United States Patent 11,180,807 (METHODS FOR DETECTING A GENETIC VARIATION IN ATTRACTIN-LIKE 1 (ATRNL1) GENE IN SUBJECT WITH PARKINSON'S DISEASE) - sequence listing, part 48

SEQ ID NO: 755 - DNA, 634423 bp, Homo sapiens
aattgacgaaagcagcctccgcccggtcgagccagtctctcggttttctcggcggcttcttgaggatgaggcatttctaggttttctcctcctcgagcaaatcacggtctgcgccttccgcggctctgggaacaggtgagccgtgcggcggcgcccgcgggacgcgctcaggtgccggtccccgcccgccggcccctccctgcagcacgcggtccgggcccaggtgccggggcccaggtgccggcgcccaggtgcgcggggcacggggctgcagctccgctcggcatccgacagcgggcgccgctgcagcagctcgcgggccgcggagctgaacggcttcgcgagttggggcagctcctcgcgctcggccctgctcggcggcgagagctccgcctgggcgccgcgttcctacagccgccggagccgccaggcgccgagggaacggacagacctccgcgcacccttgccgaccggggcgggcagaggcgggcaagcggcgaacgcctgggagcgcggagagccaggccagcccggagcgcgccggggacaccctgtgcgccccgagtcccggcaccatgcgacccgccgcgcgtcctcgcgggcccggggcttcgctcttcgctcgctgagcccctgcgctcgccaccacggaaactcggaaagaggaggcgaggctgtggggagcggcgcggagacggactagacttcccctccgcccccaagaggctgccggtccccggttccctgggcttctccagctttatcatgaacctggcgcaaggttggctttaggaaaaattctggagccagagggagagtcaaggcaattctttggttgctaaggtaattgtagttgtgataaaaaatgggcaagaaacaaatgggggaaaaacatggtttaaaacagtatcctccctccccaccccattaatatgtgttgatttcatctcctgggtgtgggtgcttgtccatttcagatgcgtgacaggtgcccgtgtgtgtgtgtctgcagtttgggactgtggaagcacgagcttacataagtggttaggcaagctggcgtgtggacttgtgtgggatgggtgcaggtctgcatataaatcatgttcctgggtttctgggtgtgaagcgcacaccgacggggacgagagcgcagaggatggcgcttttagatacttccagtcttccgatgttgtgatcgcaggtagggcagctttgcctctaatcaggcgttcattaactttttccctgaacaagctcgcccatttgtggtttggaagaaaagaaagcgagtctccgcggtgaggtgtggagggcaggggcgggtggggaggtttgttgtttgggaactgcgctagcaaaggaagcggtggctattcgcttggagaggatgacaaatgaactggttgcgtgaggagtgaagagaccgtgtttacagtcaccagcaggctgcgtaaagaagtggcccagtgagacagggaaagtgacccagaaaatttagttttgttcagaatgaaagctgctgtatttcatttttgtttcttaatttgacggagtaggaacgttattttccttctctgtcattgagaccagtagcatttctatgttacaaactgaagatatttggggtctcgtcggcttgggattatcaatgcttgggaggtgagttctgatcaatacctttaacaaccccaaagaaaaacgcaaaaataatcaagtttaggtaaaacttccactggactttctttccagggagggtgagagatggaagaactgggcttgtaagtatcaaaatggagttagagaatgagctacaagtttgtgtgtgtatggtctgtcaaaaagtgttaagactgaaaggaaactgttaggtttagttaaatgtgttgacaacacggctcttacatatcaattttcataggcaaataggtaattacatagagtgggaactgggactatggtgggaaactttctgtaagatgtatattctttattcttaatttatcactttttcaatgggtgggactactctgtgaaggaaagtagagggctgagggacatttggtgagactcttgagagagaaacctttgcaagccaaatctcgcatgctatagatgataaattctaagttctttgatattgtaccactcttaagctaaattgtcctgtaaatatgatctcatgcaccataaactatatatatgtagagagagtctattcccaataactcatcctttcctgaaagagtctgcaagttctataaatgtcagctgttgggaggtattgtgatgaaggagagaggccaccagtgtttccttttatatatttattctggcagatcttaactttacttctgattttctttaaggaatttcagttaacattcactgaatttatattgctgagagtttcagtaaaacaagactagattttctttgaagcaataaattcatcttatcaagtgaaacattatgacaatgcttttgtggcagaaatgtttatttaaatgagtccattttaattatttatttatttttgacttgcagaataagatctgcaacatagatgtttttgaagtaagtagacgtttcttgagaaagaaaaataaatttaggttactgtggacaatttgccagtaattttggatgtctctttgtctacagggacataattttgtgtgaaagtagaatcattccatttcttatgtctctcatcttctcccatgcattttatcccctgaactcctaagactttgccaggaattgctgaacattctgtttcgtgccaggggttaaatatcaggggatggaataaggagctgtgtgtcacataaacatttttcaaaaggatgctgtcagagatctcaataccgggattaatttttcctttagctttgcagttagcttgtcttaattggtattgctctgaacctaggaatgcatttaacctcttcattttcagtttccagctggaaggaatatatttaccaaatttcatcttctttgtaacatatggcatgatataaataattactatacacacactatcctgctgtaaggaaagaaatagaattacaaaatcaactttcgtgttgagtgatatggatataatatttcaaaaaacaattttaacttttcccctgattccaaaagtaatatttagctattgaaacagttcaggaaaatacaaagaaaaaaataaaggttatccataatctgctagggagagggagccactgttaacatatctttaactgtatattcttccaaatattattctagtcaattatttctacccagtccccctcccccacacatttttataaatataaaatatagcttggaaatataacttggaaatgtgttaaaggcttgggaatttactgcttgtttacagaatgattttgatcagatattagtttttactggtggtccttattttcaaaaagagtaggttctttctttttctgttctttgaaaacaagtgtttgcactttgggctggtaatgcttggggcttccttttgaatttagggattaaagcatcagaaaagaagtagaaaggtcattggccattgtgggtgggagacctgagttctggttgcagttactccaacttctcctgtggcctctgggcctctgtttccctaaagggcaaaaggtacttttagatttaactaattaagctaatgacgtatttattgctttgacatgagaatgatctttgaagagggcttattcaaacacagaaacacctgggggtcatcctgggagtctctgattgattctgtctgagatggggcccgagaaggtacatatctaacaagtccctggatgatgctgactgctggtttggtgacagtgaaaactagagggttaagtgtactagggttctcttagagggacagaactaataggatatatatatatatatatatatatatgtacatatatatcatatatacatatatgctatatatatgctatacatgatatatatacatatgatatatgtacatataccatatatctataaaggggagtttattaagtattaacttacatggtcccaaggtcccacaataggctggctgtaagctgaggagcaaggagagccagtccaagtctcaaaactaaagaaattggagtcagatgtttgagggcaggaagcatccagcatgggagaaagatgtagggtgggaggctaggctcatttctccttttcatgtttttctgcctcctttatattcgctggaagctgattaggttgtgcccaccagattaagggtggatctgccttccacagcccactgacacaaatgtttaatctcttttgggcaacacccacacggacacacccaggatcaatactctgtatctctcaatgcaatcaaggtgacactcagtattaaccatcaaaagcccaccccttgtcaacttgaacccatacatatctcctgagatcatacataatcttcaaataaagacaataatgaggtcaaaattgtgcataacataatacaactatcctttgtacaaccagaaatgcaccaatccccaatgcaaatactattacataaagttaacaatacttacatgctgttgtgaagtcaataaatcttatgtcacatgataaaggaaaaggaaatgaagatattttcttagtatgagtgtatatatacacaaacatgtttttaacaaaagaaggaggaaatactcttgacaattacagtctgtttctgcagctggtcacatggtcgtagctggtattgatgactaccttcttctacccattcagtattccttttgcctacagcaagcacctcagcaggttcttttccctggtggagtgacccaaacctttattcctgaaggatctggaccatttgtagtcccgcctggattgggctgttgtagtttcctgttgaccttaatcacagggcatggtaatactgagagatgccctaatggatttcctgtgttccatatgtagtcttccttacctctgctgtggagtagtagactgatttcctcttgatagtccaggtcaatcatgccagccaacacagtaattttcttcttagcctgttgactgaaagataggagtatcccaaactgtccaggtggcaatcttaacttccagtttaatggaatcgttgtgtttcctggtggcagtgttcctccctctggaactaagatctctaggccagcagaaggtaatgtcttgggaacaggaagcaaaaattttgctagtggatcagtaggggtgatggtgagtggtgccacttccacttccgccccttgattcctggacctgtgaatcctggctataggagaaacagtaccatatattggatgctgattcagagcatacacggccctctggagaactctgccccagccctgcaaagtattgtcacctagttggcattgtaattgtgacttcgaaaggccattccaccattctatcaatataactgcttcaggatgatggggagcatggtaagaccagtgaattccatgagcatgaacccactgccacacttctttggccataaagtgagtgccttggtcagagacaatgctgcatggaataccacgatggtggataaggcattccgtgagtccacagatggtagtcttggcagaagcattgtgtgcaggataggcaaacccatatccggagtaaatgtctattccagtgaggacaaacctctgccctttccatgatggaagaagtccagtataatcaacctgccaccaggtagctggctgatcaccctgagggatagtgccatatggaggggtcagtgttggtctctgctgctggcaatttgggcactcagcagtgatcatagccaggtcagccttggtgagtggaagtccgtgttgctgagcccatgcataacctccatccctgccaccatggccactttgttcatgggcccattgggtggtgacgggtggctggggaaagaggctgagtggtgtccacagaacaggtcatcctattcacctgattattaaactcctcctctgctgaggtcacccgttggtgagcacttacatgggatacagatagcttcacagtttttgaccactcagaaaggtccatccacataactttttcccaaatttctttgtcaccaatttttcaatcatgcttcttccaagtccctgaccatccagccaagccattggctacagcccatgaattgatatataatcgcatattgggccatttctccttccatgcaaagtgcacagctaggtgcactgcttgaagttctgcccactgggaagatttcccttcacctctgtccttcagagatgtcctagaaaaggcctgtagtgctgcagctgtccacttttgggtggtgcctgcatatcgtgcagaaccatctgtgaacaggccctagtcttctcctcctctgtcaactgatgatagggaactccccatgaggccgtgggtgcaggctaggggagagaaggcagggtggcaggagtggagaccatgggcacttgagccacttcctcatgtaacttacttgtgccttcaggacttgcctgagtcagatcacgtatataccacttccatttgatgatgggatgctgctgtgcacaacccactttatggctagatgggtcagaaagcacccagttcatgatagaaagttcaggttgcatggtgacttgatgacccagtcaaacgttcagtttccaccaaagcccagtaataggccaagagctgtctctcaaaaggagagtagttacctgcagaagatgacagggccttgctgcaaagtcctagagtactccactgtgattcacctatgggcgcctgccaaaggctccaaacagcatccctatctgccactgacaactcaagcaccattggatctgctggatcatatgtcccaagtggcagagcagcttgcatagcagcctggacctgttgcagaaccttctcctgttctggaccccactcaaaactggcagcctttcgggtcactcaataaatgggccggagtaacacacccaaatgaggaatgtgttgcctccaaaatccaaataggcccactaagtgttgtgcctctttcttggttgtaggaggggccaaatgcagcaacttatccttcaccttagaaggaatatctcaacaggccccacaccactggacccctagaaattttattggggtagaaggtccctgaattttagttggatttcttatcctctggcttgcaaatgtctcaccagtaagtccagtgtgtttgctacctcttgttctctggatccaatcagcataacgtcaatgtaatggaccagagtgatatcttgtggaagcaaaaagtgatcaaggtctctctgaataagattatgacacaaagccagagagttgatatacccctgaggtaggacagtaaaggtatattgctagccttgccagctgaaggcaaattgcttctagtgggccttatggacaggaatggagaaaaaggcatttgccaagtcaatggctgcataccaagtactaggagatgtgttaatttgctcaagcaatgaaaccacatctggtacagcagctgcaattggcatcaccacttggttaaacttatgataatccactatcattctccaagatgcatctgtcttctgcacaggccaaatgggagagtcaaatgggaatgtggtgggaatcaccatccctgcatctttcaagtccctgttggtggcactaatctcctcagtccctccaggcacatgatactgtttttgatttgctatttttctaggtagaggcatctctaatggcttccatttgggctttccccccataatagccgtcaccctactagtcagccaatgtgggggttctgccagctgctaagtatgcctatgccaattatgcattctggccctggggaaatgaccacaggataagtccagggacccactggacacactataagctggacctgagctaaaactccattaattatctgacttgcataagcccctagcttaaatggaggaccacaatgatgttttgggtcccctggaatcaatgtcagctcagagccagtgtccagtagtccccgaaatgtctgatcattttcctttcccgagtgcagttaccctggtaaaagaccagaggtctccttggggaaagatgagagaaagatctactgcataaattttcagtcatgtagtggagtccttccttaaggggacccagcctcccctttgtccaaagggttctgggtctgtaaactggctcaagtctggaaattgaatgaggagccgtgattctctgtttttataattcaaattagtcttttgtccattcaacctagaagttttctgtttgtgtaattgaagtaggaatgcagtaggcttcctatcaatttcacttttaggaacaccatgattaattagccaatgccagagctctacatgagtcagactattctgattgccactttgcctctgctgtccattatggtagttatgctcaccttgcctttgatggttgagtgctgccacttgacccctgccacctggtccctgccacctctggatccaattattcccattttgtagttgagtgactgtggttcccaccattagatctgacatacagagaatggcaattacagggctcttcaaagatgcaggtgctgccctcccaagtctattttgcaaggcattggtcaagggtatatcttctggaccctcccagctgggatgagtaggtctaaagggactaatccactccaccaccccaatctccctaagcctttggattccttcctgtacattaagccaagggagatcaggcatttccagctcactcacagtgggccgcctttaagagcttgtgtctatttttccacaatttcggctctttctctaggagataagactctcacttagtgtaatcttagcagatttgaggctcagtatctgcttctgaagctgggagacagaatccctgagttcatcattttctttcatcactttgtccgttgaacttaagagcagccaacctgcttcactgtgttccttggttctccacatatggtcaaatgtgctatgtacagagtcgctaaactccctgcctctcatgagcggtgaattaggagtgtcaaaggcatttattttgcataactctctaaacagtttctgccaaggactatcagtgttttctatactattagaagtagagtccttagcatttttgggtctaatcatattaagcagccaactccagaaaccccaaaaccaacgaaagaactccattcttaatattctgttcatctagaaccactcctggtaccaaaatctgtattaggtttctcttagagggatataactaataagatatatatgtcttagggagtttattaagtattcacttacacaatcacaaggtcccacaataggctatctgtaagctgaggagcaaggacagccagtccaagtcccaaaactgaagaacttggagtcagatgtttgagggcaggaagtatctagcatgggagaaagatgtaggctgggaggctaggctcctctctccttttcatgtttttctgcctgctttatattcgctggaagctgattagattgtgcccaccagattaagggtggatctgccttccccagcccaatgactcacatatttaatctcttttgggcaacacccacacagacacacccaggatcaatactccgtatccctcagtgcaatcaagttgacactcagtattaaccatcacagtaagctccttacaggccaaaatgcctgtttgacttttcacaggctttcacagtaagctccttacaggccaaaaagcctgtttgacttttctttgcagccatccatccagtgccccaaaatatacctgccaataggtgttcagtaagcattggttgaatcaatattagttttctcttatggaggaatatctttctggagtagtcaagacaaaagaataatcatccagaatttggaaacattaagcctgtaataagagttataatcattcatggaccacactacttcaaactgcaaagaaagcaaaaatgcttataagtaggcaattaaattgaacattaaacctaatgagttacattaaataataactaggaatacctgtttgagatgttacaaaccacaaagcctaccaaatacttcaccgttacctctctcaggtctggaagaggccatttattttctaccacatacacatatttcaaaaaatggaagtttcactattaattaccctaattaccaaggcagcagataaagcaagcaatctccttgctcccctctcctcatcccccatccctcccaccaagaaaaaaggctcattagaactctaccaccattctataagataggtcccaattttatgaatgaagaaatgtaaaactttagagaaagaaattaacctgcataaatccacaaagtgaagtagcagcatcagaagtaagatccaggcctcctgataccaaagggtgttgttctttaccacttccctctggtgacattgaatgtgtatatttgatagctgggagattctagctggctgaaataccccagttagaacttttgattatccttatgtggctaccttttatatagaaaatatatcttttccttctacttaggtgttagtaacatagggtggtaccaagaaccaccatttttatgtgtggtaacttcaaaaaaagtgtaaatatttggatatgaacaaaatagatcctcattcattaatagctcaggctatgcaaatgaattgtcttagaggctgtcttggcatttcacagtaatttggttaaactatcaaagagaaagccacctttaaatctgtccatggtagagttcactcattcactagtatctgcttgacccaagaacctattttcttgcacacatggaagcatgcattctacaaagccagctgaggtgaggtcccctgcatgaatgagagctggtggtggcactcccttggaaataccccaggcacctgtgttgctctcatgaagacctggctagtctggagctcagacagagaactgctattatttgttcttaaaggagcacaacaggcattttaaaatcctgttaattgtgtttctgaaccttagttttctcgtctgtgaaagaataatttaaaaaataccctttgagtatgtgtgaccatgagaatagaggaccctgtatgaagtatggggcatagaaagcacagacacgtaagaagatgggactgtcacagcacagttcctgttttctaataatttttagagtgagtctgttgagaaataagtgtttcaggataatggttcctctttattttctgttcctgaggcattgctgtgttagtcaagcatttgatggactcccaagtctctgagaatcctgctccatagttctcacattgggatttgaggaggcttgtagaaagcaagtggcccacacatctaagtgggagaaggcagcgtgggcaagatctctgtggtagccaaagatgcctctgtttcctggaggcgaaaggccattaatcaccagcaggaagagaagtgaaaaaggagactgctgctgcattgatagggcttatgccagacacacagagcaagcccatgttttttctctgcatccttgggatttcttacagtgcttggcacatagtaggagtttggtaaatgtttgctgagttattgagttgcagagtgacagctgtgggtggaggaggaaggatgggctagtattggtaggaattcatggactagtgggggtgcatggattggtatgagtgtggatgcaaggtgcacgtggttatagccttcattcttattgcttgcttgattttgcctggcaagatccacttcatatccatgatatagtgagactgtcatcctagtttcacattattgtgtgtctattccattgggctttggtcggtttggcttttttgttttgttttataatttatgtttgtaattttatctccacctctagcacaagaccaatacacatagtaaatgcttgataaaaattcgttgcctaaacaaaaacttgctcagcctacaaaactatgggtccgtcatatggttgtgggctgatcttacaaaataacaatcagcatttgttaagctttttgcaaatcaaagtcctttaagagatgttgggtggtattatgcccattttatagatgaggaaaccgagtggaaacgaggttcagtcacttgccctaagtcagatagtcattgaggagccaagatttaaactcagatcttttctgaccccaaagtccttgtgctgttttatatagcacaaggtggggaataaacagagaccctacccttgagatcatttcagttgtattggagagatgataggaataaatagaaaattagcaataaaagatgttaaatgatagtttaggaaaaaatgcaggggattttgtaagtcagatttggtagcaaatagatgatgaagacagtaagcacattatagtttagttcagagacagcattttatcatcagatctggaagagacaggcttcaggaaataggaataaactttaaaggtgcaaaaagggataatggcaaagttttcagatgaaaggtgttaataatacagtcacgtgtcacttaatgaccaggatacatttggagaaatgtatcattaggtgattttgttgttgtgtgaacaccctagagtgtacttacacaacctagatggtatagcctactgtacacctaggccatgtggtatagtgctcctaggctacaaactgtgcagcatgttactgtactgaatactgtaggcaattgtagcgcagtggtgttttgtacttaaatatatctaaacatggaaaagatacagtaacaatatggtgttataatctcatgggacccccttcatgtatgtggtccatcactgacttgtggtgcatgactgtaattggttattaaaacaattgtttgatttcagagtaagggctaatataaactccttatagttaaagccatctcagaccaccctagctaaaataataactcctgccccttctcattgctcttcattgtcttacttgccctatttttgatcacagctttatcaccatgacattgcattatatgtacttatatattgtctgtctccctctgctagaatatacattccataaaagcagggactcttttatttcctgttgtagattcagcatctgtcacagattctgattcatactaattgtttaagaactatttgtgaaatgaaggaagaaaatgcattttaaaaatgagttgcaaactcaaacactcaatagaccagttaggtaaaggaaatgagggaagcaagtgaggtttcttccacaatggtaacaagttgtaatttttacaaatcaaaagcatgttttgtttgtacattacacagatagaaagtttttactcccagaaatacatttatatctatttttcttgaaatatggggtcatctgactcattgtcaagagagacctggataccaaataagatttccttttttctagaagcagaacagccatccacgtgtgatgatgaatggcacctgaccttggatctcagggttggggttgcattagggacaggtggagaatgtgtttaagcgagaagtatgtgctgctcagaaagccctgttgttgccaaattttaattcatttaaaaattattaaccaatttcaattagaaaaatattatgtatatctacactgcccaatccaagagaaacaccttttgagctggctgtattttatggtgtgacctctgtagaaaaaaaagattaaataacatatgcaatatattttctccttaaacttctatggaaatgctacagtgtttagattccaaatcaagcaggaagatgccattatattattttgctgaccatacatcctaatacaaagactgattcagcagctggtcaaaatagaaaggacgcattcacaaagaataaatatattgattacattttagacttttttttaggtgaagggactttcattttcaggatagcaggtagtttagggcttggctgttggtttctgccgatagccaggggtatgtgacaggagacaaagtagctgaactctcttgatctgcattcttcccagttgcagaatagggctgagaaattgtgattgctttgagatggttactgaaagagagtgtgtacctggaaacaatctctggtttagtcaactattaatggggttgcgggggcgggatgttccgtaccccaggtcacagctggcctggggtctctgctgctcctccccactccttgtcctgctggtccgtgtcagacagtgcatctatcttcctaccaaggactcatttccagataatgattaattggatatggctcctgtgttcaagaaacttaaaattctgaagaaggaaaacaaatggagagacggaatgtggtaagcaaggcctatatatggaaagttagggagagatgacttcctgctgagggatttcactgaagaggctaagtagatgaattggactttggaggacctagaggtctggggcctgcagaaatggggccaggggacagagatggcaagaatgtacttggggcatttcaatgtaaacaaaattatacaggtgatcaaatgcaaggaatgtgcaaagaatatttaataccccccatacagagtgaggtccttaaaaacctttctggcaggaggagtccgtgttgatgaacttaaaactttaatgaaaacaaggataggggaaacctaggtttaagcaaaactgttcaataagtatttgtcatatttactgaaagtaaaatgagaaaacaaaagtagattatgagtgacattttactcaccttatgttggtaagagcagtgtgccacagtgaatttccagttacttcttgctgtttttcaggctgtcagccccccttacagtgaaatgcttacaggtagttttgctttattacagttagtgtacaattcttatgcacaagggcactcctccatgccaggctcactatacaaatgttcaatgcctttcagtcagagaggctgactgctgactcctgggtctccctgtggctaaagggtaaagtggatagatacatcttggggtaaactttatttaacttagttggcatgactgatcaggaagtcctcagatacctcacccccatgcctagggtatttagtgtcatgccaaagcatatgctgccaattccaggttttcattttttggtttcctttaagctttcaaaagcttctctgcaaaaatcacttccgctgcctgccatctgccttaaaaccccctcccccacttaaaaaaaatctgtttctaatcccaagagtcttttttgttgttgttttcgagacagggtctcactctgttgcccaggctggattgcagtggcgtggtgttggctccctgcagccttgacctcccagactcaagtgatcctcccacctcagcctcccaagtagctgggactacaggcgtgtgccaccactctgagctaattttgtgtttattgtagagacagggtttcatcatattgcctagactggtgcgagattcttatattttctaattattcttaaaatgaccaattgactatcaaaaatgtatttggaaataggtataagttgaactttgcttattgggaattcttggttgggggagttttctgtagttgagattaccatgttgttgggtatatgaagatgaacagtgacggataaaactagaagtgcaagttgaggccagtgtgcgaaggaacttgaatgccatataatagtgttgatagtgatggggatttagtcttctctctgatgcagactaaacaaaaaaataccaataacccaactgaactgaagcaaaatccaagtatctcgagcagaaataaatttatctgaccacataatctgagaattcaggcttagctggatccagggacttagatgatgtggtcagcactcttactcaacaccttgtcttcttgacttcctccttctatggcacgagagaagaagaagatggtcactaatatttctaccctcacatcttttcaacagtcacctcacaggggaggaatcttctttcttccagcgtccttatctcagtctcagggaaggactttggtcctgattagtcacatgtctacgatggttcgatctgtgtgtctgataatgaggcatactctggccaggacagtccacagtggtaacagacacaacctctggctccttcatcatccctgcaattataaccctgccatgatgtcattttttgcatcactgtatgtgagagggctgcaatgccaccttgagaacccaatatgctgcatccttcctccagatctgcatttatttgcactattctttttcaaacatacagttctactgaagtataacatatttacagaaaagtattcaaatcattgttcaataaattttcaagcagtaaacacatccatgttatctctctgagatcaagaaagagaatattaccgttcttccagaaaccacctcatgggccctcccagtaagtacatatttcttttttcccattggtaactgctaagctgatttcctttctctctctctctcttttttttttttttttttttttttttaaagagatgaggtctcactgtgttgcccaggatggccaggaactcctaggctcaagcagtcctcccacttcagcctctcaagtagctaccactaacctgatttctaacactgtaactttctcttttttgaaacaaatgaaataaatatgaaatcatacatatatgcctgtacactttctttctagatccttatgcacaacattgtttgtgaaattcatctatgttgcaatgtgtagcagtagactatttttattactatatagtattctactttgtgatattccacaaactattcatctactgttgagggacatttgggatatttctaggttagacatatgaatagtgctgctatgaatatttttgtatgtgttttgtgacacacatatgaatgtgtttctgtttgatatacacacctaagactggattgctgggccatggggtgtgcatatgttcagctttattcgatccttacaaagagttttcttaagtggctgcaccaatttatattcctatcatcagttcatgagtgtttcagtttctttatatcattggtaagacttgagattgttaaatgtttgaattttagccattctggtgggtgcgtagtgatgtcttattatggcttcaatttgcatttttctggtgactgatgatgatgtgcctttttaatttttttttgccacttttatttgtcttttgcagtgcctattcaagcttattgcctattttaaattagatttttaatctttttctcattgagttgtagaaatcttcttttaaaaacaaatttttaatacaaatacttttgcctgtcatatgtatttaaaatatcttttcccggctctagtggtttgcctttcactctcttttgatgaattggagatctcactttgaatataatctaacttatcagtctctttctttatggttattgtttcctgtgcctacttaagaaattgttgcctaccctaaggctatgaagctactctgttttaatttatagaagctctatttttttttttttttgccttttagccttttatctttaggttgtaaaaatctacctgtggatgattgttgtttgtggtgtgataaaggcatccgtatttgttttgttttacttatggatatccaataaacccagcaccacttattgaaaaatctcttcatttctactactctgaaatgtcacctttgttatcagtcacatttgtggtctgtctctgtgttttctagtccattccatttttctatttctctaatataatattgataacgcactgtcttaattacgtgagctttataggaggtcttgatattcagtagtgtgcaccctctagtttgttcttatttaagaataacttctaaagaacaaagctggaggcatcactctacctgacttcaaactatactacaaagtgacagtcaccagaacagcatggtattggtacaaaaaacagacacatagaccaatggaacagaatagagatctcagaaataagactgcacatctacaaccatctcatcttccacagacatgacaaaaacaagcaatggggaaaggatttaataaatggtgctgggagacatggctagctatatgcagcaaactgaaactggacctcttccttacaccttatccaaagattaactcaagatggattaaagatgtaaagtaaaaccaaaaactataaaaaccctagaagaaaatctaggcaataccattcaggacataggcacaggcaaagatttcatgacaaaaacatcaaaagcaattgcaacaaaagcaaaaattgagaaatgagatataattaaggagcttctgcatagcaaaagaaactatcatcagagcgaacaggcagcctacagaatgggagagaatttttgcaacctatccacctgacaaagatctaatatccagagtctacaaggaacttaaatttatgagcaaaaaacaacccaattaaaaagtgggcaaaggacttgaacagacacttgtcaaaagaagacatttatgtggccagcaaacatgaaagaaaagattaacatcactgatcattagagaaatgcaaatcaaaaccacagtgagataccatctcacaccagtcagaatggtgattattaaaaattcaagaaacaacatgctggcgaggctgaggagagagagaaatgcttttacattgttggtgggagtgtaaattggatcaaccattgtggaagacagtgtggtgattcctcaaagacctagaggcagaaataccatttgacccagcaatcccattacagggtatcaacctaaaggaatataaatcattctgtgataaagatacatgcatgtatgtgttcattgcagcacttttcatgatagcaaatacatggaatcaacccaaatacccatcaataatagactggataaagaaaatatggtaatatacaccatagactactatgtggccataaaaaggaacgagatcatgtcctttgcagggtcgtggatggagcggaaatccattatccccagcaaacaaacgcaggagcagaaaaccaaacactgcatgttctcactcataagtgggaaccaaacaatgagaacctgtagagagagggaggggaaaaacacctgaggcctgttggggatggggggatggggagagggacagcatcaggaaaaatagctaatacatgctgggcttaatacttaggcgatgggttgataggtgcagcaaaccatcatggcacacgtttacctatgtaacaaacctgcacgtcctgcacatgtaccccagaacttaacataatatataattaaaaagaatagcttcattatttctaaccatttgcattactgtataaattttaaagtcatcttctgatgggattttgattgggattgcattaaatctctagcctaaattgggagtaaattaatgtttttacagtgttggctattttaatccattaatatggaatatcccttcctttatttagatctgtctctcacgtctgtcagcatttttgtatccctctatattgtaaaattattgcacatcttttaaatatatattcctagtatttgaaattattcgatgctattataaataatacctttaaaaatatatcattttctgattgttgctgatatacaaaaaatacaattgagttttatatattgaccttgtattcattgactttgctaaattcactgaatcctaatagttctgtgtattaggttggtgcaaaagtaattgcattcataaattattatgaatttccatgtacacagttaaattacttgtaaaagagttattacttttacctttctaattatcacgacttgtatttgtttttcttgcctgttgtataggctaagacctcaaatataatggtgaatagaagtggtgatagtgagcattcttgtctaatttccaatctcagtgggaaagttttccatgttttactattaaatattattaaatatttctgtaagtgttttacaaataccgtttatcagatcaagcaagcccccttacatttaaaattggccaagagtattttcatgaagaggtgttgaatttgattaaatgccttaaagccataattgcacagaatagcgggctcacctctgtacttcctttttctcttggatcatgatcccatgtgtcctcattgccttgggagctcttctttttataccatatctacctttctagattttcttgagggttggactgttacaagttagatcatcattgtaggaattggtactgtaaattcaaattgtactatttttgtctgccatctacacggtatgagtaaaactgtaaaacccccgagaacctattcaattgttatttctttgatctatattgcttttggctggtaagctttatgaaaagattttcttttgttaaattttgctatcttaagaggaaaagtctaccattgctgctacaaatggaggcattatggagtcattgaaagggtgcaccttatattacatttaaatgccatgttttacatataaacatactgattttacctgttcctttttaaaaaagaaagaaaacaatgaaatcccaaggaataaaactgacattctttaaaaaagaaaaagccaataggagtgcttttcttcttaggtcccctgggaacatgtcatcctcttcatctcttagtcatccacttcttgtgtataaaaattggcaacgcttctctgtcactcccacttcttctctagcagtgatacaatctttcatgcgaaataagagaataataaaatgttatttctgcagtcccaatagtcagtagtattagaaactataatcttggaacccatacttaacaaaatataagccctctcatgtgagaagagagggaagacccaagctctaaatgctgactcattgctaaccaggagggtggcattagaacgcaacttgaccttcccaggtcttagtgccatcctctgaaaaccaaaggcttggacttgttcaagggacagaaaaaattgtaatgtaaagggctaaatagtaaatattttgagttctgtgggccatacagtccctgttacaacaactcaattctgctgttgtggcacagaagtgatcatagacaataagtaaacaaatgggcatttatttataaaagtgtatttatggacacaaactcaaatttcatacaattttcatgtgtcataaaatactgttctttcaacttttttttcaagcatctaaaaatgtaaaaacaattcttagcaaagagatcatataaaaagaggtaacaggcttagatttgtcccatgggcccaagtttaccaacctttgagtcagttaaattgtcaagggctgttccagagctctgtgttaggcattcatatgctagccttttaaaaaatattttttttgtcctatgaacattattcaaaagggtctatttttttcttttagaccaattatgaataagaaaaatacaatatgttgtttttacctttattccttcatcagtgcttgttctttctttttagagatccaagtttctgacctgtataattttcctctgcctgaagaacttctttttgcatttcttgcatagcaggtttgctggtgataaatttcctcagtttttgcttgtctgtgaaagtctttattttttctccacttttgaaggataattgcactagatgtagaattctaagtgggcgtttttttttttttttttttccttcaacattttaagtatttcactccacactctggcttgcatggcttctgtaattcttatcctcattcttctataggtaaggaatctggcttcttttaagatttcctctttgtctttggttttctgcagtttgaatatgatatacctagatgtagtttttctttttttgggtgtttgtcctgattggtgtttactgacttttctggatctgtgatttattgtatgtcattaattttggaaagttctccgtcattattccttctaatatttcttctcctttctttcttctcttcttggaattctgattacatttatgttacagctttttatattgttctatagttcctgaatattctgctctggtttttttcctcccttaattctctctctctttttagtttggaaattcatgattgactttcaagctcatggagtcttaaaaaatttcttaaatttttaatttttatgggtacatatgtgtatacttatggggtacatgagatatcttgatacaggtatgcaatgcataataaccacatcatggaaaatagggtgtccatcccctcaagcatttctcctttgtgttacaatccaattacactcttttagttattttaaaatgtacaattgagttgttgttattgacattagtcaccctcttgtgctatcaaatggtaggtcttactcttcttggccatttgagtctgctgatgagcccatggaaagccttcttcatttgttacagtgtttttgatttttagcatttccttttcaaaggagttttaaaaaaatgtttccttctctctggtttcattaccatttactttctccattagaatccttaacatttttcatcatagttattttaaatttcctatctgttaatgacacagataattccaacatccgtgacatatctgagtctgattctgatgattgcttgtctcttcagaatgtgtttttcttacctttcaccatgcgttgtaattttttgttgaaagccagacatgatgtgttgggtcataggaactgaggtaggtaggcacttagtgtgaggttttacttaatctggctaggagttgggttgtgtttagtgtttgctgagctgtaggtgctagaggcttcaaatccccccaagggtccttgtttttgtctcctctcttgactttaggtttccctaactactattcctcagggacgctgtgtcttggaagtcttttatctgtaatccactgttacacctgagcccggctggtgtggtggtagggcatatgtgagcagtaatgttctattaaccatctaattaagagcaaggatggaataacttccctttggtaaatggtaacgttacaggaaaggggtcccaatccagaccccaagagagggttcttggatctcacgcaagaaataattcggggcaagtccgtagagtaaactgaaagcaagtttattaagaaagtagaggaattaaagaatggctactccatagatagagcagccctgagggcttctggttgcccatttttatggctatttcttgattatatgctaaacaaggggtggattattcttgactcccctttttaggccatatagggtaacttcctgatgttgccatggcatttataaactgtcatggcgctggtgggagtgtagcagtgaggacaaccagaggtcactctaatcaccatcttggttctggtgggtttcagctggcttctttagtacaccctgtttatcagcaaggtctttatgacctgtatcttatgccgacctccagtctcattctgtgacttagaatgcgtaactctctgggaatgcagcccagtaggtctcagcctcattttacccagcccctactcaagatggagttgctctggttcaaattcctctgacagaaaaactttcccccataagaaaaaggaagatggagaacatggtggcttcagtgagggtgtctgaagatgagggacttgccttctgctggcttccatttcttccatgaattttgaagtgagctcatcagctaagactatgtgttaaatatgagctgggaaaagatatgacatagccatctcagaaagggagaaacaagcttggtaggaaaacattttgggtttggcaggcagtgttgactattcatttaatgtttgtggccatgaatttaatgcagctagtcagcctggttgtgtgacttcctctccatcccaaagtgttcatctgtttggatgggagcttggggttggtggatagttgggttccatcagtgttggaatttggtaaggatagtgtgacacagaaagggggtgtattagtgttccctagagggacagaactaatagtgtgtgtgtgtgtgtgtgtgtgtgtgtatattctatttttatatatacaatagtatatatataacagtgtgtgtgtgtatatatatgtaggagtttattaagtattatcttacatgatcacaaggtcccacaagaggctgtctacaagcttgaggaagaaggagagccagtccgagtctcaaaactgaagaacttgtagtcccaagtttgagggcaggaagcatccagcaagggagaaagatgtaggctgggaggctaggtcagtctcaccttttcatgtttctctgactgctttatatttgctggcagctgattagattgtgcccaccagattaagggtgggtctgccttccccagcccacggacttaaatgttaatctcctttggcaacaccctcacagacacacccaggatcaatactttgcatccttcaatctaatcaagttgacactcagtattaaccatcacaaggggagatgcaggagtagagggtatgtgcaagggagtgattatgagtgagtataatgatggagccagtgtgaatagtgaaggtgaagcgaagggtaggaatggatagtaaaagtgctgtgtgttcaatggattaaatgtctaaataagtttgaagattgtttgcagtgaatgcagagtaagtaagtgagctgaacagaggaagggtggacagagtggaggatgcttgtagtgggatttgaggtgatgacaaagtttaggatgtggccatgtgagatagtgactcagaaggaaaaagcttcaggtgaggaaataaggaactgagaaactggcttttctggtaggtctttgactctgatgttaaagtcactgaaagtggtgaaggtgttagggaagcagaagaaaccctctgagaggcggaagctggagtcttcagggaatgagaaggcataagcaggagggaggtgaaaaacagcagtgaggatgagcagaaagtggcagagccagatggcctgagtgccacagagcagggatttgtgttggagggagggagggaaatcatttgaaggagcggtggagagccaggaggctgcctgccctactccctggtcttcagatatatgacgtgaggacagagggctgtaggagaggagaaggcaagtttccattaaggtcacagaaggttaaagttcagagaggagatggaaggacatagtgggcatactatttacagaaatgttgaaagggtgggatgagtctgtggggagtcggaggggttggggtttccagagcagcgtggagttcagagccctggtgagagaggatgactgggtagacctggctttccagcagagattgcagtaacaggactcccagggccagcatgccctgttacatggctatctttccacttctccctcctagcttaatttttagaaactttaacagatggaatgcaaaatttttatttttatttttacttcagagatcagtcctcaccctgtcgccctggctggagtgcagtggtgtgatcatagctcagtgtagcctccaactcctgggctcaagtgatcctcccacatcagcctcccgagtagctgagactacaggcaacgcaccaccatgcctggctaatttttgtatttttttgtagagattgggtcttgctatgttgcccaggctggtcttgaactcccaggtttaagcaatcctcatgcatgcatatatatatatatatgcagctttgataatttaattagtttagcctgtcaggcagctgtgatagtgtagagaacgttgtatttatttgtaagtcttaaggtaggattggaatggagaagtcaacttcactgaaaactagcaagtagaatgaaggaaacacagattagttgaggacctactatgttccaggctttgtgccaaacatctactttatgtaggtgatttcacaagatggacatgttggaaaaactgtgggcattggaatcagtcctgggtttgaattttagttgcttggctgacaaactgtgttactttgggcaagttacctgtgctcttcagtcttacttttctcatccatagcgtgggaataataacatccacctgttgtggttgctgtaatgagctgtgcaagaaattctaatcagcaggccgggctgagaaccactgctgcagagtgattagcatttgttccattttataggtgaagaaactaaggcccagtggggctaaatatgttgcttacggccacacagcacttaaatgatatagccaggattgaaagccagttttttttgaccccagaaccttgttgtatccatttcattgagtttttgccttaatacatgggaagctaaaggagcccccccattagcatgtctgcccaaacatcaggcagcatgggatgggaggaagggatcaagtgaagggaaggcaggctccatggaatctaggtcagcggtttccaaacctggctgtacttacaaatcatctggaaaatggttaatctgtaaatctccagggaccaccctaggcctattggatcagaacttctggagcatgggaaccgggagtatgtatatttagaatatctcccaggttattctgagactgctagcctagttccggtccttgggcaagtttttgggaaccactgaattctaatcgatgtcctaaaatgattaagtgattatatcccagtaaaatactgggtgtcttccagtgccaccaaaattggcctttaggggttgagtgctattgccgtactttaagatcttggtgcattacctgaaacggacactctgtctgtcattgaacatttgaacttcgaatatataggaaatgtcaagttggcatactctgctataacaggaagagtgatttgttatttagagctgttgttcttccttctttccccttgggattcctgcccactcagtcagattagagctatataaacaagctcgtactactgagctagcacacatcttgtaaattttttttcctgaagtgcttaacgttgctgatgtcagaaaaaaaaaatccattgggttttaatgggctgaggcaaacaatgagaatttgatataatatggaggagaggaaataacttcaacagaaattcttatttggcagcataaatattcaaactatattacagtcagagtttgattgcttctcctacatggcatttccctgaatagggttttgagggctgggcactaagagtggcaggcatgatgtttaaagcatttagttgcaagccatggtaatttcagtgacattgtagggtaattgtagttggttctcctcttagctctgtgtcaggatcacctgaggaggttgttggaccgctgaaggcttcatctctgatgcacgagtcagaacatctgagggtgggggttggggtgggattctccattgaatctgatgccagtggcctgggaatttcacttggccaaaccctggcttagaacaaggtcactggtcagtttcgatattcattctgtgctggggcatttccatgacttagtgtcttccctcttcaaaagcaaccctgcgtgatggaggggtctcatcttccaggcaaggagctggaaacgtagggtgggagagcccattgtcaaaggccacatagtagccttaatgaggctagagctgagatgtgattcccagtctgacttcaaagcccttccttttcctataccatcgaggcccttccttcctgctctgctcaacattgttagctgccgaaccctaggctttgcttgttccagaggggctggcattataaagtaaacagcaggcatttattgtaactgcaagttacagatgcagtgtcagtttggagtagacttgcaggcacaatcctgactttcaatgattcacgaatctgtttgtgtcacaggtgctcaattgtcctattatgcatagagcatccccttcactatattttcttccctcaccacatattccttcttacctaaattgcttatgaattccagaagtggattgctgagtccaggctggttcatatcaataaaccttggggaaaatctttatgtgtgatgctatacatgggtctttgttgatcaagagtcttctttattggccacttttaatggcttgttatccagatgaatcttctggaaggaggacactgcatcctggtggaattttatcagttccatcattcattcaaacatatttaagtaccttctatgtgccaggttctgctctaggtgccagggagagaggggtgaaccccaacgataaagtccctgcctatgaagaactgactttctagagaggaagtccctgatagacaagtaaacaaagtcccgcagattcagatagttgcgaatccctgttatctcactctccacacttggctgtctcccacttaatctttctgggatcagattatctttgtggcttttttctcttgactgtctagcacaaagctgagccgcttctggggcttcagatttctatgcctgtgtgtgtgcatagccttggctggaatggcaaactttgcctctcccaggcttctgctcatctgtcacctcctcctactctgtgccatcataattgagcaaccacatattacagtgtcctttctgtgaacacatctgttattcctaccggtctctgaacattttaaggagaggatctgtgtctgacttatctgtatatccccagggcctagcatggaaccttacaaaagtagatgctcagtatatttgctcaaagaataaatgatgagttccaaagaacctgagggtgggtggtgtggtataggaattccgtcatggggagggatgctgagtcagatgggggatgctccaccgcagtggttttgtgatttattctttgagacattgagtgctgtcatgaatagaggagatgggctgggatataggcagtattgacagagacacgtggcatggaacattctggtgagaacctttgaaggaaagttagaaatgtgaggttctgagggtctagctcagagctggaaggaactctaaggttgctggattttatagccaatgcccaactgaggtccagggaagctgtgtgtcctggttctgatagttggttagttgcaaaggagctaggggtggggtgataccaggactcctagttcagagggctttccactatgctggggctatggtgtgtgacagataacagattaaaggcacagagaggagaaggaacttgcctaagatcacacagctaggaagtggtggagcctggatttggacatggatctgtctaatgagaggcatcttgtaaccatcaagctgtattgtctcttcttgaagactgtgaaatgcaaggtcctagcccattttcagttttcctcttgggttagctgtgagtccatataggaaaataatattaacatgctttctttcttttggtatgcagttacatgttttcagaaaaatgttcacattcttcaaatgttaatattgaagcccctgggttgtttactgtgtgtatatatatgtatatataagtacaatgaagaacattctgtttttctctaccactaaatttaaacccatttctattgtactccatttaaaagaagtattttacatcatactataatgaatgaaaacctagtcctttaatttcacaagccccagctttaatagtcaatgaatttaattagaaaatctttacctatgtaggtttcacatccagttctctataacatctgttgacctatggactagaaagtatattattattttagaaatgattctttctagacacaggaaagctaaatagcttgtctgagtttcaaaacgagttaatagaggaaccaaaaatagaaacatttctactgaatacgaggcttactaaaattcttcacacagagactatctgcattcacttagtagtttccagtctagactctggaacatcagcctgttttaacacacacaaatgcttctgttggtgggagggggtggctgggcagagggaggccgggcagagggaggcctgacacgtttgtttctaggtcatttctaaccttgctattataatacagttttctagatagaagagaatgtgctcattaaagtgttcattttaaaataaagcgacagaaacttaaaacgtctctattacatggatacatgagtatatataaatgaactcaatttttgttttcatgctctgttgtattctgtattaaggcaaaggagtaggcaactaagtagttgtttaaaaataaaactgtgtgttgttcatttaattttaaaagccattggttagaatggtaatcagtgtttccatgtagtactatattcatagaaatcctgatattacagtgtatagagataatattatagaatgatgctctttacctctttatgtaatctaattttaaaaaacattgtaatttataaatagtgaagaaagcaggtagtgttattcgaatgggatattttcggcaattaaattcttagcataaattacaaattcctctctctcccattttccacccaaatttgtttttatggaatgacctttggtagcaacttgttttataataaaatgtttcctgaatttgtattttgaattgaaatggccttttctgtcacgtatggtatttataagagtttctttgatgaaaagcctctgaattttgtgcaaataacccaggcagcctcttagatgagggataacatttgtataggacttttatggctttatactctgctctcatactcagcttatttgacccttacctgcggggaacttggtggaattcacattttactgctgaggacaatgtagaggaaggtgccttggcatgactcagagcatatagcaggtgtttggtatgtttgttttaaagggaaattaacaaaagaaacccaaaagattcttgtacttgctcaaggtcacacaataaatatagtgtcataccaaggattgaacttccttcttcactcaaaacttccatatacttgttcttatctcactgttatcttttcaggcttttcaaaaaggccacattaaatatatttatttttcttaattgaggtgaaattcacataacacaaaattagccatcttaaagtgtataattcagtggcatttcatgctttcacagtgttctacagccatcacctctatcaaggcccctgaaggagaccctgtatccattaagcagtcacccattccatcctccctgcagctactggcagctaccaatctgtttcttgtctctgtggacttacctattctggatatttcataaaaatagactccagcaatatgtgacgttttgtgtctggctttttacacttagcgtgttttcacttagcatgttttcaaggttcatccacgttgtagtgtgtgtcagtactttatttctttttattgctcaatgatatcccattgtatggatatacacgttttatttatccattcatgcactgatagacatttgggttgtttcccccttttaactattgtgaatagtgctgctatgaacatttgtgtacaagtatttgatatttgttttcagttagtttgtgtatgtacttagaagtggaattgctagatcatatggtaattctgtgttcaacttttttgaggaaacactaagctgttttcagcagtgactgtgtcattttacattcctaccagcaatgtttgaggattttgatttccctgtatccttgccaagacttacttgaggttttttttttttaaattataataatcttaatgggtatgaagtggtatctccttgtggtctggattttgatttccctaataaaatattcatattttaatgcatagaattaatcagaaaatgagctttggcaaggtgaactcaacagcaaaatgattggcttcaactgtcttcaggagattatttaagactgccgtggctgggtgcggtggcgcacgcctgtaatgccagcagtttgggaggctgaggctggtgcatcacctaacgtcagaagtttgtgaccagcctgaccaacatggagaaaccctgtctctactaaaaatacaaaaatagctgggtgtggtggcacatgcctgtaatgccagctactcgggaggctgaggcaggagaatcacttaaacccgggaggcggaggtttcagagagctgagatcgcgtcattgcactctagcctgggcaataagagcgaaactctgtctcaaaaaaaaacaaaacaaaacactgctgtatattcactcctggggtgtgcgattctgagctgaaaatcaataacatgttgtttggggattagaagaatatttgtggatagtaagactgcaatcatcccctaactttaaaaaatgtatcatgtaatatcatgtttttgttcatggcatctgccaaaagttacttaattctttgcatttcaaagccctctttatataattccttcgtgacttaatggtttattcatttatttttgcagtgtgagtgaagacactcaggatggctcaaggatccggggatcaaagagcagtgggggttgctgacccagaggagagttctccaaacatgatcgtttactgcaaagtaaggcgcctggtcaagtgccgtgcgtgctgtccgtgtggactgttgtgttctgtgtagggctgataaaaagacaaatgttttctgcctaaactgccttactgataaatgcatattttcttctcacatcctctggttctctagttctaaaattcaaggaagttcatacttgagcacttggtatttaacacttgaaaaatattatgccatttagttttctttaaacccaaaggttgcctaagcaatgcagatgggaagacacattctccttcagtggaaaggccttagtgtaagatgtatgaactgaaagttcttcagactcgtagtatgtacaaaatctgggctgaatgctgtgggagatagagaggtatatttgtatgagatgcttacagttggtaggagacataagatgtacacaaataactgttatagagtctaaatgttaatttccaaaatagatgtgcaagtagagtgttacataatttcagaggaggaggccagttctcccagcctcagaggtgagaatgggcttgtggaagagtggtctttgaactcagttttaaaatatgtgcaggattgctttatgtggaaagcagagaggaagaacataccaggtgatgagatgtttcagcaagggcacagagctgaggaaagtaacagcaaccggaactggttagcttggacataggatgcattacaaggagtaaatggagataggattttgggaagagaggctggctggagccagatgttagtgttgaattagacaatttaatcaagaaaaacttctgtgccaagagttgcaagattgagatctctttgggattatgactgttgccccattgtgctgaatggattgttatcaagatagagcggaggctctaggagagagatttctgtgtctgtgtgaaaggtaaggagggaaaggagagacactaatccagcctgtgaaatcaccttcagaattaagagaaactgataagaggaattaaagtctggattaaaaatgacttggaaactgaaggaatataggcggcaagtagagggtcaaagatgacggggtttttgacgttgggtaaatgaaaatcattggtgctattaattcaaattgggatatttggaaaaagaatacattttaaaggaagaaaatggcacataagtttattttagtacatgctgaatttgacataattgcttcttattgtacacctttttgatgtttgcatgtttgtgaaaatttaaactaactctcttgtatgttaataaggaaataagttaatgttcatttcactaactacttgagtttctactcagttctgtgcattctgagaggctctgtgtattacttatatgggcaatgtggaactagatattcctggatgatcaatatggtgaatttttctcttttccttgtaaaaatagagttctcaaattattctggctttgagtgtaagattctgtaattctttgctttgcaagagaatgtctagataacccatctctaagaatcatgcttattaaattgcgataaagaaaaaaataggttaatgggactcagcaattagtgaaacatacagaataatagacattgagtcattgttactttcttaacccacccccaaactgggagaccccgtgccaggctggtaggaacatgggctttggagtgagacttaggttaaaatgccaactttaccactctttagcagtatgactgtaagttagttctttaacttccatgagccacaattttttcatctgtaaaaagaaaaaaaaatgtgggaggaaggtaattgtgaagatcactttagataaatcgaatgaggcatcttatatcctacttagaccacaatgtggtccgtaatgaatatctctttttcttttcatgtttaggtcttgtagagtcagtgacacttggagaggaaataaatgataaaatctctaaatgttggtgctgttaataagttgtctagagcaaatttatacagtgagtttttttttaagacacaggaaaacaataaaaatatttttatattcttcagaggattgcaaattcatggattattaaagaataagaaatgcaaaggtcatgtaacccaaccacctttctactagaatgtttgtattatgtttacaggaaaaaaaaacttcctgcaggtttatgagaacttggtttttactttttggtggtagtaaggggcccttttctggtttaatttagtaactaacatgtcaattgctgtagttctttagagaaatgacaactagtaatgaaactatatcttactttcgtgtgacaaacttgtgtaaagagtatatatatatatatatatatgttcatgtttatttgctatattaattaccataaaagggacattgaattggttcagtctgttagaaagaagacacacttattgcacagtgtgagctcaggtcctgacaccattttaaacctagttaacctgactgacttaaaccatggttgtacttgaactatgggattttcatatagttttctactcctgatgctgtaggctgccttttggctacaaccaagaacttacttgctgtaggacattatcctcaaggtatcatcagtaagggttggattgtgaagccaatgacaattcaaagcattttctttggaagtccttttgtgtaatcaattattcaaagtcatagccataaacccaaacctttccttagatacccacgactacaatttacatttaaaaaattgtgctttcatttttgttttctttctcttgtttgttgttgttgttttttttctcttgttgtcagacactttcagtgtgaaatttttgcttggactgcattgtgttgattcagatgctgacatttaaaaagccaaatctagagaaatgaagcttttgggtaaactttcgagtaataagtggatgattatgtccataatgttgttgtgacttttaaatgacatttaggatggtaacctcctgacatatgagtaatgatgggtgggtttttaaagcccacacttttcagaacactcttcatttccttttcatgttttcatgtcattaactgtgagaagttgtactttcccaaggcatgacttatttattgacttgaacagactttctaatttagtttttcatccctcatattcacagtttggattggaggtgtgtatgaaaaatgtattggtcacattaaagatctatttaaaagaaaaccttaattattcatgaagacacccagacctgttaaccttttttatattcctgtatccttaggatcctgagttactgaattgcccagtgtaatgatgatatttgaacctagctatacatcacatcatttagggtgctttataaaaatgttaatcctcaaaggaccccctccacaaggtatttctatttaataggtctgagctgggtcctaggaatctgagtttcaagatgttctcaggaaaatctgatgcccaactaagtttgaaaagcacttacttagtcttttacaatatccagacatagtatgtgttgcaaagtaatgagagagttggtgttttgaattagatttttgatttcataattatttgtagatctctcaaaacgtagaagaaccaagctcttgtcatagggattttagtagcttttccttagatattttctagtcttattttatagatgaaagaactaaaagtatagagagggtgagtaacttgattaaggctcctcagcactttcccatggaagccataatggtgtccagggagcctggccactccaatcagttgcctttctagcaccctatgcgactaccatgttatcaaccacagactactgttaccacattgttggagctgagtagccatggggcacattaaattaatgaaaataatatgtggcagatctttgactttcatgtttcttctgggagagttgacttggattaatgtctcacttttttattgatttttaaaaaatactttaagttctagggtacatgtgcacaacgtgcaggtttgttacatatgtatacatgtgccatgttggtgtgctgcacccattaactctcatttacattaggcatgtctcctaatgctttccctccccactcctgccaccccacgacaggccccagtgtgtgatgttccccttcctgtgtccaagtgttctcattgttcaattcccacctgtgagtgagaagatgcagtgtttggttttttgttcttgcaatagtttgctgagaatgatggtttccagcttcatccatgtccctacaaaggacacgaactcatccttttttatggctgcatagtattccatggtgtatatgtgccacattttcttaatccagtatatcattgatggaatgtctcacatttttaatgctaaagtttcattctactcattggtgcttttgcttcttcggtaaagattttctaaaatgtttacataggtaagattgcttttgagtaagagtaggttgctttctgattttgtttggatctttggtgttaacaatgcctcttgacaaagttctcctaactagactggtaatttgatttgtttgggtcaggaggcatggaagacatcacactctggatgtcttctacatccagaaggatggaggcatggcagatgtcacactctggatgtcttctacatccaaaagctggaggctctgcctgtctggtcccagctttgtgtggagaacttcactttcctgattctacttcttgttttgttttctaccttcttcattcttttcctccttccttttcaattgtgagatacttctaacacaaaaagaatatattcagtgtccatgtaaagtagaaagaattaaaaaatgaattatatgcactcaccattagcttaataaataaaatgtaatactttggcctcatttccccttctgtaaagggaggaaattggtctaaaaatgtacaaatacctttctgcaatgatttcaaagttccattctataactttttgatctttcgtaaattagtacacttccctgatatcaaaacaatgttgtgagactatatgcacgtttaaaggtcttttgagcttttgaagaaatattttagatagttgtaggtaatctaaattggattgagataaagcccagttaagtcaggcattagaataaaaagctttaattgtaattatttaatattcaacagtggaatttagatgacatcttggtggcaacctgtttctttggcttgctaataacatttaagacatttataaaattatcattttgtagtattaattatatgctatatacataacaagtggtgtttaagtagcaacactgtacattgccagtagtatatagtgtcatagatgaaataggggttttagaggaagacaaaaaaggccaatgttcttgtatatcaacaggttagttgcctagcctcgtcactgatggcttccttcacctattcatttctagttattgactccttttctgctggaatttgagtctagcctttatgttgctctgataccccaaggtcactcttcctaatgatttagggcccttgaagtcctgggcagttgttggtttaggcatacatccagaaagtaaatgtcacactattttagttacattggctgtggtatgcagcaagaagggaaggatctagcctggaagaatccgatgctatggaggaagctagggatagagtgtggtttggaattcatagagggcagtggtagaagccagcacaattgagagtctggggacctgcaggtcctggtgactaaggcatgatgaggattagaaactgtcgaatcaggaaatacgtattgagtgtcatttgtgtgccagacactattagatgctaggaatgcaagatgagaactgagccctgaatgagcccacaggccagctgggggtaaatggggaactagacaattacagtgttggtagaagcaactgaggggcatgggaggaggtagaggggtcatgtagtccatcccaggagaggggatgatgatgtagaagacatccagaggatttggcacctgcttcgattcttgaaagatgactaggaattaaccagatggaggaggagagagaaggtgtaggaggcaggactagcacctgtaaaagagcagatttgtgatgtcgtataccgagttcaggagactttaagtggttgatatgaagctaggtttctgtgatgaaaggttgaggaatagagctagacagatggattagggccagatcacaaaagaccttatgtaccatgccaaggagtttagacattgtaaaagtatcttccctttgggcctccacacccaagttcaactcctttgcatgctgctgtctgccccagaggctgagctgtgaggactacatttacagggctcctgtgacctctgggtttcagttgggtttggttagtaaaagtctggaaagagatgggagggaaggagaatcgcaatgtcagagaatttcttctcctgggtctcactctgcaaaaccttgcactggccatatccgtctactgaagtttgttgattctctcaaggcagactactttcctcttctgggtccggacatcctttttgtctactcatccttttgggcctttgccgactactttcctcttctgggtccggacatccttttcatctactcatccttttgggccttggggtggttccagtttgtatttgttatctcttgctgtgtaacgagttatctcaaaactcaatggcttgaaaacatttattatgtcacaatttctatgggttagtaatccaagtgcagattccgtgagttctccagcacagtgtctttttaaaaggctgtgatcaagatgttgactcggattatggtttcgtctgaagtctcagctggggaaaagtctactcccaaacttacttgtgtgactgttggctggattcagctccttaggggccgttggaatggtggactcggttcttcgttggctgtttgccagaggccattcttagttatttatgacacgtgtctctccatatcgcagctcataatatggcaggttttttttttttttttttttttttttttatcagagtgacaacaggcagagaaggaagatgggtggtagtagtcttagtgttttataacctaattttggacatttttttctttattatactttaagttctagggtacatgtgcacaacgtgcaggtttgttacataggtatacatgtgccatgttgttttgctgtacccatcaacttgtcatttacattaggtatttctcctaatgctatccctcccccagcccaattttggacatattatcccatcccttttgatagtaagaagtcactaggtccacccctcactcaaggtgagggatttacacaaagatgtgaataccaagatccagaattcagaaaatctttgtgggccattttggaagccatctaccacacagctctacttctactagccaggggtttctgagtgttttttttttataatttccctgtaccctagaactcctttaaacttggtccttttggaaatacattttccttaaattgtcctatgtatatcatctgtttaccaataagaccctaacgaatgcaagtattatcccacaagcaaagggaagcgattgagactctgcgtttcttgataagggaattcttcatgaaagggtttgaagcaggggagtcatttgtccaaagtggaggatgggatctgaaatggggaagtcaatgtggagaagattcagtgtggaggtcaatgggtgatcgatgtggaagggttcggtgtggagggagagtgttggagaagtggtaggattggaggtaggaggacagtttagagattgaacaggaatccaggtgaggaaaaatgatgcccaaatcagtggcagtggtaatacagatgggaggatgtgtttgagagatgtttaggaggttcaggcaacagaatttgggggctgagaagacgtagggagaatttgagaataatgaggaggaatgaggagtcttttccctaggctatatctgtgattctcagaaagtctcctgggataaacttttgaagcaaatagctgtagaactggattgcctgcccctctcttccctgtatgtagataaattgagagagcccaagacagagtctgtaaatggaccaggatatctgggtatttgttctggctgccccactccactagctcatttatggccatgcgtaagttgttcctactttttgttaagtctagttctttaatttgtgaagtaaggggttagctatgctgggtgatctctaaagcatttttttagatctaacattctaggtcttttgtaatctaaaatagagaaacccacattttattattttactacttcatagcctcctttactttatttttaattttctttaaaaagtgaaccgagccaaaactttaaaaacaggtaagtcagaatgtttaaaacaaatggcttttggtcttcagcacttagggcttgttttttttcactctttttttttttttaacattaaataaaattcctggccacatgcagtggctcatgcctgtaatcccagcactttggaaggccaaggcaggcagatcacctgagatcaggagtctgagatcagcttggccaacatggcaaaaccctgtctctactaaaaatacaaaaattggccaggcatggtggcacacgcctgtaatcccagctacttgggaggctgaggcaggagaatcacttgagcctgggaggcagaagctacagtgagcagagatggtgccaccgcactccagcctgggtgacagagtgagactctgtctcaaggactaacttcagaaagtgttcagggtaactaatttaattgttcagtctacattttaagattcctttcattaaattttttgaagctttttttattgccttaggaaaaaactgttctgttttccttttcccccaggattagacttgctggaagaaaagctcccccatcacattatcttggttggcaggagacaggcatgcaggcaagtcccagaccagtggtatcagtgtccacagatgaaagggatggtatttttagtgtggggaatagctcagtgtggtttcatatgatgcattttgatgagtataactttctaatttgaaaagcctttggtgtgtttacgtcttcatttaatctttccaatttctccccctcatttcatttcaaggagtctaagatttttcattttggcaggcagttgatcactcttgttattgacactcctttgcagtattcttacactgtggagaacctgaatggctgtaaattccctattggcaggattttggagaaaaaaaaataaaagcgaatagatacctgtgaaagaaaaaataaatacattttaaaataattggaggatagaaggattacttttaaaagttctgttagtttgccagtacagagcaaaacagaaaatggacacatttttttgatcagcattctctgttctaaaaacttatttcaataagggaaagaatatgcaaagacatatatatagatatagacatacacccactccaaaagaatagtgatatctttctggtaaataatatccaaagtttggaaagaaatcaaatatccattgaaaggaaactaattttagggggataggattcacatttggaatgatctcatagttagtttactggatttctgttctggtcaacctaataattgtcttgaaagtgagatggctactgacattctagggtatggttagggagaatattctttatttttaaaaccctacaagattttttcattttttaaaataaaatgtcttatttgttaaatatgatggttatgtaggtttactcaaaagtgattttttccattgctctttattattttctgcatctctgtgcttacagctgaaataatttttagtattttctttagtgcaggtctgctgaagataaattctctcagttcttgtttgtctaaaatatctttgggccaggcacgttggcttacgcctgtaatcccagcacttgggaggccgaggcaggaagatcacttggcccaagagtttgaggccagtctgggtaacatagggagacaacatctctacaaaaagaaagaaataaaataaaaaaaaattagctgtgcatgttagtacatgcctgtagtcccagctactcaggaggtggaggtgggggaatcacttgagcctgggaggtcaaggctgcagtgggccatgattgtgccaccacactctagcctgggcaacagagtgaggcatggtttcaaagacaaaaagaaagtctttgtttcatcttcattttgtgaagggtgttttttctagatttagaattctagattgtcggttattttatttatcataactgtcattgtctcttggctttcattgtttctgttgggcagttggctgtaagtttgattattcctccttcgaatgtaatctgttttttcctttggctgcttttaagatttatttcactttggttttagcagttttattataaggtgtgattttctttttaatttattctccttagagcttatgagacttctttttatttggttggtgcttggggattctttttttttttgatggaggcttgctctgtcacccaggctggagtgcagtggtgcaaccttggctcactgcagctgccacctcctggaatcaagtgattctcctgccccaacctcccgagtagctgggactagaggtgcgtgccaccacgcccaaataatttttgtatttttagtacagtcggggtttcaccatgttgaccaggatggtctcgatctcttgacctcgtgatcctcccacctcagcctcccaaagtgctgggattataggcatgagccaccatgcccgactgtgcttgggaattcttaaccattaacttttcaaatattgtttatgcctagttttctcatttctctcttcttgggattgtgttcatatgttaggacctttttcctctagatttcatgtgtttcttatgctcttttctgtattttttattcctttgtcattttgtgcttcaacatggatattttctaccgacttatcctccagttcactaattctctcttcaatatattagataatctgtggttaaagtcatcccattgaatttgtaaccttagttattgattttttaagttctaaaattttcatttaattttctttttatagtttctagttttctgctaaacttctctattttgtcatttaattcctaaacttattaatcataattgtttcaaagtccatatctgatactttaaagtctttatcacttgctggactgtttctactaaccttttctttcttttttttcttttttttttgttcttctgtttatttattttattttttattttttttaattattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccacaacagtccccagagtgtgatgttccccttcctgtgtccatgtgatctcattgttcagttcccacctatgagtgagaatatgcggtgtttggttttttgttcttgcgatagtttactgagaatgatgatttccagtttcatccatgtccctacaaaggacgtgaactcattcttttttatggctgcatagtagtccatggtgtatatgtgccacattttcttaatccagtctatcattgttggacatttgagttggttccaagtctttgctcttctgaataatgccgcaataaacatacatgtgcatgtgtctttatagcagcatgatttatagtcctttgggtatatacccagtaatgggatggctgggtcaaatggtatttctagttctagatccctgaggaatcaccacactgacttccacaatggttgaactagtttacagtcccaccaacagtgtaaaagtgttcctatttctccacatcctctccaacacctgttgtttcctgactttttaatgattgccattctaactggtgtgagatggtatctcattgtggttttgatttgcatttctctgatggccagtgatgatgagcattttttcatgtgtcttttggctgcataaatgtcgtcttttgagaagtgtctgttcatgtccttcgtccactttttgatggggtggtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgacctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttctccattgcttgtttttctcaggtttgtcaaagatcagatagttgtagatatgtggcattatttctgagggctctgttctgttccgttgatctatatctctgttttggtaccagtaccatgctgttttggttactgtagccttgtagtatagtttgaagtcaggtagtgtgatgcctccagcttcgttcttttggcttaggattgccttggcgatgcgggctcttttttggttccatatgaactttaaagtagttttttccaattctgtgaagaaaggcattggtagcttgatggggatggcattgaatctataaattaccttgggcagtatggccattttcacgatattgattctccctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatggagttcactcatgatttggctctctgtttgtctgttgttggtgtataagaatgcttgtgatttttgtacattgattttgtatcctgagactttgctgaagttgcttatcagcttaaagagattttgggctgagacaatggggttttctagatatacaatcatgtcgtctgcaaacagggacaatttgacttcctcttttcctaattgaataccctttatttccttctcctacctaattgccctggccagaacttccaacactatgttgaataggagtggtgagagagggcatccctgtcttgtgccagttttcaaagggaatgctgccagtttttgcccattcagtatgatattagctgtgggtttgtcatagatagctcttattattttgaaatacgtcccatcaatacctaatttattgagagtttttagcatgaagggttgttgaattttgtcaaaggccttttctgcatctattgagattatcatgcggtttttgtctttggttctgtttatatgctggattacatttactgatttgcatatattgaaccagccttgcatcccagggatgaagcccacttgatcatggtggataagctttttgatgtgctgctggattcgttttgccagtattttattgaggatttttgcatcaatgttcatcaaggatattggtctaatattctctttttatgttgtgtctctgccaggctttggtatcagggtgacgctggcctcataaaatgagttagggaggattccctcttttcctattgattggaatagtttcagaaggaatggtaccagctcctccttgtacctctggtagaattccgctgtgaatccatctggtcctggactctttttggttggtaagctattgattattgccacaatttcagatcctgttattggtctattcagagattcaacttcttcctggtttagtcttaggagagtgtatgtgtcgaggaatttatccatttcttctagactttctagtttatttgcgtagaggtgtttatagtattctctgatggtagtttgtatttctgtgggatcggtggtgatatcccctttatcattttttattgtgtctatttgattcttctctctttttttctttattagtcttgctagcggtctatctattttgttgatcctttcaaaaaaccagctcctggattcattaattttttgaagggttttttgtgtctctatttccttcatttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcattggtttgaaagaacatctttatttctgccttcatttcgttatgtacccagtagtcattcaggagcaggttgttcagtttccatgtagttgagtggatttgagtgagattcttaatcctgagttctagtttgattgcactgtggtctgagagatagtttgttataatttctgttcttttacatttgctgaagagagctttacttccaagtatgtggtcaattttggaataggtgtgatgtgctgaaaaaaatgtatattctgttgatttggggtggagagttctgtagatgtctattaggtctgcttggtgcagagctgagttcaattcctgggtatccttgtggactttctatctcattgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatctgagactaggattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggtgattttgctcgttagttgatgcagtttcttcctagtctcgatggtctttacattttggtatgattttgcagcggctggtaccggttgttcttttccatgtttagcacttccttcaggagctcttttagggcaggcctggtggtgacaaaatctctcagcatttgcttgtctgtaaagtattttatttctccttcacttatgaagcttagtttggctggatatgaaattctggattgaaaattcttttctttaagaatgttgaatattggcccccactctcttctggcttgtagggtttctgctgagagatccggtgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaaagttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcacttcatttcattcatttcatcttccattgctgataccctttcttccagttgatcgcatcggctcctgaggcttctgcattcttcacatagttgtcgagccttggttttcagctccatcagctcctttaagcacttctctgtattgattattctagttatacattcttctaaatttttttcaaagttttcaacttctttgcctttggtttgaatgtcctcccgtagctcagagtaatttgatcgtctgaagccttcttctctcagctcatcaaagtcattctccgtccagctttgttccgttgctggtgaggaactgcttccctttggaggaggagaggcgctctgctttttagagtttcccgtttttctattctgttttttccccatctttgtggttttatctgcttttggtgtttgatgatggtgatgtacagatgtttttggtgtgggtgtcctttctgtttgttagttttccttctaacagacaggaccctcagctgcaggtctgttggaatacccggccgtgtgaggtgtcagtgtgcccctgctggggggtgcctcccagttaggccgctcgggggtgcctcccagttaggctgctcgggggtcaggggtcagggacctacttgaggaggcagtctgcccgttctcagatctccagctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggtgggcacccctcccccagcctcgttgccgccttgcagtttgatctcagactgctgtgctagccatcagcgagactccgtgggcgtaggaccctccgagccaggtgtgggatataatctcgtggtgcgccgttttttaagcccgtcggaaaagcgcagtattcgggtgggagtgacccgattttccaggtgccctccgtcacccctttctttgactaggaaagggaactccctgaccccttgcgcttcccgagtgaggcaacgcctcgccctgcttcggctggcgcatggtgcgtgcacccactgacctgcgcccagtgtctggcactccctagtgagatgaacccggtacctcagatggaaatgcagaaatcacccgtcttctgcgtcgctcaggctgggagctgtagactggagctgttcctatttggccatcttggctcctccctccttctgtttattttttattaagttctgggcattatacaaataatatagaagacatcatttacggctctaggacaatgttacgttacttctgagagaacttaactatttttttcttttatgtcagtcaaaataggaatggattaccttaatcaagtcagacacaaagattacttgtagctggacttcagttcttcttagggctagatatatttctagatctcctttactctctgtagggagcccttctggttccaaccaaaaccctgggtgcccctcctccttggaggactctgacctctaatttttgtcctttaaactctatgacactgccaaaagctctgttcagcttcttgatcatgccttttgtttaagaaattgacaatgctcttgagaagaacaagcagctccaattgctgggctcatcttcttagttttcttctttcaggtcatggcctcacaaactcttactgtcttggttgcttttcagtgccctcaaacatgtttaacaaaatgtttttcagcatttccagttgctctcatcaggagggtgtttctgaaacatctagttagccattgtcagaagtagaaccccagaacattggccttgagagaaggtggatccatcttttatagccttggtttgctcttaaaatgttttagaaaagacatatcctgagtgtcttagtggtctagcgtgatggtggtagaggtgaagaaaagtgaaacttccagtatatttaaaaagtggaattaacccgttattagttttagatggagatgagagaggaggattcagggctaatggccaggatctggactgggcatctggatgtccagtcactaggataagtggttgggttagtgacactggagcctcaagtcaccacagtaacagaatgacattcaccacagcctagttatgtaaaactctggacagagggaataaatccaggcaaatacctctacgtatgaaatggacctgaaaagaagctttacctggaggaaaccttacctgactccagagacctttttggtttagaaaacaggaagtaacttgtatctgtcagtatgacacttttgaacatttctgtattagtttgctaaggtgctgtaacaaagtcccacaaactatggcttaagacaacaggaatatattctgtcacagttcaggaggatagaaatctgaaatcaaggactgggcagggctacgctccatttgaaggcttagggaagtcccctttcttgcctcttccaggctttctgtggctgctggagatccttggtgttccttggcttgcagcagcatcaccctggtcttcgcctttgtcctacctcaccttcctcatgtgcctacctctgtgtttcacatggccttataaggacactagttgtgggatttaggcctacatccccatacccccaattgattgtgacctcatcttaatgaattacatctcaaagaccctaatttccaaatgaacttacatacgcaagtcccagggtttaggactacaaaatatctttttgacagacacaactcaatccacaacaatttctagtttatcaccgcgtgaagcttagtgctctctgcaaagatcaaatgaacaagtagtgtacttattgagctgttgcttctgacaaagcactgtgtggggaataaaaagtagcgtggcacacagtctctgtcctagacaactttactgtccaactggggagaccaagagtgatgcagaactcaggaggaaaataagctttggttggccacctaccatttaccagatactgcagtgggggctatacatatattgagccatttaatcatcagaatagcttgctaggtaagtggtattcaccctatattacagataagggaactgagggtcagaaggagtaaataactagtattaagtggtgctatcagaatttgaatctagatttgttgtattctaaagcctgtggttttggggaagaaactgaattatgttaaaaaaaaaaaaaaaaaaaaaaaacaaagctgttagaaattaaccataagagagttagtgtgagagctgggtgtggtggcttgcatctgtagtcctagctactgaggaggctgagatgggaggatcccttgagcccaggagtttgagaccagcccgtgcaatatagtgagaccctgtctcaaaaagaaaaaaaaaaagttggtgtggacaaggaaggcttattgaggaagaagaaatttgaagagaaatcatctgaactgtgtttttaagaaagggtaggagttggctggtggaaaagagccaaaaactgattccaggtgatgggagctacgtgaaccaaggcaaggggatagaatatatcagatgtatttaggagaaaatatattttataacactatatataagatacgtgctttatataattatagcctcattcttcatatggagaccttgaagtaagaaaacaaacatttttagctctgtgtctcacatggtaaggtattggtaaagctgagccttctgccaatgaattttttttccattcctcttcagaaataatcgctttccatttaaaaagtaataattcaatttagaaagaatcaaaatataaagtagagaaaaaatctcacatattcctatcatgcaaatatgactaaagttaacattttggtctcttcctcccagtccttgaatatgtatcagtagtatacataacacattaacctagagagtaatcatagtgtatgtgctattttgtgcttttctaccataacctaagcactaatctgtgccataatatgtcatcattatcatagttttatttatttttattatttttaattttgagatggagtctcgttctgtcaccaggctggagtgcagtggtgtgatctcggctcactgcaaccgccgcctcctaagttcaagtgattctcctgcctcagcctcccgagtagctgggactacaggcatgtgccaccatgcccagctaatttttgtatttttagtagagacggggtctcactatgttggccagaatggtctcgatctcttgacctcatgatccgcccaccttggcctcccagagtgcggggattacagctgtgagccaccgcacctggctatcatagttttaaaggttgaataatattctaagtagataatgtaccatgatttacttatttagggtttgttattaatagcaaattaaaaaattcctaggtcaaaatgcatgacctgtgttacaactcctattatatatatggttttctggaaggtcaatattgattttggcatatatagactgggcttctctgggttgttgtaaaagttctatgtcattgaactacagaaagagggtgaggggatttctaacaattagggccagtgttttcttcacctctaaaccgcatccccatcctagtgtctgcttggctttgcaacaccatccttatcctgagagctttgttgatgcctggggatattcagaaattttcgacttggaacccttccaagacatttgctattttattctctatttgtttttcttaagcaactaactaaataagaataacatttcaacctctttctactccccacagcattttttcctgcctgcaccacctctgcctacagtttaaccatggggttgcttcttatattttaaagctaaatacaaaagcacagttctgagaagcagccaagttctgcagccaagtttgaagaataaaactttaaaacagctcttctgtcacacacttgagaggggaggcaggctttgctataaataagtcacattccatttctatctcatcctttgcagtcctcttgggtaatgctttttgtatatgactacagtgttctcgaactgcccactcacccctttcaaccttccattttgtgcctcactttatttaaatgttcaatagttttggagtttagggaccctgcatgaaaggagtagacctttcctttcattcttcaggcttagatgtaatgagattcagtggctaacttattagaaactatactttctctttgtctgtaacgttttcagcagctgcctggattagtttcctattgctgccataacaaattgccacaaatgtaatggcttaaaacaaggccaggcacagtggtgcatgcctgtaattccagcactttgggaggctgagatgggattgcttgagctcaggagttcaagaccagcctggccaacatgatgagaccccatctctatttaaaaaaaaaaaaatacaaaagttgtctgggtgtggtggcgtgcacctgtaatcccaactactcaggaggctgaagtgggaggatcacctgagcctggggagctcaaggctgcagtgagccatgatcgtgccaccgcattgcaacctgggtgacagagtgagaccctgtctcaaaaaacaaaaaaccaagaaaccccacaaatgcattttcttataattctagaaatcaggagtgaaaaatgatttggcagagctgcatgccctcagggggctctaggagaattcatttcctccccttttccagcttctagaggctgcctacattccctaagtcatagccccacatcagtcccacctctactcttggcatcatatctccttctccaactctgaccttcctttctctctcttataggacccccggtgattacatggagcccacacacataatccaggggtacctccccatctcagagtccttaacttagtcccacctgcagagtctcttttgccaagtcaaataacatatttataggtttgtgggattagggtgtggacatctttggagggccgttattctacttatcacactgtcttagaaaaggaaaggaaaataattttggaatttttgtctttttcatagctagggaggaggtacgctgaagttttgtttttccttcctgtatttgtgatggttgatatgtggcaatctaaactaagtctgggatgtctgtttgtattggctgaagttcattggagggcagaaaagaggagagtttcagagactggcagtgaggatgggagggtggcttaaagaccttcacaacctgctcactgggtgctcctgttaggccccacaaacaagcccatgccatcgaggagaagtgaccaagcagatacattcaaaatgaataaaaggaagacctcatttactgtagtcccatccagtgtggcttccttataggactatttgtctctaattattttatttattttttattttttcagagagagtctcactctgttccccaggctggagtgtaatggtgtgatcttggctcactcagccttgacctctggggcttgatcctcccgtctcagccttcccatagctgggactacaggcatgcaccaccacacctggctaatttttaaacttttttgtagagacagggtctcactgtgctgcccaggctgggcttgaactcctgggctcaagtatatcctccctcctcagcctcccaacatgctgagattacagatgtgagccaccatgcttgaactatattttaaaaaaatattaattatgatactaaacaatacagtgaataaataaccttctcatgactgtccatctggcatagtagaagactttatgtgcttttttcaaacaatgagagaaagtgctggcatatcgcacttcccttagcttgagagacatgtgccaatctgcttgttgactctgccaaggcctctctttccgtcattttccatgttctggtcaggatttgtgacatatagtggctgacaaaaggcacacaagtgatagtgttggtggccaatctgccagggaagagtctgaccctgggcgctaatgtgactcaaggtagatgagcccttcgaggagctagtcaaggaaacagatgataaagtctaactatcagtgagcgagcagggggtgagcattttctttctgaagggagttattactgtcattaacttcattgcgttgctgggaaggaggggtcagtagttgaaacaaaagtctcctatggctgatgacatgttacaactttaggacagttgtcagcaagcaacttgctgttgggcctaatctgtccccatgcctttgatcccttgagcctcaggatggtttctacattttgcaatggttgaaaaactttaaaagagaagccatattttgtgacatgtgaacattatgtgaaattcaaatttcagtatctgtatatcaagttttattgaaacacagccacatcatttgtttatgaattatctatggcttttttttttgagctaccacggaggagttgagtggttgtgacagagactgtccgtatgaccggtgaagcctaaaatatttactaactggctttttacagagaagtttgcagcttctgttttcggagatttgaaagagactgaaaaagcatcggcaaatgtccttgttgggacaatatttccataggaaccaagacccagtgattccatgtggtgctgatttatttccaggaacccatggagggtctaactggggagggggtatacaagataaattagaaacaagtgcacattcctgtactacaaaaaatatacaagacctgccattcacccctcaaataatatgtttcctttcctgaggggtcacataatttatgccagtacattattgatgagatttttgtttgtttttttaaaataaaaaacaggcatattgagctgctggaagtgttgagctggctgttctgaaatatcccactaggatattccacttgctggctggctacctccatctcagatgcaatgtccaaatggctgtcaatttctgcaggacccactttgtgccaggcattgggccagtgctttgggcacgtgaattgctcacactgagagcactgctgtaaaatcattgttattcccatgccgcatatgaagaaaggagcttacactgggtaaacccatgcctgggcctcccctgtaagtgggaatcccgagttgcaggtcaggctgtctcttcttcacagaccatgctctttcacaagacctggaaggaacaagacaaccacctggggagctgcttacttctgatctttcctctgggatgccagggctatcacaacctcataggcaagatactctaatcactgagttatggtgttcggtgataatatcgacttccatttttataatttcttctagcactctgcatcctgcatgttatatttgtaaaaggcctgtgaaaaacataaggcagacatatctatttctgctttgtaaatgaggaaactgaagctcaggggtaaagaggcctttctaggctcaaccagcttttagtggcagagccagacctcttgacctggggtctggtgcctgtacactacttcccatgggccaggtctttgggaatagagctgcgtcactcacacttaccttagcagaggctgtgatagactctaagccgtatggtttttagtttatcctcagtgaacctcaggtcatcaactgacctccagagacgaatttcacgttgtagatggttttttttgttggcattactttacaactgtgactctgctgaatgcactgtacctttctctttcctattaccacatccattgcttgagtttcagtcctgtcttagtccattttgtgttgctgtaaaggagtaccagacactgggtataaagaaaagaggatttataaagaaaagagggttatttagctcacagttctgcaggtgtacaagaagcatggcaccggcatcaacatgtcagagaaggtcaaaggagaagtgagtacgtgtgaagagacaccatacccaaagggcatcctggctttacataataataaaccaacctaatcccatctcgccagagtgagaacagcagcccagcacgaagtcattcatgagggttctacgcctataactcaaacaccttcccctaggccccaccttctgacaccaccacagtggggagcaaatttcaacatgagatttgatggggacaaaaaatcccattatccaaaccatagcaagccccaatccaaaccaaaagcagatccccattcgtggttcccctttccacatggttccaaatgaggaagggcaaaattcatgtgttctgctcagtaaaaggttgaaaagttattgggaaacacatcttccaaggtttgtgtcctttgggacatgggaatatgttattaaccaggacagctgctcacagctgcacagggatgtactgaaacagctcattttaagcaaattttaagtagtggagaggatcattcctgggcacatttcacaagcattctgtcttggttttaccccaatctctgcatattccttcttcgtcttcattcccggggcagcttcttctgcccaccccgtgaaactttggcccattcttttctgtatgctgtccaggggccatctcctcctctctacatgctgcattgaggatccccaaattgctatcctctctccaaactccaaatgcctatatccagctaccaaaaagacatctctgtttgaatcttcctcacttaccacaaacataacaggtagaacatagcttatttcttgccctgccaaaactgttctccttctgagcttcagtgcttggtgtagcatcctccacatagttggcatcggaggcagaacctgaacctgattctctttgacaggcctaatcactcaccactctacgcaatatgaaaatgacatgccatgtgaatccaatgccatgtaaaaaaagataacattttctgtttgtctccctaggatattgtaaatgcttggcaccaagtaggtgataaataaatgtgaaggacaaacctgttgattaagcgttcctgagacatatcctttatctttctcagatgagattctctgccacatagcttatccctgtattgggtggattgtgtaactctgaggttcaaacattgggtattgcctctaaaccttgcacagttatttatctcagaactattgagtttggcggctgtccacatcatgtaacaattctgctgttaccttcctttccttgttttcttccttccctctctcctcatcttccacattcctatctgtgagagaggatgagaaaaaaacagacaagaagacaaaccaatatttctctcaccaatgaaaaatacctttccgttctgtttttaccattaaatgtggtatttgccctctgtgtctcaattaaaacaggttatttccttcttagtttcttcttttatattttttttcttgtttcagaaatggttcatgttaattgtaaaagaaaaattccgaaattatagataagccaaagaaataaataaaacatgtaacaaccccctgctcagagagttgtggttaacttttgaagtacctacttccatgcttcttttctaggtacatattttaacagaaatagagacttactgtacttgctgttgggaagcttcttttcacataatagattgagaatattttcttgtgacagtcaatattcctctagaccagcaattggatcactttgtttaaagggccacatagtaactattttaggctttgtgggacttactgtctctttcagctaatcaactctgctgttataagtgcagaagcattcacagaaagtgtgtaaatgaatggacatgtctgtattctaataaaactttatgaaaacaggcagtgagccagatttggcccatgggtggggctgtagtttgcctatgcttgtctagaatatcttttttttttttttttgagacagagtgagacagagtcttactctgtcacccaggctggagtgcagtggcatgatctaggctcactgcaacctccacctcctgggttcaagtgattctcctgccttagcctcctgaatagctgggactataggcctgcgccgccatgcttggctaatttttttgtagttttagtatagacagagttttgccatgttggccaggctggtcttgaactcctgacctcaaacgatcctcccaccttggcctcccaaagtgttgggattacaggcgtgagcccacactccactagaatatcatttttaatgcctaaatagtgttctatcttattgatatatcattatttacttaaccagtcagagtaatagctaatgttgtttgaggccttactctgcgcttgcaacattgcttcgtttgttctatttgcattctgacttacacctgcccacagccctgtgtagtgtaggtattattctttctatttaacagatgagggaactcggataaagaacaggtgggtaatttgcctaaggttagatggttagtaaatagaaaactcaaaatttaaatttgtttgatttttagaagccatgctcttaactactcattatgtttttacgcacgttagtaattatttgcttggataaattcctagaattagaataacacatgcattttaaggttttgatatttgttgtcaggttgatatatttggccaacttatatttcttgagtggtatatagcagggctgtgtttctacacccttgtctataacaaggactcttttgacgctttgctactttaataggtaaaacaagcttcatctttttttatcttatgaatactctctatatttcttctaaggtgagtgtctgatgcatgttctttctccattgttcaataagagcatttgtcttctctattaatttgttggagccttttatgtaagggacttctgtggtttttaagttgatgctacatgacgtgttatgaacatagccttttactttaaggagatgttgtctttacaattgaagataattaaatggaaaagtatttagttttaatgcagcattaattagactcctggaattgaaaaaattcccagaaactgtaaggtaagggaggacttactcctgttggggaacttgtccctttagtttccatctcttaagtactagaatttgtgttctttaattggaaccattgctttgctgtggccatggcaacacatcttagctgccatgaacagcgcacactttgacaaaatattttttttagagagtggcttttagatggaattcattttccaatgtattcatggagtctagatgaattaatggatggtagacccatacttttataataatagtaataataatgaaatgaatagttactatctattgatcccttactgtattctagccacaatgctttattttatattatttcatcggatctttgtgataatcttatgtcatagatattgttgttatccttactttatacataaagaaattaacacagaagagttaagtggcttgctctggcttatacagatggtaagtagtggagtttgaccttgaccttaaccttgattttctactgcgtgagtcttacaggtttattatagcctttagggtatatactgaattcaacagtggtagcatggatggcaaatcttgatgtcatctagagtctaagatgacactagcatcagtgggccacagggaatctgacccagactttcataacttgtattattatgaagattagagttctgaagcttactggattagaagagcacgagggggtagctgccccaatatattctaatttctcttgaggaccaccaaattggcagagtgtctctgatagggaaaaggaagagttggaaggcatcttagcctctaggacagaagaaccatttttattggccaccaaagttacatctagttgcctacaaatttatatccaaactccttatcctgccaattcagggttctgcaaactgatgccaaactatagtttagtcttctatcacatgactgcattatacatacccaattatctgggcaaacagacctgatccaaacacagtttgtactttcctttcctttcctttgtttagcctgttccgtctacttggggtgtctttgatttctccagcctcagtctcccgctgttagaattctgggcctccctcaataccaaggttaagtagtacctaacgaagaattttttatttttacagacaaaagcagtttctctcctcctctttgattcttatggttatttatattactctcaagtcaatcataaccttcttatttgtaggatagtttctccctgtaggacttgcaggattcctcgaatacagtgcttttccaaaggtaaatgacgacataccttaatcttgttgttagggattctgactctgagagacatgaaaccactgtttagagtcttgttatgtatgaattgtgtccccctccacccagtccatatgttgacatcctatccgcccatgtctttgaacgtactttgaaatatgattgttgcagatgtaattagtaaagatgaggtcatacaaaagtagggtggactcctaatccaatttggccgtcacactggaaatttgggcttgcacccaccgagaacattgtggaaagattggaatgatgctgtcagaagccaaggaactaccagaagctagaagagaggcctgaacatacccttccccagagccttcagagggagcatggccctgccaacacctaggtcccagacttccagcctctggaactgtgggacgatacatttcttttgttgaagccactcagtttgtggtactttgttgctgtggccccaagaaagtaccacaagcctgaggttttcaccgtccttacagccagcaagacgggatgtttcagatgaccctgtcctatgtggaactgggggctgaggtggggtggcctgataacagagtcaccaaagagctgcctctcttatctgtactcctgagttctcacagccttctgggcatcttcagcaccagcaactcagcatgtcaaaactgaacatctttcctctccaaaccccttttccctcataagcccatctaaattatggttaccatgtccctctcagtccctctggaattcttcccttttctcatccccaattgaaaaaaaaatctggaattctatgttcttctggaaaataaggaagatctggcaacaccaggcctttgttactgcatggctataattggccagatggatgggctgcccctgaacatagagaatgtgtcctgggtcctgtttgacatcgcatgccagaccctgtgggcattggagcctggcccctggcagggtggaagtgattgcctctgcctcacagggacataagtggaaagcttcagatcattctctgagtcaagctgtccggtttatgtcctgctgtgtcgcttactggctgggggcagccatgggaagtttccttgatctccctgtgcttccgtttcccagtctgtaaatggagataataatggtgctcgcctcataggggtgttgagagaattaaatgatttaatgcgcatcaggagattggaacctgacacgtagcaggtgcacctgaaatgttcccttatattcttatgtagtcaagaaaatcttgtcaccctttatctaaactgctttattatttttcatgacgcacggcatatttacttcttggttttactttgctactctccatcccccaccagcttgacacacattcagaaaatgtggccatagtttatacacatagattcagggctggcctaccaaggagtttggacaaagctcccgggatctcacttggtggagctcctgggcctctcctggctgccgagtcccctgtgctttctgccttctgtgttgtttcggttccagtgaccaagggcacagcttggtgactggcctcccgaggccttccgagtcaccgggggatccctctaattaggtacactgttgagcatgcaggtgtatatcctgcaggcaagaagggctgctgaaatagtagcttaacatgaaatccaggcagcaagtcgggtgttcgttagaagtgtgtttttttttttttgtgatttgggacactgacaaagcccagacaaacctccccacaccaattgtttcccccagctgtattccccttattgggccactcctaagcagtgctgatgacttatttagctaatatttgttgactgaatttttattaatcaatagagatttgttaagtaaatggagcattattcagacatgtggcatcagatccattactagatgtaagtgataaataaagtggtaggtaagacacagtcctgcctgtaagagatgtgcaatctagtcattgagagagaccctatgagaaacagtgggtggagctgggggattaccggtgttgtttatgggatcccagagaggaaggaccctgactcagcctgaggttgggactgggggcaactgggggatcatcagacttgtcattattgatctaatgtcccagtaaaattgggcgttttcaggacagggactgtgactgtctttttattgctctatgtcttgtcctagcccagtggttgacatataacagacggtcaataaacatttgatgagtaagggaattaagtgacatctaagctgagaactgaaggatgaggagtctgccaggaggaaagtgtgggaggtaggggaggaagggggtggcgggaggaagtaaaatgatgacgaaggatggtacagggagggaggagcatgtgctccttgagggtgacaaggactgcagttctgggaactgttagcttgtatggtgggtggcatggagccatttcaaggtgggggcctgggcagagctgaatggtgagaataacatagagttcttagtttttacatgatgaggtttgatatgcatgatccaaggtgcaggaaatggattggagaggacagggtggaagaggagaggccattcgatggctattgcagcaatcttgagagatggtggtggcaggacaaattactgacacctgagatggagaggtgactagattcagaagcaactagggatgtagaattgtcagaacctggcaattaggtgtctgtggggaaggaaggagagatgtatgaatgatgctcaggcctccaggggatgtgggcaccacttacttgtgatagatgagaagaggagctgtgagaaggttaaattcacacttgggcatggtgagtttgagatgcctgtgggaagtccagagcgcagttgtatacagcaggcttcacctccagagagtgatcagatttgagatacaggtttgaacactcattggcatagagggtcagggcttcatagcctagaaggacatagataaaattaagaaggcctatgaacttcagaaattatattaaaatcataatgcatgtgcattgttctgaagagctagctttgtatcaacttttcaaaatgtctgtgtcctcaaaaaggttaacccttggtgcatatggttaatgaagccagaaggagagatgagatttttcaggcagcaagaagggaagagagccagggtttgtgctgcagaaaatatcaacatttcgggggtgggaggcactgtgctgagtcagaggcctgggggtcagagttctgggaatgagataaagacttacaggtagcaatagctttactgttcataaagcacttttacatacaatgccattttatctctcaggaactcaactagatctttataatttggctctgtatcagttagagttcagtacaagacatgaaaacttggctataaattttaaagaagggatttcctagagggaataggtgcttactatggacccagaaaatctgagataggtctcagttaatgtagaaagtgtattttgccaaggttgaggatgtgcacccatgacacagcctcaggagggcctgacgacgtgctcaagctggttggaatgcagcttggttttatacagtttagggagacatgagacatcaatcaatgtatgtaagaagtacattggttcggtgtggaaaggtgggacgactggaagcaaaggcaggaagactcaaagcggagagggagcttccaggtcatagataggtgagagacaaacagttgcattattttgagtttctgattagcctttccaaaagaggcaatcagatatgcatctatctgagtgagcagagggatgactttgactagaatgggaggcaggcttgccctaagcagttcccagcttgacttttccctttcacttagtgactttgggggcccaagatattttcctttcacattacaaaatctctggaagggcagccccagggaaagattcccagaacaatatagaactaaggtcagagtacatccctgtagctgccaccctggcatcgaaaagctgggactggaaagccaccatggctgcagctctttctcggccttcatggagctgaaggaaggatgctggacactactgtattaagaaatctgttttcgtgacctgccttgatagcagtgaacagtcaaatagaagccaaagcatggccctcatctcacttccaccttctagaactccttgcttgagtacatttaattagtggaatccacttcagtcctgaatctctagatgcagagaagtctggaagatatctttataccacctctcttcctaaaaggagtgtgaaatggagctagagaaggggtcttattttgtaagggtcaagttaagaactgtttcagtcttagtgagccatgtggtctctctgcagccttgccattgaagtgtggaagcagccagagaccatacagaaatgagtgagcatattgtgttccaataaaactttatttataaaatcaggcctggcacagtgtttcacgtctgtaatcccagcactttgggaggctgaggcaggagtgagcttgattgtgccacagttctccagcctgagcaacagagtgtgagaccctatctctaaaaaataataatgataaagttagttaattaaattaaaatgagtgatggggcctaaaggccacagtttattgacctctgaggtaagcaaatcaattctcaataattatcgtaggttcttttttacagatgagggaattaaaaccggagagcgtcagtcgaagtgaaaataagtcctggttatttagttttcaaagttcatgttctccaggaaatcctgatgctcagcctctcctcttacaaggcttgtgatctaaaagaggagataaaatatgtactttgttggtgcagaccatggtaaatgctcccgggatggtgcggaatgcttttgcatacaaggcatttttgacaggagaaatcagaagtatgatggtgaaagtagttttagctagatgttgaagaaaggtataactctaacaggtggagatggagaagggaggagtcaaaagagctgatagggtttggctctgtgttcctgctcaaatctcgtgtcaaatcataacctcaatgttggaggtggggcctggtgggaggtggttggatggtgggggtggatccttcatgaatggtttagcaccgtccccttggtgctatccccgcaatagagttctcatgagctctggttgtttaaaagtgtgtagcacttcccctctctctttctcgtgctctggacatgtgaattgcctagctcccccttcaccttccgccatgattgtaagcttcctgaggcctccccagcagctgagcagatgctagcatcatgcttcctgtacagcctgcagtgcatgagccaattaaacctctttttttttttttataaattacccagtatgaggtatttctttatagcagtatgagaactaatagagaatttttgatggagtcaaaaactgcaagagaagtttaggaaaacagctagaaatggaaactcatctgaacattgtgaccttctatggtgttagtggagataagactggatcagggagaaccttagatagtaggattaggaatccgaacttggaaaaggggaagcactgatagtcttcgagcagggttgtgatacacacattacctcaggaagaattatctggttttgttctacagaattttgtgtaagtcagaagatacagccagcaagaattcgctcaggcggttgttgtaatatctttacatgaggatgcaaaggaagaagtggacatgagtcttgggccattcatgggacagggcaacttgtaaatgtaggtggaatagaaggatggctttgatgggaagagatgaaatgaataacaatacttgggaaatttgaggaatgggagcttgttttgtgggtaaagtaatgggccccatcttggatatgaggtgctgaggggcagaaacggaaatatggagtaggcgattggaaatgttggcttcatcttcaagatggggttggttgggagtcatcccatacaggtggatagagagccaagtaagagctcagctctctgagggagtgtgtacagtggaggatgccggaaggagaacccaggagacaaaggtattccagaactgggagagggacaagagataggaaaatgtagtaggcagggtagtgagagtggcaggatggatgttgtaccagaggagtcaagttagggagctatttccagaaaaagaaagagccaggaatgttgcatgccacagaaaggtcaagaaatactcgaaaaaccactggatttggtgaccacatctcaaggtcatgggcgaccctgagagagctgtttagtgtgtgttcttctcttgaggagtttcatattgaaagaaaagaggagagaaaatgggagattgaaatttgtggcttgttttaaagtggattaattcttcagtgccagaagaccacaaagaacttggtctgagaatatatcctgatttctccccaagacttttcttaagaaaaagcaagttgaaagaggaacaccctttagtttcgttctctcttgatttcaggattcggtttttggtcagttgtttgtgtctgactccacttttggccctgtcgtggggccgctcctggcaacctgggaggtcacgcacaagtgtgtgcagttgttaagcaactgctcgcagtcgcggtggccctgctaaattgggaacatgtattcgtcccagtctgagtcttcattcagtgggaaacaatgagtccctgactttgaaatctcagaggttacacatttgtggaatatgaaatcagtgtgttgatgatttttcctacctcatagaattctttaaaaataacactggagaattgctatgcaattctgtgaaaatttagttctctctagggccttttctagaaaaaacgttatgcccaaatcccaaaaggaactgagtattttatatcaatgctttctaagataaataaaaacagaacacacacacacacacacacacacacacacacacacacacacacacacacaacgcagcaacaacagcaaaagtcaataaaacaactcaccaaactaactctagagtttcagatggaaatgatgttatcagtccaaattaaagacatattctcttattttcttttacaccttggtttgtggcttccataatacaatcatctgagtcttgtatggtttctgaaatggatgctagaagagataacttgaatgagtacttttcccctggtggaattctcttcctcatctatatttaaacagttgttttgcacctaaagggccctaagttacgtttctctggagatatttagagataagaagtgttgtaagtactctttcacatttgtgcagaactttagtctttgaagtgtttagacatccattaatctttttttttttttttttttttttttgagacagggtttccctctgctgcccagactggaattcagcagtgcaatctcagctcactgcaacctttatctcctgggctcaagtgatcctccctcctcagcctcccaagtagctggcactacaggcctgcaccaccatgcctggctaatttttgtattttttgtagagacagggttttgccatgtcacccaggctggtctcaaacaatctacccacccttgcctccaaaagtgctgggattacagacgtgagccactgtgcccagcatccttaatctcattctacctcactttctgcctattgagagataggcaccccaagtaggaagtccaaatgctgataaagaaattgggattcagagtgacttactaactagccccagatcacacagcttattagaggcagattcagggctaaaggtcagattttccagctgcagatttattctgctttgagtggcattttagacattagtgttttctttaatccttaagcatttcagtgtctaaggtttgtataacatcaggttggtttctggtagtacgttgattgtggagagggcccagaagcagaaaccacagtctttacatgatagttactcttatctgaggtttggcctttattgaatggaagtctcttgttaaagaagggtatgcattgaggcaagagtcttgccaacttttcaaaaaaaaaatgggaacccctgggctccttggggatggctaatgacaatgattatggaggaggctgcaaatgtgaagtactttataaatcctggaggtgtggcagtagactgtgtgtttctggggagacagatttttgcatacattatcctctggacacttctgcctttggtgcatgcttgtttttataaaaaagcttgttttgttcctcctgtagaaatgagcctatcatctagagtcatggtggttttctgtatgtgtgagcttatgcttcagttacactgaacactcgtactactgcaaaatcgaattcagtgacattgccaatatcttcgctctcagtagtctttaaatattcttagccctgggaactggcccaagaaactgcttattcttttccctgtatcacttagcatataaatcctgaattactgctgactgaagatacataaagtacaaatcaataagtattttgtttctatattttggagaatgagacaatgagtgaaagagaacccctcaatgagggctttaaaatattgtcattgttctatggattagtagagctgcggctactattttacttacccactggccaccaggtactcacactgcagtgaaaggattcctaaaaacatctttattaagatattcacatactatacaatccacccatgcaaaatttaccattcgacgttgttggtatattattactttgtaaaaatcatggccctatgcacaacatacaacttgccactttaatcattcttaatgtacggttcggtggcactaattatgctcacagttttgtgcaactgtcactgctacctatttccaaaactttttcatcatcccaaacagaaactgtgtacttattaatcaacacctccccgtgaaagaatttttaaacataccttgattattagctttggatgtatataaaacctttaaggaagattttgtttagtctgttttttttcagggaaagtttattttttaaggggcagttccatacagtaggtgacacaggttaggttcctccagaaagcagcctcttatagtagcatgtgggacattgccagagtctcaggagcaacacttctaggggatgggggaagggatggagggaggactgggtaaaaggagaacgtgtactgtgttgtcattggaaggcctcaccctacccagtggaactctggaactggcatttcccaagttggggcaacagggatggatctttgtaccatatcattcagtcatagggttcagctcccaggacggcgcatgagcttggacaaattctctccagccaagggtcagagaaggttgacagctgagagctaagagccagcagctgaggggtgaaatgctcagtccatactttgccaaactttgctctccactggaatcacctttgcatcctcaaaaatactacgcctgatttaattggtatggggtaagagacaagtggaatgcttccaaagctccccaggaggtttgaatgggcaacacagattgggaatggctgctttcagtcttgaaggggagtcagcatagtatacatcatcatgggaaatgcctggactttggattgaaaaaaagttgaacttggctcaaccatttactgacgttgtagttcttatttatgttctgttaagattttgctactaggctttaaaaaatatgaatggatggtgcacctgggtggctgagagggcacttacaaattaaaacaaaaacagtgaacacctccagaatttgatagaacacaagaatgcataattcataaagaagaaattcaaatgctttttaacatttgaaaatatagtcttaatagcaactgaaagaatgaaagttaaaactatattttgcttattatattagcaaagatgaaaaataattgctattgctcagtaatggtgaaggtagtggcagaagacactctcaagctcagcacagtggttcatgcctgtaatcccaacattttgggaggccaaggtgggtggatttcttgagctcaggagttcaagaccagcctgggcaacatggtaaaaccctgtctctacaaaaattagccaggcatggtggcatacacctgtggtcccagctactcaggtggctgaggtgagagaatcacttgacccccaggaggtggagcttgcagtgagctgagatcatgccactgcactccagcctgggtgacagagcaagaccctgtctcaaagtaaataaataaataaataaaacaaacataaaagaaggcattctgatcctcttggtatgtccattggtgtaacacgaatggtggaccatttggcctccattcatgtgtctaccaatgcaatgtagataaaaattcataaaaagcgaatgccttttgacataacaaatctaattctagaagtttatcctgaggaaataacagaagagtatgtaaaaatgtgtgcataagttgtaattgcctgggtcttgctggcaattaggagaagcacaaatggtcattaataaaatattggttaaataagttctggtacatacctatgtacttctaatgagagaagccattaataaaatagtgtgagcctatttttgcattaaaacatttgcattgaaaaatgactttgagaaaaatatcagatgttaatggtaaacagtgtttttccccctgagtataagaattatgggtgaattttattgtctaactcatatctctttataatatttatacttagaaagtattacatgttatttaattatgtgttaattttatattcataaagagcatagagctatttccaaaaattacatatttccaagattacacacctgcatatctctatctatctatctatctatctatctatatctccctattcattcagcaacctaaaatgaaacagcctataatccaattagtagttatccctagaatttgaggtcacgggtgatttttattttctttcttgtgcttatttatactttacagatttttataatgagatcatatctctcttataatgagaaatgttttaaaaaagcttttaatatctcagtgcacttgcctgacctattttatatccattcttgcatctatttcatttgaagggtcctttggatagcatttctttctccatgtctttcttcctgctgtcctatttaaataatcacaattctgtgttgaaatttttgtatgctttacctaattaggacaaatattctgactcttgcatttgttatcaagatgtacatttttactttattcattattgttttttttttcttaagcaaagtttggcctttagatgatgcatttccaagcctagcatccatcatctaccattatgcttttgactcatctattaaatagtaatgtgtcctccaaaaatattgatgttaaattaaatgactctatatttgtccttggaaaaagctttgaggctataaaatttaccaagcaggtaggacatgcaaaaagagaaatgcatgcaaatgcttcctataggcaggagctcttcaatgtgtctgacaaatctcatctatcctttaggtcctaaattaaacatcacttctctgtgatgcccaccttgactttcccagggtaagctggtgctgacttctccttatgtttattatgcctcttattaaatcttattttaagtagttattgatgtctaccaatgcattagaccaccagataggaaatatggttgccatccaccaacactcttccaacagtccctacctcctcatattcaagcccctgacaaatagatgatgacagacgcgaccatatgtcacttccaagattaggttttgaaagacagaggtttccgtgttgggctgtttctcttggcccactaacctatggaaagctagctgttgtgacgataggcaatgtatgcagagaggctcatgtggcaagagctaataaaaaatggaagctggccacacacatgtgagtgagctttgaagcagatcctcccccttgtcaagccttcaggtattacaggcctggccatcagcttgattgcaaactcataagaaactctgagtcaaaaccgtccgtctaaatggctcccaattcctgaccttcagaaaatacgtgaaacaataaattcttgttgttttcagttttgagttttaggatagtttattatgcatcagtagataactaatccacattggtactagaggtgcagtgcttatgtaacaagaaactaaaatgtgataggactttgaacgaggcagcgggctgtggaaaagctgtaaggattaaggaccatgttagtaaaagtgtaaagtgccttgaacacactgtccatagaagtttggactttgaggaggctgccattgaaggcttcaaggaaaatgggagaaatcctattggaaactggaaaacagagaatctttgttacgtagtggcaaaaaaaagaaagaaaaattaacaacactgtcacctgcagtaatgtagaaagtagaaaatgtgcctgataaactggtgatatagttaaggagatttctaaccagagtgctgaaagtgctttctgattttttttttttcctgttgcttagagtaaaactgcaagaagagaggagaaactgaaggtaaaactattaaataaaaaagagccaggacttgctggttttaaagattcccagcctccccacatggtacgtgatgctaaaattaagaaatggcatctgagcaaagaccaaattcagggcacttttaggaaaacaaggtccaaacattaagccaaggatgcgactataaagtcttttcttaacatctcagtaaacaaagatagtgtctcagaatactgtttagtcagaaaaacctaaagatactaagacaagcttgtccaacccttggcccgccggctgcgtgcaacccaggatggctttgaacgtggcccaacacaaatttgtaaactttctcaaaacattatgcgtggacctttatttttatttttattttttagctcatcagctattgttagtatattttatgtgcggaccaagacagttcttcttcctatgtatctcagggaagccaaaagattagacacccttggacgaagggcttgccttacagatcctctctatcaaccagtagtgctccctggaagctcacagacattgtacctcagtccaagctcaagaaggacctgtttcaaagagatttgtgggtgtggcttttgtgtagtggaattaagcctaaagggattcccagaagacccatggagttgaaagggggttgtgcttgaagaaacaccatcagctggaaagaaaagagacataaagagtacaaaatgcagagaggcctttggaccaccaagtgtcaacaagtaaaaagcagactgagaaaactaactccccaagcacatgttacctttcatgaaaatgaaaggatgcctgagagggcacactcaagatttcaaagggtgagactaaagccatagagaaatattcctaggccttaattagagaccaaatcaaggagcttccatcatttgcttgcctggatttcagaactactatccttgcatacttcccattttcccctttgtgagttggagtgtctatggcagttatcctctccttatcctgcccttgcatgttgggtgcatggggccagataacttgtttctttatttgcacatgcctctatatcaagaagaaccacattcaattgttgtatgtcagagactacacccaagaaggctgatttagatgatgagggtctggacttggaactgatgctctgttgggatgagacttttggggacagtaggaggggtgggagtccttgggagccaaagggtgtcctgtgttaggcagcctccaagatggctccctttgatctctgactcctggactcacagagttgttaatcccctccccatcccacattgtactagggttggcctgtgtgaccaattgcaaatggcataagtgatggtatgtcgctctcaatattagtttattaaagactgaagcttccattttggtcctgctctaatcccgtgctttcctggatccctcacggtggggaaagccagctgccataagttgaggacattcaggcagtctggtggaggcccacatggtgaagcagttccagccaatagccatgtgaccctctagttccaatcaaggcttcagatgatgcagaccagattgacagtttgactgtaacctcatgagatactatgtagaaaaaaactgctgtaggccttagacttctgtacttacaaagacttcttgcaaaattggcttggctggcatccaggaatttggatttaggggaggcctgacaccatttcctaatggataagagtggttcactgtgcctaaactgtaaacaatattatttatgctgagcacttgctttccatatgggagtcttggatttttatatgtgctaggcagagggtgtgtaatgagcaaccctcagtaaaaaccttgggccaggagtgctggcttacgcctataatcccagtgactcaggaggctgaggcaggagggtagcttgaggctgggagttcaagaacaacctgggcaacagagcaagatgccatttctgaaaacagaaaattagccacgcatggtagtgtgcacctgtagtcctagatactcgggaagctgaagtgggaagattgagcccaggaagtcaaggctgcagtgagccattaactgtgccactgaactcccgcctaggtgacagagtgagaccccccaccccaaactctaaaaaaaaacagacaaaaacattgagcactaagtctgtgataagcttccctggtagacagcattttccacttgtcacaatacgatgctggaggaattaagcccatgctgtgtgattccacagcgagagaactcttggaaacttgcatttggttccttgtctggcaaagagaaaaggtgctgattttgctttatattcttttgctataataaatcctagctatgaataatattatatgagtcctgtgaatcctcttagccatcactgaatctgggggtggtcttgaggacctccaacccagagctcctgagctaggagcacctagatcttcctagaccctcagaaaccataggataataaatatttgttatgttgaggcactgagttttggagtagtttgcttcacagcaataggtaactaattctggaagccagtcatttctctcttcccagcatttagtttagtgtcttggaacataggtgttaaagaaatatttgttgagtgacttgacactatttctgcctttgaagaagttcatagtccatttggttcctttgctggaggaatctaaatcctggcttggtattatgaagcaggcttactctcttttttctgtggcctagaagaatcaatcgcagtggcagcagcctgccttaacgttgtcaggttctgccatcttccctgttgaatgagatccatgggtataagaattagtgtatgaccatgcctcttctcttttactcacttcttaggtcctttgatttttattttctctcccttctatgtcatggcagtggtagctattcttactattgaaataaaaacttcttcctgctgaaaaattaattaccaaatgtttcagggccttataagatattaatatttccatatcgagtcttgcctcttactctatcatatgattgccttgaggaaagttcagacaaattaactttccattttacattgcaccccactttcccagcttctgcaaactgtcttgaaatagactttatagaaagataggaaccatttccactaaaatgagtttaatgtagggaaaaaactcaaagtatacactgaaagtagacttctttgagtcatttacagttaaaaattattttaatctaaaggtgtatttgagtgtgtgcacaggtatacacatagaccgccccccaccccatactcattcctgtggcacacttcttgctagttgttggcactgttaaataaaaattacagggggccatcgttttggactaagcttctgcacttggccccaacaaaccagattgaaaatcaaaatggagtcactcatgctaaagttccatgtcaccttccaataaatcaggggaggaagataacaatctaattttccaaacagggcagtttcaatcttcaatcagcctgatgaagttctctctgctttaatccttacaacaaaaagtaacctgaaggaacgtgatgttaactagatatttttttctctattgttctgttttcctgttcctggattacaaagaaagtaactatgcaatgaccaattgcttttgttctgtgtttctgctttctctagcccttttctgcttacaaagccaaccatctctgcccactcattgcagcacttattaatggcaaaaccgcaatacttttgcaccaaaatatttaatggaatgaagtgttgttctattctaaaattgcaaataaagctacttgagctcctgaaagtaaatttgttgtaattttgtcctttgacagatccttttcctcctctttgagtctccttccggttcagcagatgaccttggttatgagtttcatgagaatcccagggtgatctaatagaagctctctcatttatcttctttccatctaattttttacaatttttattgttttttcttgtgtcagagaatcatctacctttgtttcaaagggttctagtcctgctttcaatcccatatacttgggcctgatggatctttcgaaagtgaaattgtggcctcatgatggcatcatttgaaagcctccgatgactgtttcccgaggagggtgaactttctctccttacctgctcttgctttcctgcctccattttgctcatggcattcccttgaattaggttctatgagtggaatacagctttgaaggcaattccagagatccaacaaaaacccaggagattggaaggaattcatatttgtcaaaaaatgtgtagctcaaaaatataaaaaaaaaaaataatgcaaataaaacccaatagagtataacaactatttacatagcatttatattgtattaggtattataactgatctacagatgatttaaagtatagaggagggtggcataggttatatgaaaatactacaccactttatattaatataagagacttgagcatctgcagattttggtatcctctgggggggtactggaggcaatcttcctgggatactgaggggtgactgtaacttattttcagtactttggtaatagtgtatttaacggtctattgtttctcagggtttgtggatgatagtccattaggatctgaaaataagatattagaagttctatttacttttttttgtttttctgaaattttaagtgtatatgaagttaagggaatacatgtaattttgaaataattaaatattcatgtttggaaatctgttcaaatttttgggtggctgggaacacaaccaaaaagatatgaaaaccaataacaattatgtatcagtaggcattttataaatagtctttgatattattttggatataagtgatttgattggcacttctcatttaattgcttattaggtgggtttctgttttgtagagaacatttaaaaaaaatttagacaagcaaaagttaataaaatcacctgtggtatgaccactcagaggtaagtataatgaatgttttattgtatcttctttgcagctagttttctatacacatagacatgattttcttctaaaaaaggaaagatcatgatgtatttataatttgtaaaacttttataccttgctctttgaactttaaagaatgtcatgaacatttccttagatactaaactctttccccatatattttaatggccttattatatgaacatataaaaataatttattttgataccttaattcatgtgctgttggatttttaggctcttgcaccattttccccacttctctgcttgctgttataaacagttctgaaaaccagatgctgttagccacaccatacatatctgtgatgtttcctgacaagattcctaaaagtagcaccttcctttcataggtgaggttttacctctacctttgttgtctgtctctaaggcaaaggcaattttgtgtaatggtgaagaactcaggacagaatttgaattgtgcctcaaccagttactactgtgtgactctgggctagttgtgaacctctctattcctcatttcccctcatctgtaaactgggggaaacactaataccaacattgctgggtggttgtgagcaaacaataaacaaataatagtgtaagcaaacaataaattttagcaattgtttataaggtatttctcttgtcaagtaagccaagttaatcatctaatggctcctataaaataaagcatagggccaggtgcagtggctcatgcttgtaatcccagcactttgggaggctgacgtgggcggatcacctgaggtcaggagtttgagaccagcctgaccaacatggtgaaaccccatctctactaaaaatacaaaaattagctgggtgtggtggtacgtgcctgtaatgccaactactcgggaggttgaggcaggagaatctcttgaacctgggaggtgggggttgcagtgagccaagatcacgccactgcactccagcctaggtgacagaacaagactccgtctccaaaaaaaaaaaaaaaaaaaaaaacaacaacaaccataaaataaagcatagttatagtattcagtaaggtgaatgacacattaatgactccattttccatttgatcagttcttacatccaggaaccatgaacacagctatctcaacatatggtagtttatagggatagtctgtaatcttgcaaatttaaaaggtaaataggagtccttcagtaggcagattcatatattgacaaatgaaggaagaattagtcttgttagaagaaacttgccatttcgtttgtgaacaatgtagttaatttatcacaggctcagtgagggcaaggatggagctatttcactttactatttgtgtacagatccagctcttgggccgtggtaggcactcagtgaatatttgtgaaatacataaatattcatgagcaaatatatctatactttgttgaatgtattgcaatgtatgttgtaaacataatgaaggctttgtgtgatgaaccgacaattgacaatgaaattattgtctgcaaagtgggctggggccttcaggcttttctcctgattatagattcagaaataatgcaagaggctgttgctcaaagtgaatcccttactccgtgctggtcgtgttctttaattcatgtgctgttcccttgtgtgtgctcagtccttattgcagctgctgggtctgagctcactgtgaaaatcgtgtttcctttctgccgacccatagggctcagtgtttgattaataagtttcccattttctgagaaaaatacctaggtaaatcccccttggacagcacaaggatctgcagtaatttacaaccaccgtgtgagccttgtgttgaatgacatgctctttgtaaggatatggcataatttataatgctggccccaacgtccactcctagggcgttctcagtgcagtgccttgactctgatattggataatgttgacagttaagagaggaatgactttagttgctgctgctgaattaaaaaagtcagacacacagtctaaatggattttgctgtcttcaaagtagtgaccttgggatagatagaactctttgatgcttccattgatgttgctattgccccaaacatttccggaatcctttaaaaattacctttaaagcatgtggcacattcttgtgaatatttttgagtctaacaaatactcattctttgtatgaggctttgatttttggaaagagtgaagagtcactggcatcaagtgcaacaactgaggtgggtgatgagggcagagagtgctggttttgtttagggcaacatatggttttagaggccttttaataatgtcatgagacttgagcatttgttctaaacatgatttccttttaaaataatgtttgaaatgatgaaatagtccaagcctacagaacacaacattacatgccagataggcacgttcccagcatggatgttaaacagatgttaacgtgctgtgtttgtttgcgtgtgttctttcatcttgctctccttccctgttttttctttgaaagacagtgttttagatattcctaaacaccccccgcttccctccatacccgtctgccttctcccctttttccatcaatattcatacttctgccaatgttgccatgcttcattcccaggtgtgcttgtaccttttgaggaaatgtttagaaatttaaaggaattatcttgtgtgtgtccttctaacattgtctttgaggtttatccatgttgatttgttttaactgctgttttagtccatttgtgttgctataaaggaatacccgagactgggtaattaataaagaaaagaagttcatttggttcctggttcttcaggctgtacaggaagcatggtgccagcatctgcttctgctgagggctcccagctgcttccactcatggaggaaggtgaggggaaaccagtgtgagcagatcacatttcaggaggggaggagagaaagagagagaaagggaggtgccaggctcctttcaacaaccagctcttgagggaactagtggagtgaattaactcattactgcaagggcagcaccaagccattcatgaggaatccgccattatggcccaaacacctcccatcagttccaacctccaacattggggatcaaatttcaacatgagatttggagaggacaagcaaaccaaactatagcaactgctccataggattccagtatatacgaataaatcaagagtcttcatctgttcacctgagagaaagttcagatgctttcaccttttttgttattacaaatagtgatacagtagtaactgtgtgcatatctatctagaaatatgtactagaggttgtctagagccagtactcagaggaaaaatggctaggttctagaacgtgcacattttaacttagtggacattaccaaattgctctccaaagcagttgtaattatgcttccattggtggtttcccatatcctcttagttatcagatttttaatttttgctaatccgattggcacagaattgtatctcattgttttatattgcatttctctgcgttctagtgtgattgagtgtctcttctgtactcagtggccgtctgagtttcgtcttttgtgaattgcccatttatattccttgctagtccttctattgccattggcctttttattaatgatttataagaatcatttataatctagtattctttgtcagtttaatgggccccaaatatctttactactctgtggcttatgttttgactttttatgatgtctctaattaaacagccgtgctaaattttaatgtaatcatatttatccatttctcctttgtggcttgtacttttttatgtgtttttaaaaagaaatactgctctatcccaatgtcataagaataatttcctatacattcttttaaagttttcaaatgtagtgtttcacagacacttagaattgatttttgtgtatatgtaacattggaatccacttttatctttttccatatggatgtccagttgtctcagttacatgtatcaaatcttttcccactgtcatacaccacattcccaaacacgtgtgactgtgtgtggcttctgttctttattttatttttatgtttatttttattttttgaaacggagtctcgcactgttccccaggctggagtgcagtggcttgatctcagctcactgcaagtgctgcctcgcgggttcacgccattctcctgcctcagcctccagagtagctgggactacaggtgcctgccaccacgcccggctaattttttgtatttttagtagagatggggtttcaccgtgttagccaggattgtctcaatctcctgacctcgtgatccgccctcctcggcctcccaaaatgctggaattacaggcgtgagccaccgcgcccgactgttctttgttaatggtgtgtttgcttactctggctctaccctattttaattaccttggtcttataggtttgggtagtttaagtttcacttcagttttcttttttggaattttttttggctattctaagctcattatactttaaactgtattttaggaatgtggaagccctattgggcttttgttggaattactcagatggtttacagataaatcgtaagaatttgctctcttatcctgggtcttctcatctacaactatggtatagctatgtttatttagttctctttttaggtctttcagtagaattttgtaatttttgccatacttttcttacatatctttgttaaatgtctttgtaagtatctcatttctttctttcatttgttcctttttttgagataagatctcccaggctggagtgcagtggtacaatcatagctaactgcagcctcaaccctcctgggctcaagtgacccttgtgccacagcttctttctaagtagctgtgactacaggtgctcaccaccacatccagctgatttaaatttttttatcccacattttttgttgctgtcaatgatatctttttattgtatcttttcctattattgctggtgtataggaatgttatttttgtatatcttgctgaactcattaattttcatggtttagatactcatacattatgcagacagataaaatcttttaataataatgacaggtcttttccttttcatgttatgtggcattcacttctttttcttgtcttgatgtactgacttggactttcatgatatcacctgtttttgttaataaagttttattgaaacacagccacatccatgttgtctgtggtaccattgtattataacatcagagttgaatagttgcaacagagactacctagtttgcaaagcctaaatacctgccttcaggctctttacagaaagtttgcctatcttcacaaaacagggttgaacagaggcagtgatagtaacctttcttgtctcatccctggctttaaaaggagagcttgtgccaccaagaataagtgctgcttctgggttggttgatgtgtgccttttattgggttaagaaaatgtcttttttttttcttcaacttttattttaagttccagggtacatgtgcaggatgtgcaggtttgttatataggtaaatgtgtgccatggtggtttgctgcacacatcatcctatcgcctaggtattatgcccagcatccattagctattcttcctgatgctaccccacacctcacaggccccagtatgtgttgcttcctcccatgtgtccatgtattctcattgttcagctcccacttataagtgagaaaatacagtgtttggttttcttttcttgtgttagtctgctgaggatgacggcttccagctccatccatgtccctgcaaaggacatgatctcattcctttttatggctgcatagtattccatggtgtatatgtaccacacaagaaaatgtctttcttagatttgtaggaagtcttttcttgtttgttttgttattaaaaaaaatcatgattgaatgttgaattttatcaaatgtagttttggcatctgattattttttctctcattttaaacatacgcaattatattcttttgaatttttctattatttctagtccttggggctagaatccgcccctttgatgtgcttttataacttgtgatctcagtgggtctcattttttctgtaggaattgtctgcagcatggattgtgggaattttgctctggcattttccctgcccattcattagtccaggaccaatttttatgtgaatttctcagattgggcatttccggaccatataggaagcctaaatttgtaccgccaaaatgttccagaggcggtggtctggagtttaaactttgcaagggaaggcttttattctcctcccttggagacagacagaaacatacgagtctctttgtggttgcagctctttgaggagcctcactcagggcagcagccttctacctcgggcagagcccacagactttgcctgtttctcctctgtgctagttgaaatctaaatgcctactccccctggaccaatacttgtttctctccttctccctcaccatgatcctgtcactctctaaggggagtgaatttatgcttgcttctggttttagttgttgctttgtttctggcacctggtaatttcttctttcttattgcaggttcagctatgaatttaaaaatatatataatatttccaggtgcttgtaggaggtgagtgtgaatgtgtgtcttctcaccctcttgctgaaatgagaggctgccctctaaatgaaatttcaatattgaaaagataaaacccaaataaaacaaaaagcaaccccccaaatcagctccctaaccatgagccaggcagcacgtgaagtcctttgatattagctcatgccattcttatagaaactctgtaactctttttaagtggagaagttaagaaactggcccaatcccatgtcagggcagagccaggccaaaaacccctctgttttattggctgttacctcattttacatgtctgaacagtaataacagtgggtgtcaagtgtacctttcctaaaggtaactactacaaaggtcaacactattttccatctaacactcctaatatatttttacacattagtctcacctggtaattctaagatagaataatgatcatgcttgtctgtgagaattagcaatttttttcatggatttaagttcaagaaaaatcagaaattagcagttcaggagttttcaacatttgtaaaaaggcagatgggtgcaccattagcacttccttctgagtgaggtagatctccagggaattaataggaacccgttgttttccatgttggcaagatattagagaaatatgtcttactctcaggtttactaagacatgttttaaagataatactgtcatgcatgtggcttatggaaggctatagggatgtggatttttatattctctctagatttatttgcccatactctgaaatcaaggcagacggtaaaggtggagtcagtggtcattctgtttttttgattaggggtttatagatggctgacattttaatctcagttaatgactggggatggactccagggtccttcaccacagctcacccttgtttgtgatctaatttagcagcatcttgatttgaattgaaagacagccttgggaatattagctcggcccttgtgagagcattctggaatgctgcatattacctgatgctacctgagatgtaggtggttgggcagtgacagcctctctgagccctgacctgtcggggagaggttgagaagtggcaaaactttgattctaccagctgcaaagaccgatgtcaccatgaagttatattaatgactttgacaagaattttctcagtgtacagtaggcatatttgctgaatgagctgatcttgtaatcccagtatatctggagtagtcaattatgaattttctaattagcttgatgtttggtctcccagctaagtgagctcttgtgaactctgccagaatctggatttccaaattatctgacaggaggaaaggaaaggattgggccaaagtggccattgcaagtcagtttcttataagtcaaaaatttaatcagaccaagtgcctttcttttctgtgttcagaaaatacccattctttgtttctcacaactgttaacctgtcctaggatgaactggttctgcctccctttgctgtttcctgcattagtacttggaaaagcctgtggctgcatggtctgaggtgtgaccttcatggtgggcacaccttgtctctcttctctgcccgaaaggaggccactgttttcttgtctctgtaactgctctgtgaattcttcttcttcctgatgactaagtgtgactattctccaaggtctttatctttttgcaagttttctgagatcttcaccaataagcacgaatacttactgaatatgttttgtgtgccaggcactttttaaagcactttaataacaataactaatgtttattaagcatctactgtgtgccaggcactgcttttggtacaaaagatgtgaaataaaccacacaaagaccatccctcttggaacctatgttttattgagatccagccaggtggtagaacacatcagtaaacaaacatagacttcagcaggtggtgacatgtgctctgaaggagaaatggagtccgagtagagagtgactatgcatgatgaactggtcaaggaaagtctgtctgataagggggtatttgagaagagcacttctccaaggaagtggaggagcaagcccagtttgcttccaatttcttcctccttgtgtcttgccaactgggaccaagcatgcctggcgtggaacaaactctttctgttctctgctgatggagccattttctcccagagcccaggctctaggtctgaaccctgatccttctcttcacttttcttttctaatggccagacgtctttgtccttcctttgaaatagaagtgacagcaaaatcttctttcccacagccgttgtggataggaagcctctgcctggctgagcactttgctactttatttctgaattcctgtgccagcctcctcaatgatcttagctgctagtcttgctcttctcacccatctgtggccaccaaagcactggaacacgtaagccatcatttgagtgcttactccataccacacactggatcctcacaacttgctgatgctattacaatatgttttttttcttttttcctttttctaactttttttttttttttttttttgagatggcgtttcgctcttgtcacctgggctggagtgcaatggcacgatctcagctcactgcaagctctgcctcctaggttcaagcaattctcctgcctcagcctcccgagtagctggaattacaggcgcctgccaccacacctggcttatttttttttgtatttttatagagacggggtttcaccatgttggccaggctggtctcgaactcctgacctcaggtgagccaccctcctcggcctcccatagtgctgggattacaggtgtgggccactgcgcctggccttttttttttaaagttttatttaggttcaggggtacatgtgaaggtttgctatgtaggtaagctcatgtcatggggagttgttgtacagattatttcatcagccaggtgtattaagcctagtacccaataattattttttctgctcctctccttctgccacccccaccctcaagtagaccccagtgtctgctgtttctttttgttcataagttcttatcatttagctcccacttataagagagaacatgcggtatttggttttctgttcctgtgttagtttgctaaggaaaatagcctccagctccatccatgttcccacaagagacatgatcttgttattttttatggctgcatagtatttcatgatatatacgtaccacattttctttacccggtctgtcattaatgggcatttagattgactccaccatgtctttgctattgtgaagagtgctgcagtgaacattcatgtgcatgtgtgtttgtggtagaatgatttctattcctctggctgtatacccagcagtgggattgctgggtcgaatgatagttctgcttttagctctctgaggaattgccatactgctttccacaatggttgaactaatttgtttttcttttacaaagttttttttcaagactagtcaagtacactagtgagaagggagaaaaaagtagagcaaggagtttgatctgtaactgactgaacaatcaatggagatacctcttacctttggaccagttgctattacaattatgattcccattttgcagagaaggaaacagactttcctatggtcacttgctaatacaggaggtggctaagccaggatttgaactcaggtccaatggaatccacaggctccttccagccaccagaccaagcttcacataccctgctgtggagcaccatggagaccctggttcgctctttcactctttggctggctcaggattctttcatgcttcctattatcagtgggataaaagtccaaatgttctggaataatatttgagatctttcatgcctggaccgtacttcacctgtcttctggttttgtatctgagctccctcctgtaacaacctttgctgaacatactcaaatgtatcatggaggtaaacacagcgatgcctacgtttatacagtgagtgctttttctttccctttacctgaactcactctttcttcatgccccagctcagactccacctcctctcttaccttcgtctgtgttcatctatacttccaaactctcctgtcagttagaaggcgtgtcctgcctgtttcatgtcattcctaacatcagaggacatagctcttaaagatcttattaccaacttgccatttccatgaatttccttagcccttgatcctaaactattgagaaagcttacatatccaaaatgagtctaacttttctaagcaatggtcttgggagatgtacatatttcactagggcttcctggagctggaaatatatttggtggagctcctttttctaaattgccttccggctacccaagaaagtcaatttccttctttaatagctgtgactcatttttggactgatgatggcactattccagttcagtcacctatctgagtcatcagtagggactccatttaaaatttgactctttccctaaattgaatcaattctcaagggattaaaactagatattcactagaacattccccaggaaaatttagaaatcagagttctgaaaatgtttgctcaaaatgtcaaggggtgaaactgagagaaggcaactggaacgtttctcttaatccactgtccctcacttacctgcttggcagaaagaaggcgggggaaggaaagcattagaataaaaagagaaatgttcagaggcagtttgagtcatgaggaaacagctaaaacttccaaaacagaaactgaatgacatcctcttcctaattcaagccttcctcaggggaaaattgaacagaacatttcacttgataaatggaatgagacctggtcctggagtatttggaaagatgaatgacaggcaggaggaatacagtggaagggaatgccatttatttacaaatgcatctcctcaggtaagggaggggatttcacagagagagggaggtggaaccgcagagggcttggtccaagttagaacatgaacttactccttgctctcgtttctgggggagaaagccatgtatacctccagcactcagaagtgctcgcgacaatgagctcattgggatttgctactcaattagattctgctttgtacatgtagcacttagcactgtgtctagcacataacgaggactcggtaaatatttgttgaatgaatgaaaaataattgctgcctgggagaagttgagaggctttgtaattctgccctgtcatttctggtagtgaccaccaggtggtgccttcttaagaacaggaggaaataaaatcactccagtgaacacagaaggcttggggttgactcagaaccttgcccctgtgcacaccgtctaacagtacatcacaatttcttgttcctaacgttgaatgtgcacacaggattcagatacgtggctggcactgactttctttacttgagtcaaggtcaagtaaggttttcatcgttggctgagctctgggatttaaaaccagttctatcccaggccaagtgggtttctgttgttcctgcttatcccctgtcctccaggagaacacatgctgcccttgcttccatattttctcagaaattcgtccccagcatcactaatggattcatatccagctcttgcactcacgggttgaaaaacttggtacccctgtgtattttaagcagctacctgatgagtacctatgttgaaataggtttctgtggtcgaaattctcagaaaagtcccacaagatgggcataaatgaacaaactagctcagcaggcttaggtggctctcccaaagtaacacagataagtgagttggcagagaggattccagcccaggacagtctgcccttaggttgtgctgtgatctctattctgttttatgtggagtgagtttaatgtatctgcattaacgagatccagggacaaaaatataacaaaattcaaggaatgtgaagcaatgtcctatagaaggaggacagttcactatcagtgtgagccaacacactcagctcttggcagttttcagacagttgcaaagaaatacttagcctgaggcttcttcgtgcccataaacctaattaagggtactagagattctgattggcaagagctagggacagagaggctgagtgagactatacgtgtccctatgtttctgtatataaagacagaaagagggagtttgagagagcgaatgagttaaatcctaagtagacctggaaaactatcattttgctaggactggacttaagcaaaacagcagagcaaagttcagagttaagccagaactttgccttgaacctcaggcccattgagccctctgctccaacagggccaaatcagcatccaatagtccccttcaagttgtatctgtcccgtgtctcggtgtttctggtttctgttatttggtaggtcacaattaattatacagggttaacaaaaatagattaacataatgtacttgccgaatagtgtttctttgggagaaaatgacttaactcacctaaaatatctccaggcataaaagatattaatgttgggaatatcaggagtgattaacctctgagagaggttgaagggaagcaaaattggacaggaaggataggaggaatggagataggggatttcgggtggggagagcctcttagagtcttttatttcagaccttactctgtgcctttccatagggccaagtctgatcatcctctttttatggtctgaatatctttgagcccttcagaaactttcaaattagtaatatacatgattaatatttttgacacttacatgttaggaactagacattatttcagtaatcctcagaggagccttgagtggtagatgctatcattcttccccctttcttttaaataatgaaatagaggtttaggaagacccaaagctagttgatgtcagagccaagatccaaagcccatgtgtggttataaagccgtgttcttaccactatattatgctgtaagaataaagggacaaacctcaaaataaaagctttcactatcagtaacacagcaaaaaacaattattcattcaataatgagcaggatgaataaaaacagacaaacctcatcacatgaagttgaacttcagagaatagtcgaataaaaagttccctcaaacttaggagaaacctaaggctatgaaactgattgtttcatagccttggtaataagtagccatcaggggccgggcatggtggctcacacctgtaatcccagcactttgggaggccaaggcaggtgaatcacctgaggtcaggagttcgagactagcctggctaacatggtgaaaccctgtctctgttaaaaatatgaaaattagccgggcatggtggcacatgtctgtaatcccagctactgaggaggctgaggcagaagaatcgcttgaacccaggaggcagaggttgcagtgagctgagattgtgccactgcactctagcctgggtgacagacagagactccatctcaaaaagaaaaaaaaaagtagccatcagaacccatttaaaatctgttcatttggtcaacaacaacttgtcttagtgaaagttggttttaaaactggcagaactgaccagtgtcaaatccttacttcagcccatcagggatgcagtttccagtaaacatctctctgagtgccagccaatcaaagaatcaattacagcctcagctgagcacccacgtgctgtcaacccacgtgtgcctctgaacatctcacaaccacagagctccatgctttcaaagccctctaagccatcagccatctgtcctgctcacagacactgtttggccagcatagctctcttctgtgatgagcaatgtattcagccttggagttctgtgtcagatactaagtggtgatctcattgttatttgaaaaaacaagcacacatcagtatgtatgtagtgtatggctacagagacaatagcacaggtaagaggttgggtagggcaggtgctagggggggctactttggatgggaagctcaggagagcctctttgtgggtgcaaggtttatgaagagacctatatgatttgagaagagtccagacattcacagatctaggcctggggcttccaaaaagaaggaaaggtcttaaggtaggagaggatgcctgcgtgtctggggaaggagtagaagaggaggctggagaggaaatgggtggaggctgatccttcagggccttgtgggtcatggcatggtcaggatttgggattttgcttcaagtccaacggggaggcaggaaaccacccagggaaggactatgtcctctgctttaagagagagagagagagagtgtgtgtgtgtgcatgtgtgtataatatacacttgcacatatgtgcatattgaaagaaaggggatggaggcttagggtcaggagtgcctcttagagtctcttactttataccttactgtatatctataaatgcacatacatgcatatatacacacaagttttgcagttaggttcaaagatcctgtagatctagaagaatgtctatgacattgacaatgtgagtcagtacaccctccactgtgtgctaccaaatctgcccaccctcttccactgggagtcccataaatgaagtggttttactaccctgttgtagcccagtgacagatgatcagtgatgtcaaaagcgtgattctggagaggttggtcactttgttgcaaagctgctgtatcatttcaggtacatagtctgggaggtacagagtctagggtcagagtagagtctcaagccattgtgcatgcctgcccaagacagagtggagttggtctactcctgaatatattaaccattttttcccttagtcattacatgtaaagcttcatgtctgcatttgtcagttatgatttatccggatcacctttcttacagaaagcggtagatgccaaccagaagactggaataggcttccttttatctcttttgcacagttgtgtcttcggtgagatgacttgactctctgatgttgagagtgtttttgttaatttttgaagcatgatctcagttggtttaggatatgaatgccatacacactcattgttttcgtttggggactgccgctgtgctgggtgactgcgtgtttgtgctgctggcccttgctgacactgatattggatttacaaagccaaccttgcagttttgtgtgggcaggtaggctgcctttaatttgtggttgctttgcccttctgaaaacacgaacttctatctggttggaagtcattttctttttcatcaatctcaactactgaacctatttcttcaggcacatctccagactgccttggatatttcgaggatatgttctgcgtgttcacatttgaactgcagcttggtttgcagacaccctctccttagattggcagctgtttgtggaattcctgagtaccaattacatccagtagcaggaaataaaagacaaacaaggaactagtagagctcaaggtattctttcatccttcctccttcttagctaatacatcttacagttagctctgaaaggagaatttatttaaacatactaaacactgtgcatagtgactcttacatcttttctggtaatagcatgctaatgctatacttcaaagtgcagtgaataagccctgtagagaaatatcctcatggtatggtttcaaaggacaggcatccttctggaacatattgttatcttaggtttttgttttaaatgtcagcacatggagaccttattctaaggctgcgtctgtgctccgctagtgagtatggaaggcttaggtgattcatggtgggaagttgaagtaactagagaagacttggtgctgtttggctttagtgaaatttttagaagctgtagttgaaaaaccaacacagattggccctctgtttgttgcttttggctgtctagggactgcaaagtaaaaaatgacattttcttgatgtctttctgacagtttctcacctgtaggtcaagtcctaattgaaatatgacataaatatttggcgtcataaaagcagaatctccataacacattaggtgatttctagagtaatgctcacttttattgtttgggttccattgatgagttaggcagggttatattttaagaattttcttacatcaggaagagtcaacagaggatggataacatattttgaacgtggacattgcttgtaagttgcaggacacttgtaaacactattgagtgtcacctatagcaggaaccagtttttctttatccctcgttctgtgacagctacctgggttctatgttggagccccgtagtatagtttcaaatgcaatagccactgcataatccttgtcacccaaagactgcagatcttgacagaacttgtacaacagtggccttgctgaggagtgatgtacatttcttttgtcatttggccacataagaaaactgcagccatcactgtattttgatgcatcagactctgtgtcctctgagtgtgattcagctgttggatttcttgattatgaaagtatctagagtacctcatgttcagtgatgtgaactgctatgaaagttccctccgtgtattctgctggatttcttaagttatatcttcacagagagggcttgcctcttatacagtctgcatccagcacccataagtactttcctttgctgcaggagcaggaactgaacccaactgtggatggagtgggaatgtgtgttctgattcctgcttattagcggtaggatgtgataaatatgttccaaagcaatgcctggtagaagtgttcccctacctgcatgtgacaagaagcattttcctcccttcatttggatagaggaagggctttggataaggaaaaaaaataaagaagatcttggaccttaagctggagacaggaaggtcaagtgctttattttttctgtgatgagaaccagctcatttgagaactgaaggtgaatactgactgtcatatttaataagtagtgatggaatttgcatttcttccttgaggtcagtagtctgctttcatagatagaacaggagtttaaattctgagcaaaatatgcaatcttttctctttctttgattcttatcctgtcaattatctcgtcattctacagaggactaaaaggtaaagagttctaagatcttcgcattgtctgggaagaagtggaaatgttaatattagtctttaataagttattaatgacacatattataattgttaggataactcctaaaaggatagtgaagagcatataacttccatattaatggttaaagatgtgccaaacaatagcaacaaaggaggaggaaaatttgaacattgggataaaagcactgcacacagtggtagatgtaaacacaaatatttcagcaattacattacatataaatggactaaatgatgcaattaaaagataaagacatggatgaaaaaacttttcaggaggcatatttaaaagataaggaaataaaagtttgaaaaaataaaaggatagaaaaatattatgcaaatactaaaggaaagcagctgtaggttggctggtatcagtgttgatcatatcatggacatggttgattatggtatgagtttgtgccttatgttgtaagtattcacaatcagagtttcttatagttagaaaaaattagatgatcaaattataaattactagaaagatttcataattgttaaggtgtaggctttttactgcacctggagaggcctttcagccatgatgtgaattatgtaccattatgtaagataagtggagcgtaaatgctttgttcaaacaattataatgtaattggaaacttcttgtgttaacaatatcattatcttaaaggtgaaaggggtgggaagaatgtggtagaaatcaagttccctggggaataggctttacagccaaaagtaaagtcattttttcctgaccagtgacttagcttaaaacaggtcaatgatattctttaaataaagcaatatttaattggattcatttgcagctgatatggattctggggcttgatagcacttacatattaagctggaaatctagaaataagaactttagcaacaatttttttttttttttttaggatttgagattagttattaataacacaggatgcaagactcttaggttgtagttgtgggtaagcataaatatatactgaatagattcagacattggccaagtagactcagtttttttcaggagatcatgttcattcaaagggataatttcttctttctgaaaaacttctattttgaaaatattaaatgatagaattccccctgaaattttttattgtgctgtttaaggaatggtattttacccattagtgataatccatgaatgcatgctatgaatggatacttaggaaacatttcctgcatgtccatggaaagataattatttttaatatttgtatggactgttaggcttttttctgtgagtaagatgtttttaatgtagaggtgtacttatagagtatacgatttttattgtattcttttaaatggactatttaatataattgacatatttcccatggagtaaaaacactatttagatgcttgtggtaacataactcctcaaatcttagtgacttaagacaacaaaggtttattacatggataatgtagatcaacaggaaactgctcattggaattgaagactccatgctgacactgatgggaggctccatccatgcacaggcactcacagtcaccaaagcagcataggaaaatatggtaatccttgcactggctgttaaagcctttctagaagagaaataacacttgcttatatttcattgaccaaagcaagtcatgtggccatgctaacttcaaagaaggtgggcaagcgcaatcctgtatgtccaggactggactattagggaacagcctaattgactactccagattgctactgacaacacttttttaaatgattgggataatactccaataaatgcctatgccatagtttacagagttagcccattttaatgtttgcagtgccaatagtttattaataatgctgaaatggacattttggtatagtcaccattcctccacactgctccttttctggggtacttaaactaatcctagattaagtctcctgttgtatagtttaatggactgctgtatgtctactttgtagcacttattttctaccaacacgctataaatttcatatagagaccacacctttttttcagtgctgtgtctgctaaccgttacataatagatattaaataaacattaatgaaggaatgaattaattggggaagtgggaagggtaaattggtaaaactactattaaggctttttctatatgtttccaaattgctttccaaaagaattatagcaaattcacatgtgagtcagcagtggtttatcagtttaccacccattgccaccactggttattttcctttgctaaatggaaagtcaaaataaataatatctcaatatttttagcactgtaattggcatatctttgattatcaataagactgggtatttttcatacatttggtttttgttattgtgataaaaacataacaaaagttaccatagtaaccattttttaagtgtacagtaaaatataactatgtgtacattgttgtgccacagatctctggaaacctcattttgcaaacctgaaactctttaaccattgaacagtaacttgtcttcaccctcctccaacacttggcacccaccattctactttttatttctaaaatttcgactacttaagtatacctcatataactagacttatgcagtatttgtttttttgtgactggttaatgttacttagcataatgttctcaaggttcatctatattgtagcttattgccagatttccttctttttaaggctgaataatattttattgcatatatatatgtatatcaaattttaaaatctgttaatccgttgacatttaggttacttctacgaacttggctattgtgaataatgctgtaatatacatggtgtgcacttatctcttcatgattctatttttgattcttttgaatatacagatgcttgacttacagttacgtcctgataaaacccatcatcagttgaaactatcataaggtgaaaatgcgttcaatacaactaaccaattaagcacaatagcttagcctagcctaccttaaacatgctaagaacacttacattagtctatggttgggcaaaatcttccaatacaaagtcaattttatagcaaagtgttaaaattgtcatataatttattaaatactgtaccaatagtaaaaaacaaaatggttgcattggtgggtttttgatgttggttatcatgacaaggtctctcactctgccacccaggctggaatgcagtggtgtgatcacagcttgctgcagcctcaatcccctgggctcaggtaatcctcctacctcaacctcccgagtagctgggactacaggcatgagccaccatgtctggctatttttttttattatttgtagagatggggtctcactatgttgccccagctggtctggaactcctgggctcaagtggtcctcttgccttagcctctcaaagtgctgggattacaggcatgagtcagtgtgctcggctgatgctttggttatttaccctcatgatcatgtggctgactggaaatggtggctctttgccactgccccgaatcataagcgagtatgttactgtatattgctagcctgggaaaagatcaaaatttaaagcatggtttctgctgaatacatatcacattcacaccatcgtaaagttgaaaatagtaagtcaaactgttgtatgttgaggactgtctgtatatctaagggcaggattgctggataatatggcaattctacttttactttttttcagaactgctgtcctgttttccacagcagctgcatggttttatattctccccagcagtgtacaagggttccagtttcttcacctcttcaccaacacttggtattttctgttttgttttttgtttttgtttggttttgatagtggccatcctaacaggcatgaagtgattatggtttttgattagcgttttcttgatgtttagtcatgttgaatatattttcatgatgctcgttagccatttatagtatatcttctttacatagatgtctctattcttcaagtcctttgcccaattttaagattggtttatttgttttgctgtgtgaagagagataattttactccaatttggatgccatttatttattgcctaattgcttgggttaggacttctagtactatgttgacgagaagtggcaggagtgggcctctgtcttgtttctgaacttaaaggaaaagctttcagtttttcaccattaagtttgatgttagctgtgggattttcatatatggtctctgttatcttgaggtaatttctttctattaatgaaattttttgtgtgtttttgtcatgaaagggtattgaattcttttcagtgcttttttttttttggcaccaattcagtcatgtggtttttagccccttattaatgtggtatatcacattgattgatttttgtatgttaagccatcctatcattccaggaatatatcccacttggtcatgatgtataattactttaatgtgctattgaatttggtttgctagtattttgttacgaatgtttgcatcagtatttatcagggatccttgtggttttcttgtagtatctttgtctgctttaggtatcagagtaatgctggcctcaaaaaaatgagtttgaaaattttccatctttttcaatttttttgtaagagtttgagaagaagtggtgccaattcttctttaaatgtttgatataattctccagtgaaaccatctggtccggggcttttctatattgggaggtttttgattacttacttagtttcctttccagttaccatattcccctattatctgagagttcactttctgcagtttcaggtactggcagtcaactgcaatctgaaaatattaaatggaaaattgcggaaataaacaataagctttaaattgcatgtcattctgagtagcatgataaaatctcccactgtcccatttcatcccacccagaacttaaatcatccctttgtccagcatttctacgtatacactactcccccattactgtataggaaaatacatggcatatagagggctcagtactattcagggtttcaggcattcactggcggccttggaatgtattccccatgtataagggggaactgctatattgctatgttcagattgtttattactttatgattcagtcttggtagatggtatgtttgtaggaatttattccttttagattatccaatttactggcatatgcttattcatagcaatatattataatcctttttatttggacatcaggtataatatctcctctttcattttgatttttgttatttgaatcctctatatttagtctgaggatttatcaattctattggtctttaaaaaaactcaatttttgttgtttttttctattatttttctattctctaatttgtttatttttactctagtctttattatttccctctttctcgcaactttgggtttagtttgtttttctagttccttgaggtgtaaagttaggttgttaatttctttcttccttgttaacgtaggtatttactgctataaaattccttcctagtattgcttttgctgcatcctatatgttttgcaatgtgaatctcaattgatagaggtttatttagccaaagtttgaggacatgcccaagaaaaacatgggtcacagtagcatttgtgccctgtgcttttccaaagagcattttgggaacttcagtatttaaaggggaaatagcaaaaatgaggctctgattagtgctcagcacatctacattttatttatttgttttaacttcttaaaattttactttttaaataaacatatggtaaaattgacgttgtatgtgagtacagttctatgaattttgacacatgtatacatttatgtaaccactgccataatgagaatacaaaacagttccgtcaccccagagaactccctcatgtcatccttttgtagtcaatatccctagtcccacccgtaacactaacctttagcaagcactaccctgttacccatcaccaaagttttgtcttttccacaaggtcacataaatgaaatcctaccgtatataatcttttgagactggcgtctttcactctgcataatgcctcgaagactcatccaagttgttgcatgtaaacatattattattattattattattattattatggctgagcagaattccactgtgtgaacataacccgttttgttttgttttgttttgttttgtttttcacccattgtagagcatttggctgtttccagtttttgataattaagaattaagcttctataatcattcttatacaggttttggggtacagatatgttttcatattgtaatgcttaggtaattcctagaagtaaggttgctgagtcaaccggtagatgtgcctgtaactttatgagaaactgccacactgtttgccagagtattttcaaatttcagccattctaatatgtgtatagggtattttatcatgattttaatctacatttttcaaatggccaatgatgctgaacatcttttcatgtgcttatttgccgaccctacgtcccctttggtgaagtgtctgttcaggtcttttgctcattttaaaaattggactgcttgttctctcaatattgagttttgagagtccttaatatattctgagtgcaagtattttgctggatatgtgatctgtaaatattttctcccagtctgtagtttgcctttttattcttttaacagtgtctttctaaaaacaaggttttaattatgatggtgtgatttattttttctgttatagatcatgatttacccctttagttataaaaattttataattttatattttacatttaaatgtgtaacttagtttgagttaattttggtataaggtattgagaggtgtagccagctgggcttctgggtcaggtggggacttggagaactttcctgtgtctagctgaaggattgtaaatacaccaatcagcactctgtaaaaacacaccaatcagcgctttgtgtctagctaaaagattgtaaatgcactaatcagcactctgtaaaaacgtaccaatcagtgctttatgtctagctaaaggattgtaaatgcaccaatcagcactctgtaaaatggaccaatcagcaggacatagatggggccaaataagggaataaaagctggccacccaagccagcagcagcaacctgctcgggtcccttccatccacactgtggaagctttgttctttcactcttcacaataaatcttgctgctgctcactctttgggtccgcaccacctttaagagctgtaacactcactgcgaaggtctgcggcttcattcttgaaatcagcgaggccgtgaactcaccagaaggaagaaactctggatacatctgaaggaacaaactccagacacaccatctttaagagctgtaacactcaccacgaaggtcccaattcttgaagtcagtgagaccaagaacctaccagaaggaaccaactccagacacagtatgagatttaggtcaaggttcattttcttgcatttagatgtttgaatgcttcaaacaccgtttattcagaagactgtcctttctctgatgaattgcctctgcaaatttatcaaaaactcagttggtaaaactgtagttgcccatgggtatatgcagcagagcagaactttctgaagtaatggaaatgggaatacacgttacagggtgtgttatgtgggcatatgcatttgtcaaaacatcaatttacacactttaagtcagtgaattttactgtatgtgagttatacttcaattaaaatatcagttggccatatttctgtaggtttatttctggaagtctattctatgctgttgatctacatgtttatctttttgccaataccatgctgtctttattttttattattttattttatttttgagattgaggctcgctctgttgcccaggctggagtgcaatggtgcaatctcagtcactgcaacctctgcctcccaggttcaagctattctcctgcttcagcctcccaagtagctgggactccaggcacatgccaccatgcctggctaatttttgtatttttaatagagacgaggtttcaccatgttggccagtcttgtcttgaactcctggcctcaatcaatccgcctgcctcagcctcccaaagtgctgggattacaggtctgagccactcccggccaaccatgctatcttgatctcaattactttagctttatagaaaccttgatgaagtggaaaagtgtgattcctccaactctgttctttttcaaaattgttttggctattcttgtttctttgcctttccatatacctttagaatcaccttagttctacctacaaaaatcttgttgggattttgattaggtttgtgctaaatttatagattaattaggggaagattcacatcttcacaatactatcttccaattttgaacatagtatgtttttttcatttatttaggtcctctttatttcattagcattttatagttttcagcataccctctaattgtttacataaatatttattagatttatatgtaagtatttcaattttttggaattgttttaaatatcatttttggagttattttaaacagcatttaaaaaatatttggtttccagctccttattgctaacacataaaaatatgatccatttttttacatgtactctacaactttgctaaatacattcattagttgtaggaggtttgtatgtatgctatttcttgggatttttcatgtaaacaataatttcatttgtgaacagggacagttttatttcttcttttccagtcaggatatctttatttcttttccttgcctgattgctctggcttggaattccagtatggtgtgaaataggaatggagatagaagtttgccttgttttcattcacaggaggaaagcattcagtcttcatcattagatgtgatccttgttggttttccaatgatatgtcctttattaggttgacaaaagtctctttttgtagcaaatctacattttacatgtcaaaagagggagtagatgaaaaaagtaaattacatattcatctcatactcagtgaatctacattttactaaataagttgaagtaaacataaaaagaggaagcagaggaaaagtcaattatgcattaatctcagggtaggtgaagagataatttctggtcttgtccttgtcctgtacccgcaaagataagctggtagttgacattgtgagggtgagagtcaacagagctcagttttagggctagtttataggagggatatagatcctgaacgatttagggcctcacgtttatacttattgtatcttccctatgaattggcccttttattgttgtataatgtccttttttgtttcttctgacagttttgacttaaaatctatttgtctaatattggtatagctacctctgttctcttttggttactatgtgcatggaatatctttttccattctttcatttcagcttatgtgtgccattatatctaaagggaatctcttgtatacatcagatagtgaggtcttgttttttaattccttcagccattctgtcttttgattgaggcatttaatccatttacattgaagcaattactgattgggagagactttctgttgtcattttgttaactgtattctgtatatgttgtatctatctattcctcttttcctttttcctttttatttgctgccttcttttgtgtttcattgatttttttttttttttttttggtgacatgctttaattcctttctcattttcttttgtatgtcttctataggtattttctttgcggttgctatggagattacaaaaaacatcttatagttgtaacaatctattttaaactgttaactacctaactttgatcacataaaattcctttacatcccccgtcctactttgttaccaatctttcaaattatacctttttatattgcatatccaatcaagctttcaaactatatccttttatattgcatatccatttatagagttttataattgtagttattttttaagcttttatcttttaaattctataccagaatttaaaatgacatacaacctaccagtacagtattacagaattctgtatttgtctatatattgacctttaccagggagcttacattttcatatgctttcatattgatatctaggatcctttcatttgaaggacttccattagcatttcctgtaaggcaggtctagtggggatgaactctcccagcctttgtttatttctccttcatttttgagtgacagcttttttggccatggtattttgtgttggcttttttttttcttttagcatgttgagtatattatctcacttccttctggcgtataaactttctgctgagaaatctgctgataatcctatggaagatttcatgtacatgatgacttacttttctcttgctgtttttcaagattctctctttgtttttgattttgacagtttgattataatgtgcctcagtttaggctcttcaggttcatcctagttggagtttattgactttcttgaatttagatgttctttttccccctagatttgggaagttttcagtcattattttctcctttctctcactgttctttctcagggactctcataatgtgtatattgatctgctcaatggtgtttctttctttgtttcttttttggctttgactagaaaatttcaaatgacctatcttcaaattcattgattctgttttgctcttgatcaagtgtgctgttaaactcctctggtaaatcttccaattcagttgttgtattcttcagctcaagaatttgttaggttcttttttaaaatagtttctatttatattctcattttattcattcttcattttttggatggtttattttttattgctggttgtctgtacacccagttaactctttaaacttctttaagatggttattttgaatcctttgtcaggtaatttatagatatctgtttttctgatctgcttttggagatttattttattcctttgattgggccatgttcccctgattcttcatatgcattgatttttgctgggatttgggcatttgaaaaacaactacaacaaccagctcttccagtcttaatggactggctttgtgtaggggaagacctttaccagtcagcctggctagagattctgagggtctctgcgaccttctctggagatgtgtcttgtctgggcttgcatgtaatttcccaattagagaagtttgctaatttctttttcaacagtttgtgttctcttgctttctctgtgacactccacagtactgtaggttctccggtacagcaagaaaacatcaagttcttttgttctctgcagccctagatgtccaaagtataccagtttcccgttagagtctgtgttaagcaaaacagaaactagtctcttaggcagccccctgaaaaactggaacactggatgtgcattcactcctcttttcctcccaaaggagaagctctgagtaggttgttttctcccaattcattgagctgtgccagcctggggaaaggctaagaatagcaaaataaaatgacttttcctacctgttttaattctgctgttcttcactttgtatttgcctaggggcactgtggtttcataactggtttctggaggtcttataaaggcattttgtacaatatattgttggtaagtctgtggggggtgggcagggaatgagatctggggcatcctattttgtaatcttacttatatcacctcccaggaagatcaaattttatacttatcagtgtatgagagtagaaatgtcattgtattggggggtcagtagataagattccatatctgtttctatcactaatgatagaactactgctaaattataaaaatgtaaaatggtgctagaatagagattagagtaacatatttttgaaactttaaaatctgaaggaatttactgcttaacttctgcctactttcagggtattaatactagagaaatttcctctaatactttcctttttctttttctttttcttttttttttttttttgagatagagtcttattctgttgcccaggatagagggcagtggtgcagtctcagtttaccgcaacctctgcctcccaggttcaagcaattctcctgcctcagcctcccgagtagttgggattagaggtgcatgccaccatgcctggctaattttttgtatttttagtagagatggggtttcaccatgttggccaggctggtctcaaactcctgatctcagatgatcctcctgcttcggcctcacaaagtgctgggattatgggcatgagccaccgcacccagcctctaatacttttctaattatgaacctgatgaatgcttagtaggatatatatgtaaatcatctgcaattcattcaacatgagtaattactgttaacattttatagtattttctttacattttgtatgtatctgtataatgtattcaaaattatgtatatttaaatgttctctatacacagatctgtttgctctctgatcaccaggctttatataataaactttttttttcatgttaaacattcactggtttttcaatatctgcatattttcctaataatatattgctgtaatatacctcatttgaccatgtaaccatatctcatatttctattttgggaggttattataaatatggggccatgaaaatgtttgtagaaatattctatatgcttttaaaatatcctgttttcttcaagtagattgctggagatggaatttctaggtcaaagaataatgtggacataaatgattttagaactttttctacctttgccagttacctttgaaaaagtgtgagagtgttacattgcttttgtttctcatgaatactatcttttaaaaattttagctaacttgataggtaattttatttgtatttctttgaacattaattctgcttctgtggcttgtttattcttatcccctttgcccttttctttattgtgatattggaaatgtccctttcaattagtttttactctttatttattaagggtgttaatactttttttagatttgtggtaaatattttcccctgattcgtagtctgcatagcttttaattgtcttatgttattgtgggttgaaacttttatttagtcaaatttgtacaactttctttagtaacttttttcctttgctgttgtgcctgcagtcacacaccatccagatattaatcacctagattttaaattttctatatatatacaaatttctgactatactatattccttctctatgaataacctcttttaacatttttttgatgggcaaatttgctggcaatgaattccctcagtttttgtttgtatgaaaaagtctttattttttcttcacttttgaaggataactttgctgaatatagaaatctatgttggtggactccccccatttaacacattaaatatttttctccattctcttcttgcatggtttctaacaaaatgtctgctgcaactttcatcctctatagatgtttccctccttttggcttctttcaaaatttcttatttgactttggctttcagcagtataaatatgatagcccaggtgtaggtatttttgacatttattgtgcttagtggtggtctctaagcttcctagattggtattttggtgtctgtcatttattttggaaagttcttggtcattattccttcaacatttcttttgcttcattctttcttccccttctgttcagttacacacatgtcgcacctttgcaattattccacagttcttggaaggtcgctgctgctgtcactgctgctgctccttcctactcctcctcttccttgttccgcttctcctcctcctcctctctttttcttctctgcccacctcccactctgttttcttctctctttgcatttttatctgggaggtgtctattgagctatcttcaagttctctgattctttcttcagccatgactagtctcctcatgagcccatcaaaaacattcttcacttctgtttgtctgatttctagcaattcctttagattctctcttacagtttccatttccctgttgacattacctgtctgttcttgcatattgtctgcttttcccatcagtgttcttaacatactgtgatagttaattttaggtgtcaacttgactttagaagggatacccagatagctagaaaagcattatttttgggtatgtctatgagggtgtttctggaagaaattggcatttgaatcagcgtactgaataagaaagatctgccctgccccaatattgacaggcaccattcagtcagctgaggtcccagatacaacaaaaagggagaggagaaatgaattcatattctctttctctccccttctctctcttccttcctccctctccctctccttttccctctctccctcccttctagagctgagacattcatctgcttctgatcttgaacatcagaactccaggttcttggctgggtgcggtggctcatgcctgtaatcccagcactttgggaggccgaggcaggcggatcacttgaggtcaggagtttgaaaccagcctggccaacatggtgagactctgtctctactaaaaatacaaaaaaataagctgagtgtggtggtgggtgcctgtaatcccagctacttgggaggctgaggcaggagaatcacttgaacttgggaggtggaggttgcagtgagccgagatgatgccactgcactccagcctgggcaacatagtaagactccgtctcaaaaaacaaaaaaaaccaaactaacaaaaaaacccaaaaaactccaggttctccaccctagggattctgggtcttgtatctgcagtcccgcagtttcttaggccttcagccttggactgagagttacattgttggctcttctgattctcaggcttttgagcttggactgagccatgctaccagcttccctggttctccagcttgcagatggcgtactatgggacttcccagcctccataatcagatttaattcccctgatgaatcccctcttgtctatctatttatcctattggttctgtttctcaggagaaccctaatacacatattaatcatagttattttaaatttcctatccgataagtccagtatttatctggtttgattattactttgcctcttcaaattgttttttcttgccttttagcatgccttgtaattttcattgaaagctgaaaataatggattgggtaatagacctttagtataaggttttatgttaatctagactagattaatcacagactacagttggcctgtgtttagtatttgctgtagctgtaggtgccagaggcttcaaattcctctggcgtcattgtttcagtctcccctgttgtctttgggattccctaagaactcctcagatagagtttgcatcttgcagctcttttagacgtaatctaatgtaatctgttattttactggtgaggtatggtgctaaggtgtagggaaggggaaacattctgtaatcttaggactacataccagtttcttagtgggcttgcattcatggcctatgaccttcacaagtgtttcttagcttttattttcttaaagaaaaaaaaaaaagctcccataatgagataggaaggctagagggggccagagtaggaggaatgtccttccctcaggtggataaggctctggtaaagtctttttggattccactctggagagtaggcctttatttttgaaactcctctgggcatatttcacaatagttaccattagggatggaatatttgtgtccccccacgcccccgcaccccgccaagtttatatgtggaagtcctgacacccaatatgagtgtgtgtggtaggctgcgtgtggaggtattgggaaattcaggttcccaaaagtttggtcgtagtgaagtcctcagaggtcttcttgagtctttccttttcttcaccaaaggctcactgacgtcatccatcctcctgatggaggtcaaagcattaaagtcatttttctccctaggagcgtctcccccattgccaaattgccaggctagtattagggagaaatgtcctccctgaatttcattgttgggtttttttttttttttttttaaaccttattatggctttaatgttgaaatttctgttttggactttttagcatgacacatacacacacctctcattttattttcattgctttttaaactcccatgtccaatgtctattttaatcttatgtttggcagcctgaaacattttatttctaaaattaattctctaattatacaacatctacatggcttgtaatgacatcagtagagcagaatctagaatccaactcaaggttttcgttttgttttttaagagtaagtaacttattttgatcaatgtagtaagaggagattgaaaggtaccagtgtgtgtgaaagtgaatagttgcttcctctccccatctcctcttcttcctcccctgctcctctcctcttcttcctccccctcctttcctcttcctcctcccccaacccttcttccttctactcttcctcctcctctgcttattccttcatcttaactcatccttcactaaaaagagttatattagcattagaagtattccttaatggctatacttttcagatattataacttcagaattttctagccaataacaggattctagggcaaatgtcatgtaggatatggctcttcgagtaccaacatggcaagaaattgatttcctctattgaagacacattgattttcagctgtactgaaaaactcacagccttccagtatcgacaaatagtaaaaattgacttcacataataacacctttatttacctagccttgtgaccctctgattttgttagatgatcctatggtgaaagaatgcaccaggaccaatgcttggacaaatagtaagtctccattttctttatagtagatgcttctacataaaattccgctttgggcagtaacttgcgtagacagctgttcttgtgacacgacataatgcacactgagcacggtgacagctccagacgatggtctactctggagtttccaactggactggtaatctactggatactctcatctggaattgtctcctagctgagtggttaagctatagaagcccatgattaaacaatgttgtttctggaaagaataatagaaatggttattattagtgagtacttactgtctgccaggccctgcactaagggctttttatgtgttagttttgtttaatccccacaatatatctaagaggtattatcccccttttcccgtgaggacactgaaggtccaacagctaataagtgaagctggcgatatgtcctgttttagctactaacatttatcagcttcatcatacagacatactttgtcagattggttagccaggcaagtgaccgctgagagaatggggcacaggagaagtaagtgatgactgcgaacacaggctggacaaagatcactttcttatacgagtctgcagttcttgaaataatacctatcagatatggcattaacagtgattggtagccttatccaaatgcgatatttgacttttgccttcatatcatggtttgaatttacaaacttcatttctttttctttttttttgagatggaatctcgctcttgtcacccaggctggactgcaatggcgcgctcagttcactgcaacctctgcctcccgagttcaagtgattctcatgcctcagcctccagagtagctgggattacaggcatgtgccactatgcccagctaatttttgtttttttttttttttttttttttagtagagacagagtttcaccatgttggccaggctggtcttgaactcctgacaaacttcagatgggggcattgccttaagtgtatgatgcccaccattgaggtagactaccacatggtacctggatgagcatcttatgtttcaccaaaccagaaatttcccaggcaaagtgaacggaacaagagagactgcggattcagacgtttcctatgcagttatacttctgaatgggtagtcacagtgtgttcaagggtaaatgatagctaaattatcacccatctttaaatgttttcactttaacggggttaccaaatcgctctttaaacttgaatttctatcaagcttcagaaccataaatgttttcttagaatttttccaagattatctgaatcagtgagtcctttaactcacttctccaggtatcaaaagtcttttaagtcttttttctgccaaaggtgaatctatgctaacgccttctagtactgattctcctttccattttcccatgcaccctactgctttctgtctccctttgcaattcaacagaaagagaaatcatgaggcagtatgaaatgaaggacttttctgggctgattttccttttgaatcagaatggaaatttatggtcatagtgctttccatgaggtatttagaagtttccagtcaatcattgctcttatcaggggttcttaaaggctttgggagatactaggttagctttcttacaatataggctgccctttgttacagcgacactttctttttgcagattttttttttcttaacagagaaaattgagatatgaaattatttccttaatctctacaataatcaaatcataattatttctattctattttttaaacttttaaatttcactaacagtacatagccattgcagtaatttttttaaaaaatagagaggagcttaaaaataacaaaaacctctataatcccatcacccagagatgagttttggccccattcatctcacaagttctgtgcaactattgcatttcatgttgcctattcatattaagagaatagcattacttttattatgatgatgatttgtaaacaatttcccagagttaattcccagacatttaaaaattttggccataattgaaagtcaggattttatcttctcagttggaaagtagaagagaaaagtataacagtgaaaaaaatttttcttaggtgtgtatttgtgttggattgttctaatttcaaaacagagaaagttttgaactcctgctttcatggttcattcttagaaataaatagaattgttttcccaagaaaaccttggaaaactttctagtaatagcaggaggaatatgggagtaggaaatggcaagttgaaggattttaatttggaaactgccaccttttggaatacagaagagctggttatgggattggcccctggctttacttgtccttaacatgggctttgataaggggaaaacaaagtgagggcttcgagccacaagtcaaggtcttgggaaagcttagcaaaatggtgcaagtctctcgtgatatctacctttatgcttactgctttctattggcaaaaatctctcatcttttgcagatgcactgagatcccatcagtagacagagaaagaacgtgggtgagtcagaagcaatcagccagaagcacacaaatgggtgtggacatgtcactgccaacaacccacacagagtggctggctactgcattcacccttaggatctcctaatgagcacagttaacagtagttggagctttgtctctgacatcctcttgcagtcatctgccttatttgctgattgatttctgttcttgaaactctgaacaggaagccttctgttgactcatccctgcttttcagactggaaagcacttgtaattttatctgccatgtatagtctctaaaaatttattttgaagatatgctgtatcaaaagcaatttaagaaagtaggaaggtaggaaatataacaaccaaaaccaaacagtgacactaaatatatacatatatatagctgtacactagacttaacctaaactgaccagctagatgattttgatgcagtaaagacaagttaagaaaatttgtctttactgtcaacaagacagtaaacttgtctctatgtcaacaagaaaaaaggcaattagaaattcttggaaaaacagaaatttgcaaatgaagtcccaatttaatatgaggtaaactgaaatgtgacagaattctgcataattgatggtatataagaaaaaagaaaaaagaatacattggaacttgacgcttacagctagtatggtgacaacggactatatctcctttaactgatttagtttcaccatctggaactgcactgaataaaaatatttacctaattgtaatactgaatatattttattagttttcatttttcataattaacctgtatgcaaagcatggaagataaattatatttgctgaacaaaatggaaatattctaaaacttgatgttgtaaattaatgcttattataggtgataaaatgtaagggggggattgaggtggaatggagtacaagagcatatgttttcttctgtttcatagtggatggttgaaatggtactctttagtcttgatacatagagaagtagagatttaggaatatgattacatgattaaggtaacaaatgaaagattatatatctgaagaggacagaggggaaaggagatgctgtgtctcaaaattgtgttctcctctagcagggaatcaatataccgttgacccttgaacaacacgggtttgaattcaggagtcctcttatatcccagtcttttttaaaccaaacatgaattgaaaatacagtattcccaggatgcaaagcctgtgtatagggagggctgactttgcgcatatgcagattctgcaggtggactgcaggacttgagtatgcctggattttggtatatgcaacaggtcctggaaccaatcccccaagtgagtatactgaggggcgactggattgtttcacttttgtagaggcatatgggagttaggcagccttgtgcttttcatactatgttcttgtttaatttctggggttttttgtttgtatttttgttatccatgtacatcttttgaaactgaaaaaatggtgatcagatgatttacaagaaactttgattaacaattatactagcacaactttgttaaatttccctaggagaagacaacagcctcaaatgcagtgggaaaaaaaagcaaaatctgcctgcttccacattgttttcaaggagagcacttgaacaaaatggtactatttggacaataaatagatgggtaccaattctagacaagcacaagcaaaaagaaaacagggctggcagtattcgcatgggggcaatttcaagacagaaagcattaagtggacaaaaggtgatattttgtaatggtaggggttagaatccaccaagaatttatacagccatggttctttacgtatggaaaattagcgccgaaattggtaaaggaaaaactgttaggagataaaagaattaaagaataaggcaaaaaatattagtacttagaaaattataatagccaatggtataatttaaggtatgaaaataaaacaaacaaaagtctgcacctgcaaaggaaacttgaaaggcagggctgttggggatggggtgtgtgtggcggtgaaaggggtacagatagtttatcctaatcataggttttaatcactttcttgtagaaggaaggaaaagttttatttctgtgacaccatctcattgtaaaatccagtaaaattgaaaactttgagataaatgtattatcaggagttacagccataacttttagtatgtgagctataaattctgttcttatcactaagtcactgagaactaaggctgctgattttcccaacatagtaaaacagagcgacctgaccaaaaaatgaaaaacatttttatggacttttattctccttcctgcaaccctaatctccttccttcctctatagattctagtctatctaagaaattctaggtggatggtttgctttctctgagggaagctaagattgaggccaaaaggagatctgctaggtacctgtgcaaacgtcaggtgggacagtgaatagaaagtaggcatgcaggggaccgagaaagataggctctgggcatcacaaacagcttttccaactctagagacttgaaaaatgtatttggagttacatctaagtcagaagagtacatcttgtttatccccccaaaaagcctcctggtatataccttttagtcaaatagcattgtgatcttgtcacaatatatggacaacagatattttcagttcatttgatacttaacatagaacatattaatgtgccattttatcagaaacctgtaaaggagtttaataatggataactagaatgaacataagtggtagcaggtccttactctcatcccccctcccacttttcataatgtactgatttgaaatgttcgtgaaatcaatacagacaaattaactcagtgagcagcttctccccagtctcttgctgcagtgatgagaagcctctttctggatctacttgtttccagatggtagacaaggcttattctgacacatggactgaaaacagggcagaccagcagtcggaatcttccctgcttagtgtcttaatctatagtaagacctcaaagaattagattccctagcatgaggaatttttcttactgaattttttaatgccactatatggcagtgattaaatagcaagttcaagtgattaaatctggtccatctctatacttttcctttacaattgctatcaggttttgtaagtaaggaagtggaggcatttttgtaagtgtgttaactctcaaagcccacaaaagtatgtttttaaacttagggatcaagttgtgtggatccgatttcagacccccagaggttcttccaatgtgtctaatgtccaggacagtgcacatgttcagagtttcattgtatttttctttctttctttctttctttctttctttctttctttctttctttctttctttctttctctctctctctctctctctctttctttccttctttctttctttccccctccctccctccctccctccctccctccctccctccctccctccctcccttccttccttccttccttccttccttccttccttccttccttccttcctttctttttttgatggagtctcgctctgtcaccaggctggagtgcagtggcatgatcttggctcactgcaacctccacctcccaggttcgagcgattctcctgcctcaacctcccgagtagctggggctacagctgcccaccaccacgcctggctaattttcgtatttttagtagagacggagtttcaccatattggccaggctggtctcgatctcttgaccttgtgatctgcccgcctctgcctcccgaagtgctgggattacaggcatgagccaccgcacccagccagcagcatgttttctttgaagtgttgttcaggggtctcttgcatcagaatgtcctgaactgcttgttgggaatgcagtatcctgatcctaccctccagattctgattcagtaagcctggactgagccttggaaatctgcattttatttagcataatgtcctgggggcttgggggctccccaaagtttgaaaaccaccgctaagggctattatgtttctgtaggcaaacctatttttctgttttcattttatgtcatacaaagtaggagtttaagaatttatttttggtgaaactagaacactgtcttcaaattaataagagccttgttgtgtaggagaaatattctcttcaaaatctctccacgaaattgatctcaaaaagactggctgagtcaaatgctaaacagatctgtcctgtatctggctgccacctgtcaaaattgctgaccttacacttatgtattcaaatgcttcctggaagtcaaaacatattttcaaaagtttctagtggaaaagaactaagcctgtcgcttggttttaaaaggtggaaattgagataagaccgaatggttgagattaatttcacatcacaagaataggggtgagaagagaatagcaatttccataacttctatcatttatcttttaggttgaggatactgtgaaataatccttccctttccaaccaacatgaagatgactgatacacccatcatactgaaggattcctactgtgtcagagattacattatattaagtccttacagaaatataaagagtataaccttcaaaaaactgggaattgttaaattatacattggattttgggggctattgtttgggaggttttgttttgttttgttttgtttttccttctttcataacagttcgctcaattaactataccagaggcatctttggctgcaaaggtggaggaatcactgtgctcgaagatgacagttctacaccttggcctgacagttttgagattcttgcttctaaaataagatggaacctgaaagatgggatgattctagcatactaagtatttgactttaattggaatcattgaacgtcccttgaattttttttctcattggtattggattctgttgtctttactgatggaaatttcttttccttccattcttggttcatgacaaaccaccaactgtccacgcatgatctcctttcattttacttgtatttgaaatgaaaacctgtgagtgcaatgcctaatctaagaatcagaacattattcttttatacccctatctctgtaattctcctttatcttactccttcacctccccatccctctgccaccagaggtaaccaccattctgaacattgtttatcattctcttgcttcacccctacatatctacatgtagccttaagcaatacattgtttcattttgcctggctttgaactttatgaagaggtatcatccctggcttatatgatctcttgagacttgctgtttcactcagccttatattcctaagattcatccatgctgtcattgctgtgtagtatttttatttgtgcttatactgcagtttttctataaatgttagtataggttatactatgatttatcaatactcatgtcattgggcattcagggtgtttcctgtttttgtatctatgagcagagctgttagtaagcatttgcgtctcctggcatgcatgtgccgaggtttcccttgtgtctatgcttagaggaagtacagcaaccactgctgtgttgtggtgtatgaaatcattcaactttacaaaagaatgggaaagcgctttcagggtcgctatatccatttacacttccaccagaggtgcagaaaagatcctatcagttcacctcttcaccaactctttgtattttcagacatcaattttttttttgccaattttgtgtttataaatctactgatatacttcttaagtattttatctatcccttaggaaaaaaggtaggaaatagaatgtggttgccttcacatagagaggctagaaaacaaagtatcatgcctgcttagtttgatggcacccaaatttttctcccagttatctcactactagtagttgacattcttttctcaccctcgctagaaatatgaaaaccttgcctctgcacagtggaatcccttggaacatttaaaaaatgctaatgtctggaccccacctccagagactctgatttctttggagcccagcattgaacatagggatttttttttttaaataaaagcttcccaggtgattctaacgtgcagtcaaggttgagaatcactgctttaaaatacagaaatcttgacaagcaagcataagctcagggtagcctgatattgttaattgttctttttctcatttctaaagtacaaagtttgcataattttggagaatcctcttgcctctaatttctagctcagcagcctttgagagttttttggtttttgttttggtgtttgttgttggtagaagtaaatagtagaaattcaataaaagttagtatgggctagaaattgtgcttgacatttatttttttcttataactgtggatctcaaagtttagtgtgcataagaaacacctgggaagcattttgttttgttttacaatgcggattttgattcagtaagtcttggcgtgagcccccgggaatctgtgttctaacaaagtgattatgatgtaggtggttctagaatcacctttggataaaaactgcctcataataatcctacagtataagcagtattctcatttacagatggggggatgtgaagcccagagaagttaagaagcctgcgccgtgtcacagagctccctaggggactagcctttgctctgtaagctctcagccctgctcatagtatgcctccaacaaggctctcagaatttaggaaagtctgctttggaacatgtgttatcttctctatacttacattctttcttaatctgccatgactttctctcctcatcaaaaaacagcctttaatctcctacccaaatccacctcgtacctgtgagtcttcaggtgtgttacactctgaacatggtcccgtgagagaatttcttattaaaaattgagcttgcaaaaaatcaaatgtgttatatttttgttcttatttcaccctaaaacaatgactttagttgacaatcacttttatgcaaccttagtaattatttctaaactcatgtacaagtggatggaagtatttctgtgcacatttagaaaatttatattcattgcttgtttccctcccctgccaccccacagagtgaggactttaccatgaaatctgggcctttggcctatgtatttttaatcatgttcatattgtactgtatctgcaaccatctgtaatacagctgtatatgtttacatgaaacacaataaacttttaagtttaattccatttgtgagcagatggtagcttgtcaaggaaacatttgatcatgtttatgtctgtatttggccacaaaaacctcataattactctcattaattacatatccttttcatgttacctgtaataaatgctaaggtatcatatgtgttggccttgtgggatatatttttgtatgtagagacagtcctcttaagaatgtttgcggcctggagcagtggctccgacttgtaatccaagcactttggaaggccgaggcaggcggatcacttgaggtcaggagttcgagaccagcctaggcaacatggtgaaaccccatctctactaaaaatacaaaaattagctgggtgtggtggcaggtgcctgtaatcccagcttcttgggaggctgagggaggtgaattgcttgaacctgggaggcagaggtttcagtgagctaagatcgtgccattgcactctagcctgagtgacagagtgagactctatctgaaaaaaaaaaaaaaaaaaaaaaaaaaagaatgtttgcttctgtaggcacatttatgtctacctattatgatgtcaagggtgtattccagtttgtatctgtagctgctacaagaagggtgtcatgggatctgtggttacactcttactcttcccatctgggtatttctgagtgtatttgctccaggagagccactggttctgctggcctacatgcaaagtgtatctatctctctgttaatgcgtttcccatgatgatactcgctgctgagatacttcctaggaagttttgctttcctatcacctcctttaagtgctttcctttaagtgttctcattttaactcattattaaactagcagacttgattgcagtgaatttttcttaaataacttaattgtagggccttttgcgcgtcattttgtgctcctacttactgctcagaggtggtacaaagtcagcagctcaagagacagacctgccacccatgatctctcctccaagttctcaggatgttcagaaagttaaaatttcactctgtcgagtttccatctggcttggcaatcaatgccggattagctccaaatactctttccaagtctcttgaaggatgtgctagcctctgttttgaattctacttcaggatcacaccatctctgcatgcaagaatgacatatctgagtgactgccactaaacccacatggtggaagtgtttgcttatcctgctatgtgatgctggctatcatattgtcagtttatgaggtgtttttttttttttttgcttgtcttcttccatgtaagtatttccagagcagaggcattggcttgcagaaggtgtgcctgcaatcagtccagcttccccagatgtgctgaggcttcaacaggggtttttaaaacttgtgctagaatactcatcttccaaaaaatctttaagttgatgcaatataatagctgccaattgagcatacattttgaggtagttttctttaatgggagtatatgctcatccacactctctttccagtgttaaatattttaagacagctggttagagttgagggtgccttttttttggtcataaaacgatgacagaactctaaaatcacatggttatttatcaacattaaaaacattcttttatatccattaattaatttattctttataacagcttctgtggaataggtatataaagggtttttttttttgtctactgttatttaagagtatcataaaacctgagaaagaaaaacataattagttgtcatctagtctaatgctctcattttgcagataaataaattgaagttcagagagatgaagtcactcacttatggacctatagctagtgaatggccctgaaattgtttcccagtcatggctggaggcacaactttgtctgagacctgactgatacttttgactatgtgatgttgtgtcaattatctaacacttctggacctcagtttctttacccatattatggattattgtgaatattatattagactacatccaagaatgctattaacccagggcctaccatcaaataagtagttaatttatatcagccacttcacagctgcacttatttttatttttattttttctgagacagagtctcgctctgttgcccatgatggagtacagtggtgtgatcttggctcactgcaacctctacctcctgggctcaactgattcttgtgcctcagcctcccaagtagccgggactacaggtgccaccatgcctggctaatttttgtatttttagtagagacggggttttgccatgttagctaggctggtcttgaactcctgatctcaagtgatccgcctgcctcagcctcccacagtgctgggattacaggcgtgagccaccgcgccttcctgctgtgcttattttcaatactcttttctcagggatcttggtaaccagagcagaatggcagtttttcagctcttacaatgcctttgtttagaagtcttgtatgtgtatatctgctccatcacttaaaagttctcctaatgcaatttggaagggtttaatatggaacaagagcagggactttgggatggagtctaatgataacttgtcacatgttcttttagaagctgaattaggtagtttttgccttactggtgcgctctcatttaactgtgaggtatcctggcacttcaaacaggtaccatatggtaactgttttgtgttttaagcctggtactgtttagaacacatgcttcagagagtggtcattgtttcgctgccacccagttaaggcatgtgttacctcttgttatggatggaatgcctgtgagccctaggttcctatgttgaagccctaacccccagtgtgatggtatttggagatgaggcatttgggaggtgggtaaggttagattagctcatgatggtgggaccctcttgatgggattcatggccttataataagaggccatgtgaacacagagaaaaggtcatgtaaggactcggcagaaaggtggccatctgcaagccaggaagggaggcctccctagaagccagacactgcctgatcttgatcttggactttccaggcttgagaactgtgttgtttaagcccctcagtctgtgatattttgttatggtagctgggcttgaacagactgagagacctctgctggagtgtgcgttgttcaatgatttacttccttgtttgcctacattatacactttcactatgtctccacgatggaagaggcatgactgttcagatgcatcggggttcgtctctacctaccaaggtcctgtgccatgaggagatgtcgggccagggactcaaacaggagcagtcatccaactcctttctattaggtctttggtgatttaaaatctcatatgaatcaagagctggtagagtgctaatgttcacaggtttttatagaacattaaagctctgtaatagttattttgtatgttatataaataatttccctgcaagtatttattcatttactcttcatttacataattgcttataatcttttttaatatattcttgtcccctgcgccacccctcccaccttttttttttttttgctgtggttcatatgcttttatgtaacctgagctataaaagactagaatactgcagatattctatctgccatgtctgtcattttcttatgatgggtacttagtctaccgtatacaaatttctgtatagttaccaatgtctttttagctatttattaatcttatcttgtttctttggcttctgaatcactttgctgaagttgaaatcatctgaggtcagagccagtttttatttaaatagactgaatgcagctaaacctggattatagccaagaaagatcttacaccaagtgcctacaaaattagaagcattgccaaggacgcatcagcagagtgttttgcttactgaagtcttattctgaaataaatttgaggccctggcgatgggagcttttggttgttattggtagacctcctaaaaaatgtaatgtagtttaattttacttttaatttttttagcatgaactttctccttcatttcttctttccagagatttttgggtctatccattggttgccatctatgtgttcaaacatgtgactaggtagaagagaggtaaacaggagtgtattcacctgttatcatggagaagttattattcaagacctgtaaggggaatgtggcagtcctaaaggctgcaaatattctggcagcattgtaggattgcactttccctcctcctctgaaggtagatgggagccatgtgtcttgctgtggctaatgaaatgtgagcaaagtgttgcaagctttaagagccagtgcatgattcatcatgttcccatcccattgccacagtgtttgtgaaagcgagtgttgagatggaccctttgttttctgggtccttaattgactgtggtaagataaattattgacaacctgtactagacatatatcttcagcagtatcctttggttgggattttgttgagataagggtccgtgatttggcatactcagtgtaacctaacctattctgattcttatagggaatcagagaagtgtccttacactcagggagcttgtgatttaatatagttgagaagatgtgtttgcataatgaagaaggaaccagctgcttaactgtactctttatttagccacattactgaacaagagacaagctgattatagcataatattgagattttgagtatattcctgagaccctggtttcaactggaaaagtaactttttttttttccttgacactttcagatcacaattgatcaaaacacctatgcaaggaattaaacttgctacaaataagccactagatgcatgatacctttaaaaaagaccaattatgagttatcttttattgttctttttatattaaaaatctgcatgggaaatggaatgagaatatttataacagtacagatttgctatgatggtgtctattaatcaaagttctttattttttagtatgtggggacgacacatactcatggctaatattggtgaaattgctaattcattcattctttatttggtgattcactccacaaacatttattgggcatttggtataaaccaggcatagctctcaatgctgctggtacagcaagaaacaagacagagcctctgactttgtgtcttacattttagtgagagaattgggtaataagcaaacaaagaaaggtacagtgtggtatcaatgatgagagttataaagacaaagcagagaaatgagacagacagtgcaaggtgtgtgatctcacatagagtggtcaggaaaggctgctttcagaaggtgacatttgaacaagaaattgaagaaagcagggagaaaagccatgtgactgccctgaggaagaatccttcaagtggcataaatagccatttcaaagaccctgaggcagggatgtagtaggatgtttgaagaacagcaaagagaccagtgtggctggaagaagggtgagcaagtgaggagaggtgggtaggagatgaagccagagacgtggtcaagagccacagaaccagggcctgccctgcctctgatgaaaaggcactgggattttgaatgtgagagaaccatgacctgctttatgttggaaactgatgtagtctgtggagggcaagaaaacaaacagaccagcaaggagacttttgcatgagtccaaattggagatgatggagtttggacacagttggcaagtgtggtggttgtgagatgtgttgggttcaagatatcttttgaaaatattgctattaggactttgtgatttgttgtggactttggcctgagcatctgattgactgatgatgctattttctcagatgaggagaatgttcaagatgttgttacctatttaagagaaggtggccattgcatattgcatatgtgagcctggacttcaggggaaagtttaggactggagataggcggttggtcattcaatggataggtggatttgaatccatgagattggatgagattcttttttgtttgtttgtttctgagacatagtcttgctctgtcatccgggctagagtacagtagcacgatctcaactcactgcaccctctgccacccaggttcaagcattcgtgcctcagcctctgagtagctgagatttacagatgtgcaccaccacgcccaggtaatttctgtatttttagcagagacagggttttggcatgttggccaggctgatcccgaacttctggcctcaagtgatctgcccgcctcggcctccaaagtgctgagattacaatcatgcgccaccacgcctggcctggatgaaattcttgaggaaaggagggtaccgagaggagaaaagatgttgaagaactgaatctggggtgctcccaacagttagaggttgaagagctgaagaggaaccagtaaaggggaccgaaaaggagcagccattgaggagagaggacagccagacaagtgaagtgatccacagctacatgaagacagtgccaaggaggaaggagaaatgagaaatgaaaatactactgagaggttgagggcctgggctgagactggaacacaggatatagcagcatggagatcatggtgacattgacaatatcatgtcattgattgggtgggggcacaagcttgattgaagctggttcaagtgagaataagagatgaggaaataaagataggatatacgtttcttgagagatttttgctgtggggtgagaggtaagggaggatagctatttaggatgtgaagtcagaaaaatttaattttttaaagatgggggttatattacacttgaaagctgatcattatttagtagagataaagaaattgacagaagcatctccttaagtaggcaagaggggatgggacctagtgtaagtggtgggttggctgctgcattagctggagttaaggcattgcatgttctagatttgtacggagacatataggtgaatgcacacacttatgggaagatactgttattatcttctgcttgcctttgttttctaagaaatagaatcaagatcatcagatgggtgtgagtaaggggtcatttctaggagtaggagtgtaagttggccaagaaagtgtaataagattgctgagcagaactgaaagcacattgagattactatcatatctttaaagcaaaatcagccagtgtagttctttgtttttctctagattgtgtcatttgctgtggtgtagggagagagtctaaggattctctcgtaggtaatcatggtcatagttttgcaatctgaataatgtggaagtggagatgggcagccgtgcagtagggcacttgcaagggagcaatttttgggagtgccaaaggccaggctggaagaggtgaaggaggagggagtgatttttgggtggtgccctagaccaggctgaaggaggtgaaggaggagggtgaagacataaagtggggaacggaccatggagaggaggtcaagtcaatggatccagagggcactgatgccaaattgttgacaggcatgagagggaatgagctggaaattcctttgaaataaaaagttggcagctttcctcaagcttaatctcaaaagagacatttaaaaattacttacttttgctgcatggttggggaaaaatgtatttttcaagcatgagttcaactcattttgtaccagggtattcacactgatattcttgggtaagtcattaaaattagtcaactatttctgtgtcttcacccacaaaaggagacgtgtgagaagtgaatacttagtgattgttagattccactgaatctcactgctttgttgcagtttaacgagcaggctaggattgcagcgctgtcatttcagttgggccaccaagccttgaatgaggagataaaactggaagataaagtcttagtaggtacaacaaaagaagcttttgagagatcgttggatagatgtcatctatttggttgctaaataataacacacaaagaaatctctctactgtttatcatgtgtacttatcttgagaagcatcagtgattaaaaaaacaactttgaaaacataaaaatggtgaagtgtggcaatggtatcatgtggcaacggtaaaatgtgtttacccatgtaaatataatgtcacaaatgaatcttgtcattatattttgtagtatcttggaggttactggccagaactattataatagtcagattcatttcatatttatttaaaatccgcggtgttttcacatacattgtgtttttaggggaaattttaccaatgattaacatatattgtctagaagcagagccatctgaattgaaactcaaatataattgccacttttattaaatatacaactggcagactttgaaaatgttatctcagcatctagcattggcttcattttggtttctcattttcctattttattttgttcagtttagcaggggacagtggggaacagggttacaaattgcattttttcctgcattattggtttttgtcaagtggtttacaggccaaagtttgtggatctgccagaggctttatcccaaaactataggcaacagctatttcttgaaataattttagatagatttctacattgatttatgttttggggtatatgatgcacaatcccttaagtcttaatatgactattggtttaatatggcagaattaggatcaggttcactcattgtttattataatttacccatgcttgactacccaataaaatgtcttccctttacaatgatctttttctattgccatattcttcttgtccttaaaacaacaataacagatcctcaaacgtcattggggttaataaaagatgtttctttattttcagatctttaacaaagcttctccttaacccagagggttttcagaggagtaaagagtggaagtcatttgtacatgaattggcttttgaaagtggccctcattattttattttattttattttatttttttattatactttaagttttagggtacatgtgcacaatgtgcaggttagttacatatgtatacatgtgccatgctggtgtgctgcacccactaactcatcatctagcattaggtatatctcccgatgctatccctccccccctccccccagcccacaacagtccccagagtgtgatgttccccttcatgtgcatcattttttatgaagtggccctcattattaagccatgtctctgcctgttgattgatgttaactatctgcttatggtctgagatcagtgtgtactgcaaatgtttgggaagatatcttctttctgtggaggtgaaacttaaatatcttctataaaatatgcctcgatttcagaagtagcaattgtagcaatgcctgatgtgaccactttattactgccttagaagtacttttgtggtttgactgtggggagggaacgggtcactggagattttgctatctctccaggtttcatgctttgggaatcaaaggtaggtaacagtttggaaaaactctgtaggggctaaagctttttctaaaggtttttacgtctatatatacctctgtatgttactgcttcaagcccagcaactagcaattttagtttcactgaaattgtgttttctttaaatacacaagataatagaattgtaactggaatttacatgttatatataaagatatattttatttaatcttgtcagaagggttttttttttttttttttggtgcttttaagctaatgtggcatctttctcttttcaaagagtggcatctccaaggaatagctctgcctggaaggtgtttgtggctgtccacttaaaagctgaaattaggtcagtgttattttgtcttgagataacaaaaataagaccccaagggagtagtgacttgggatttcatttaagtacttaatttacaggaaaaaaaatacagtttccgatactgaataattattacactactgaataattatatattttttcttctcccggtgttcttatactttagaggcaattttttttttttttttgtaaagatcacaaaaggtctgattagtcaaagaatgaaagaaatgcactgtggctccaaagtcccttatccaaaacctctgggacagatgtattttggaatttaagatttttgtgctgagaatgatggtttccagcttcatccatgtccctgcaaaggacatgaactcattcttttttatggctgcatagttttccatggtgtatatgtgccacattttctttatccagtctatcattcatgggcatttgggttggttccaagtctttgctattgtaaatagtgctgcaataaacatacgtgtgcatgtgtctttatagcagcatgatttataatccttggggtacatagccagtaatgcgtcattcccagcaaactaacacaggaacagaaaaccaaacactgcatgttctcattcataagtgggagtcgaacaatgagaacacgtggatgcagggaggggaacatcacacaccaaggcctgtcggggaggtggaggacaaggggagagagagcattaggaaatatacctaatgcatgcggggcttaaaacctagataataggttgatgggtgcagcaaaacgccctggcacatgtatacctatgtaacaaacctgcacgttctgcacatgtatcccagaacttaaagtaaaatttaaaaaaagattttttggagtttagaaaaataatacatttggatttagcagggtttagtgcggcactttttaatcacacacactaatatttctgtagtgaaactgaatattcacactgagataaagactatgaataacttcacatcagttcaggtaaggttttgcctcctattaagtcttgataacaaactttaaaaacttaaaaaaataaaataaaataaagtttattttcaaaacttttgaagtttgcgcgtacagctagcttgtaggtctggccttgcttttctttagattatatttcccttattagtcttctaaacacattaaatctgtgtttaccaacgctgtaatattttgccaccgtgaggatggtctagaggccagcaccatccacatcccttgggagctggctagacatgcagaatcacaggtgctaccacgaagctgctgaatcacaatctgcattttaatagaatccccaggtgattcatgtgtgcgttaaagatcaagaagcattgctgtagtattatattggctttaatttagattccaagtcttaaagggaaatgctgatggggggatactttagttgtttaaatcctgggaaagtgagcccagattacactaatatcatttatttaattatgtatgtatgtattttttttttttttgagacaagatctgacggtatcacccaggctggagtgcagtggtacaatcttgactcactgcaacctctgccttgtggggttcaagccatcctcccacctcagcctccagagtagctgggactacaggcatgcaccaccacacctagctaatttttgtattttttgcagagagggggttttgccatgttggccaggctggtcttgaacttgtgagctcaggccatctgtccacctcagccccccaaagtgctgagattacaggcgtgagccactgcatctggccgaatatcagttctttttaattttttattcaatatttcctccgtctctccctcccactcttcctatttttttttttttttttgagacagagtctcgctttgtcgcccaggctggagtgcagtggcgcaatcttggctagctgtaacctctgcgtcccaggttcaagcaattctctgcctcagcctcctgagtagctgggattacaggcgcctgccaccacacccggctaatttttgcatttttaccagagatgggatttcaccatcttggctaggctggtcttgaactccccacctgttgatatatgtgccttggcctcccaaagtgctgggattacaggtgtgagccactgcgcccggcccactcttcctttctctcctccttccttttctttttctttctttttaaaaataagtctcataatacttgactttaaatggatcatttagtctatttatttacatttattatattcttgatatatttggatttcttctcttttatactttctgtttattctacttttgtttctttctcttgttttatttatttttttgagatggagtcttggtctgtcactcaggctggagtgcagtggcgcaatcttggctcactgcaacctctggcctcctggcttcaagtgattctcccacctaagcctccgagtagctgggattacaggtgcatgccaccacgcctggctaatattttgtatttttagtagagatggggtttcaccacgttggccaggctggtcttgaactcctaatatcaaatgatccacctgcctcagcctcccaaagtgctaggattacaggcgtgagccactgcacctggctctttttcttttaggttgatattttttttctcatcctattccttcctctgctagtttgttatataccctatttctctcttttagcagtaatcctagaaattgtagcatgcatactttatttataaaagtctaaattcagtcagtatcttttcttcctcctaaacaatagctcagaatgttttaactcccgttttcctctcttgtgctgtatactattcttgttgtgtgtttattctatttttaaaaattattaatcatagatgattttttaaaacttatttttttcaagacagggtcacattccataagccaggctggagtgcagtggtgcagtcacaatgattgcagcctcgacctccctgggctcagatgatcctcctacctcagcctccagagtaactgggactacaggcacacaccaccatgcccagctaatttttgtatttttagtagagacggggtttcaccatgttggccaggctggtcttgaactcctgggctccagcaatctgcccgccttggcctcccaaagtgctgggattacaggtgtgggccactgcgcccagccaatcacatatgatttggttgtttaatagtggtgtttatctacatttattcacatatttgccacattagttgcttactacgtatttttgcattttagaccttctacttggaatcaccttcttcaacttggattctttagaccttccttaactgagagtctcttcatggcaaactgtcttggattttgtctaaaaatgtctttattttgcccttattctaaactgttactaaactatacattttgttttttgttagtgtatctgatttgctggctgtcattcattgtgctttatttctctctctctctctctgtctctctctgtgtgtgtgtgtaagggagagaatttgctaattagttgattaattttccactgtgagctgttcatttttcttacagctttgttatgaggattcttccaggtctgagttacagaaggattctcctagaaagtatttaaggttgcttctgctatgtgcctgggttattaccaactgtgactcttcacattaaatttttggcttcagggttttgggactctaagagctgtatgaactcgcactgcaaactcatatgagttttcacttattatagtaaattctcaggtttgatttttttcttcttccatccatggccaagatttgagacaggcaagtttccttgcactccaggaatgtagcttgacttactgttcctggtgttggtggtggtgctgctggagatgagatccttttagccatcctatctttggcaggccctgggctttgtttcaccctgaactctgaaccctgaatcctgtgggcagggcttctgctagcccatgtggctccactctaaattgatgcaggcactcagcttgttaaagggagcactggatggatttcagcaagcttcctgttccttatggttctgtctggtaggccttaaacctaggctcaagtactctggagttaaacaagtggcccaaggcaaaagccagcttcagtgcttaacttacttcgcagggattgtatgtatgtatgcatgtgtatgaatatatgttatgtatacatatgtatgttttgtgcgtgtgtatttcaccgttgagtgttaattactcccttgttacaactcattgatgcatttaaataaaacatttaaaatattttattcatctcctctcatggttttcagcaaaaatgtaggtcagggtaaattaccagatatattggaccagctggatgtagtcgcctttgatttttttttagttctaccacctatgtatgtatcaataaacaatgtattctttagtgcttccttatttttaaacattatgtgaattgaataacttatgtaatcttttgcaatttggtttcccgcaacatttctatatggagtatggttcgttcatatttactttataccaatatatgaatttctttagctattcaacacaatttaactattcagattccactgttgatggacttttggattctttccaatttttgctattggagttttccagttttgctgctaagaacactctcgtacatgtcttctggtgcattgtccaggattttctctagaatatattcctgggggtagaattgatgattcattgagtaagcatgtgttgtaccttactaggtaattacaaatggctttccaaagtagttgtaacaaattatgcttccattagcggtacacaagagtttctgtggctccatgtccttaccaattcttagtattgtcaggtttcttaattcttgcctattaggtgggtggacttaatacttcttagtttagttgttataacttgttttttaaaattaacatatctatgtgcatattcgtagtcatacatgtttgtctggtcatttaggtacttatgcaatactctagtagactcagaatagaaattagccatggcaacatatatattacattcttcatattgctacatttgaaaataatcataattatttgcagaaatatgaacagaacatatagaattaaatgttttcacgatgtcttgtattatctttcatgtttcatagcaatctctgtgttataggccacatcaactgcttttgcattgttctgacttacaggaattgcagatttattgttctcagtgccatatttaagttccttctctgtaacaatcaggtgtaatacttgtaaatttttttaaccttagtacaaatttaaaaagcagaaatttctcttgcagcttcctgtgtttcaggcccagtgctaagcacatggcaagcattgtcccatttagttctctccaccatgcttcgggcaggtgctgttgttaagcccctttcatggaggagtgaactaaagcatggagaggttaagggtcttgatcaaggtcccacaatcttattctcaatggaccttctccttctctaatctaaaaccctcattttattttgggaagtggatgtaggtctaggaagcttgtttgtgtgtgtgtagtttgtttgttttttttttttttgagatggagtctcgctctgtcgccaggctggagtgcggtggcgcaatctcggctcactgcaacctctgcctcttgggttcaagcaattctcctgcctcagccttctgagtgctgggactacaggtgtgtgccaccatgcccggctaattttttgtatttttagtacagacggggtatcaccgtgttagccaggatggtgtcgatctcctgacctcaggtgatccacctgccccggcctcccaaagtgctgggattacaggtgtgagccactgttcttggctgtttgtgttttatattaggaggcagagagcacttaggggaagcagaagctctggtctgaggaggcagtggtttacttattagttcacaggccttttaggtaatcactggtccttcacttaattaagcaacttaatatatgtcttacggattaagttaattttaaatcaatgctaatttttatgtcaaaatatattaagcagcatcacattaaagtcaaaggtagtcttgtaattattagagcaataggtatcgtgctgtcgttctccaatgtggctgcacattggacaacctgaggagctttaaaaaatactgctgcctggggatcactcccataagctctgatttatctcgtctggggcaccaggagttttaaaatttctccaggtgatctaatgtgtagccaagcttgaagattactcgatagtcattgattatgtgcgtgccacattcagattggtggggttcaaatcctccttctgccactcactagatgtgtggccttagttaagttttgttaacgtttctttatgtcttcatctgtaaaatggggatgaatgataaaaatactgtctgcatctcagagcattgttatgaggattaaaggggtacagtaagtccttatttaacgttgtctataggttattggaaactgcaacttttaagtgaaacgatgtataacaaaaccggtattaccatagattaattgacataaatgagagttaagttcctgcagcatatttttggtcctaaaagtattatcagacttctacataaagaccaaaacatttctaatattaaacactgagagaaatctaggttatacatacatttaagaaagattaattcaatcatttactcaattattcgactccagaatagtgggtggtccgagcctgtcctggcagctcagggtgcaaggtgggaccagccaaggacaggacaccatcccatcacagggcacactcacgctcatccacactcacactgggaccacttagacatgccagttcacctaatgggcacagctttgggaagtggagaatgtgaagaaaatccatgcagatgtggtgagaacatgcaacctccacacagacaatggccttggctggaataaatttttttttctcacaaattttataatgaaacaatgttactgtaggacctgctgtataatatatacatattaataaaatgcttggaatagtgactggcacaaaatagtcctttactgtgagctattttaagtagactaagaaaaaattattactattattggatattctctcaaaagtatcttgggggctaagattttaaattaaatcaaattttgcctagtactaagcccactttggtgttttcttggctttgtttaatttttttctccatggttttatttaaaagttatttctaatcaccctgtcaacttagcagatatctgttggaatcatttaaggtgtttgtttccaaaagactgcagaaattaaatcaagatatttgcagaggaatgactgacagcttgcaggtagactggagaaagtgcttcctaccataacagacagaaaaaatggtagtacaagagtcagcatttcttatttatttttctatgaggcagggtctcgctctgccgctcagactggaatgcagtggtgtgatcatagcgcactgcagcctcaaacttctagactcaagggatctcctgcctcagcttcctgagtagctgggactataggtgcttgccaccatacctagctgattttttgtaggggtgggtagagacagggtctagctctgttgctcaggctggtcttgaactcctggcctcaagcaattctcttgccttgacctcccaaaatgttgggattacagacatgagccaccatgcctggccaattgagcatttctttaaactggaaactagcacctttataataatttcacacataccattattgttgaaaatagtcagattttcagaggaaatctctattaacctaagttgtataaccttttgaggttgtaccagtgtagagcctgtttttccgagcatctacatgctcaatgctattttttcagttatccagcatccccccacttgtttctatcctatctcatatgcaagagggtgtaaatgtttttgtgcattgcttttacatttttatttatctctcaagtgggcaagtaagacagtcatcaacagaggttgcatttggagatcatattctgttttttctttaaactatttgatcatttcagagaaactttattctcagttctgttttgtcttcagctgtcaatatccctgactccaggccctttatttagcttccattcttactgatgtggaaacatacttttaaatgaactgcctttaaaaagaaatattttagtaaagtgaaggatctttttgtaatgcaaataatgttttgttcaggattttcttgagaaatctgccatgttctctaagcctttgcctccatactggatgtggctttgccttttttgttgtgttgaagggcatgcacagatatagtttctgattatttttctcagtctgatttctccaattaggcatattatcattagaaaactcgcccattttcccatggtgtttaaaagtaaaccaggacttgtgacactatgctactcggcatttatgaaatgtaatttaattactttgtttccattgtgaagactcggtttccttatttcctatattcatttatttattcattattggtatacccaacaagataagtaaatacgatacagccttgcatttgacaattttatggtgtgtatgtatttatcatgcctgaactgtgactagacttaagatgaagatggtacctaaatcaagctcttttatattttgtctttcccataatctagtctgtcttttctttcccacaaaatagaatgggatactttttattataaatatatgacatgttcactataaaagagaggcagtaaaggaccagagaaaatgacctgtgatgccaccacctagaagtaatcactcttgttaacatcttgttatttacttgtacagtttttttctgtgttcataggctgacatttttccttgcagatgttctctctctatattcatacaaagctgcagttgttcaagtcccaccccagcctctggaggtccaggatgaatgcctccctctttctgtcctggtaccttacgtgacctccggacggcagtgtcagtgttggaaatggcaggctgctgcaaatatgctaaaacctcatcagttgtctctattcgtctgaccaaagtccgtgggaagagcaagatgctggtgatatcctggagctcttctgacacaaggctctggctagccttgatacattcctcaaattcttccttccaattctgaaaccttttgttttccagacaataaaaccctcccaaactcctacctagacattctctctaagcagtcctgggagaccacatgtgacttgacttttaactatctttacagcgtttacattttgctccttctttttgtcatgccattactagagggaggatgggccatccagagcagcgtgcgccctccacaggcaccttagcctgttcttcactccgccatgattgaaagaggagaaaatattctatagctgttccttttctgttcttggctttttcactcttactgaccttacaagttttatttttccatttctgaatctcaattattttcatttctcctattcagtatagtttttaatagatagcattgcattacatggatgtcccttatttaatcaactgtttggtatttcttttctgtttttcaaaatctaatgaacactccagtgaatatccttttgttcgggatttatctctagaaggaagattactggctaaaaatatatgtacatttaacattcatatacatatctatacacacttttttttgagacagcgtttcactctgtcacccagactgaaatgcagtggcatgatcattgttcactgcagcctctacctcctgggctcaagcaatcctcccacctaaacctcctgagtagctgggactatagacacgtgccatcatgccagctgagtttaaaatctcgttttgtagagacatggtcttactatgttgcccaggctggtttcagactccttgggctcaagtaatcctcccacctcagcctcccaaagtattgggattataggtgtgaaccactgggcctggcctatgtatacataattaggctatactgtctataaaatttggctatctatagtcaaattattttatatgcatatatccaaatatacctataaatagccaaattatacatatacagccaaattttatatatatatatatataaatgttatatatatatagccaaattatataaagctgtatatatagtcacattatcctacaggaaatgatgtaaatgtaccaatttacattcctgtaacagggcattagaattccctttttccagagccttgccaacactggttatttataaccctttcaaactttgtatgaaagttgtatgtattttaagataaatgaaaacttatattgatttgtaattatttattggtataattgaacacctttccatatctttattgtactaatgtgtatgaattccatcttaatagttttgctaacttgtccattgaggggtttcctactgatttgtaatggctctctatataaaaaggatgttaatttttgcctattttacagtaatagtacaaatattctctcatgttttctattagtcttttaacctttgtttagttttttttcgttccttcataaatgctaaattttatgtcatcatatctttcagtccttttctatattatttctggctttgatggcatgcattgaaagcccttttccaccccagagttatcaactcgttggaaaatgatgttgaaatgtcacttttaatatttactaaacactcttgcctaatttgttctattttgaagccctttaattctgtttctttaatctgcctgtcttttttttgtgcctgttccttactgtcttgactactgcaggcaacatacttacatctaaagaacaagcacacctattctgcccttttgctaaacaaattttcagcctctttttcaatgattattttttcaaatcaatgttaaacatcacgtaaagtttcaagaaaacccctaggggtattagtatttagagtgcattaaatttttagctaattcatgggagaatttgaagtattatatcttctaatttaagttagagtacaggaattgtctgtctttatccctctaagtacattcagattctcaagaatagtaccaaaattctcagatccccctctaccagtatttttctcccactgatggctcttcaaccctaaaatgtcttagtggtatggtttggatctctgtccccaccaaatctcatgtccgatcgtggtccccactgctggcagtagggcctggtgggaggtgattagatcatggggaggcttcttatgaatggcttagcaccctccactttgtgctgttcttatgatagtgagttctcatgggatctggttgttaaaaagtgtgtggcacctccccaaaccccttgctcttgcaccggccatgtaaggtgaggatgcttcccctttgtcttttgccataattctaagtttcctgaggcctctccagaagcagaagccaccatacttcctgtacagcctgcagaaccatgagtcaattaaatcttcctttataaattacccagtctcaggtatttcttttcttttattcttttctttctttcttttttttttaagagatggagtcttgctctgtcgtccaggctagagtgcagtggcgccatctcagctcactgcaacctccgcctcccaggttcaagtgattctcccgcctcagcttcccaagtagctgggattacaggcgcccgtcaccacgcctagctaatttttgtatttttttagtagagacggggtttcactatacgttagccaggctggtctcgaattcctgacctcaggtgatccacctgccttggcctcccaaagtgctgggattacaggcgtgagccactgcgcccggccaggtatttctttatagcagtgtgagaatagcctaatacacctagcctgatgttacacttaggatcctcttcattattcttctgaatccaagcctccaactttatctacccatcacggttttagcttatattttgattttatttcttacatcttcccttatatttattattttaatattttgtttctcttttctccttctatacttgtactagatttatcagaatctgtaaatctcttttaaccctattaatttgttaactcagttaaatatatctattttgccaatgctcatcttcctatttttaacagtcatatatcaaactgtatttctcaactgatgtaccaaaattaaaggacacctagatgccctccctcagctaaagtgtttactactgcatccaaacccatgaattctccctaactgagagaggatatttagagggcctttgtgccttttttttttccccctatttcttccttgaaaattctggagctttttgaaataatttagaattttacttttaagatattattaaatttttttctacagcatgcctctgtttaaagaatcaaagctttttaaacatatcactagtcacatatattatctgtgtagacttagctatattatcatatatttatttttataaagatattgctcagcactattcttttacagttttatttatcttaactgacaaatgaaaattgtatatatttatgtatacaacatgatgctttgatatatgtaggcattgtgcactggctaaggtaagctaattaacacatgcctcacctcacagacttatcatttttttgtgagaacacctagtgagaacacctagaagtcacccacccagcaactttcaaatacattgttattaactgtagtcaccatggtgtataacggatcttttaactcattcttcatacctcactgaaattttttgtcctttacccaacatctcctcagtccccttacctcctctagactctggtaaccactgtttgaactctgttcctatgagttcaactttttttattctacatgagtgagatcatgtgatatttatctttctatgcctggttcctttttcacttaacattaatgtcctccaggttgaccatgttgtcataaatgacagatatccttcttttttaaggctgagtagtattctgttgtatacacataccacatttcctttacccatttgtttgtttttgaacacttaggtggatcccatactttgattattgtgactaatgctacaatgaacacgggagtgcaggcaactcttcagcacactgatttcaattcctttgggtatatactcagggattggattgctgtatcatatggtggttctgtttctcattttttgaaggaccttcagaccatttccataatagctgtactaatgtgcatttacatgagcagtgtacaaagattcccttttctctatatcctagccacacattatctttcgtctttttgataacagccattcgaacaggtgtgaagtgatatctcattgtggtcttaatttgcattttcctgattagtgttgttatttttttttcatatacctgttggccattcatatgtcttcttttgagaaatgtctattgaggtcctttgcccattttaaaaattgttatttactttcttgctattaagttgttcgcattccttatacattttgggtattaatccctatcagattatgatttgcaaatatattctcccattctatagattgtctactttgttgtttcctttgctgtgcagaagctttttagtttgatgtaatcccacttatctattttttgcttttgttgcctgtgcttttagaacctgatcaaaaaattattgcccagactagtgtcttggagcttttcccctgtgttttcttctagtaattttacagtttcgaatcttaggtttaagtctttaatccactttgagttagttcttgtatatggtatgagatgagggtccaattcatttttctgtatgtggatatccagttttcccaacaccatttatttaagagacagtcttttccccatgtgtgttcttggtacctttgtaaaaaaatctattgaccattgactatgtggatttatttctgggctttctaccttgttccattggcctaagtgtctgtttttatggcagtaccatgcattttgattactgtagctttgtagtagtttttgaaatcaggtagtgtgatgtctccacctttgttctttttgctcaagattgcttggctctttggggtcttttgtggttccatatgaattttaggattgctttttctatttctgtgaaaatatcattggaattttgataaagactttgaatctgtagattgctttaggtagtatggacattttaccaatgttaattattccagtccatgagtacaggatatctttccatacatgtgtgtcttcaagttcattcatcactgtcatatagttttcagtgtacagatttttcaattcctggttaaatttacccctaagtactttatttatttatttttttgctattgcgaatgggattgttttattaatttctttttcagatagtttgttgtatgtggaaatgctgcatcagcactaattcttacatattttatcttcttgagatcttttctgtttactttttatttgattgagatgctttcttagataccagtattggtatactttcttgagtttgtttctaaattatcttttcctcctcaaatatgtatttctgctgttctggtcttggattgcagttctctttattcagatgtgtgtgaacactgttctattgttatctgtggtcaagcattgcagacgagaagtctgatggtagactaattattttccctttttaacttacttctcttgtctgaatggaaggctgtagaatttttctctttgtctttgaagaaatttctctagaatatgtccagatgtcttttttatttagcctgactagaatgtctgagcctttttatgctaaaaatgcaagtctatcttcaactcagcaaaaacttcaaactgaaaaccgaagttttaaaaccagtgaagctttcttccacttttaaatattattaccacacctacttcttctcgtaattttttactttttttttcctaaaaaatgtagaaagtacagaaaataatgcggaaagttctcatttagcccaagcagagagttaaaaagataatcttttgtcatatttgttttagatctttttttaacagtatggttatattttaaaatgcctagaagactggagttaaagtcattcagttatttcttaatagtacttagagagttgctcatgaattggaggataatgaaatatgagacatgccagagcaggagaaggaaattctaggggctatttggggtcttttgtggttccatatgaattttaggatttaaaaaaaaatttctgtgaagcatgtcattggtattgtgataaagattaattgcatctttagatccctttgggtagtatggacattttgacaatattcttctaatttgtgaatatgggatatcttttcatttcttgtatcttcaattaatttcatccatgttttatagttttcattgtagagttcttttacctctttggttatattcattcttaggtattttttatttgtagctattgaaaaaagattgctttcttgatttctttttcaggtaattcattactggtgtatagaaacacctctgagttttgtatgttgattttgtatcctgcaactttactgaatttgtttattaaactattagatgatagtttaatgataaatgtttaaggtggcagatatactaattaccctaatttgataattacacaatttataaaagtattgaatcatcatgttgtaccccatacatatatatagttagttattatatgtcaattataaataaaaaattatatactacgttggttttcaaaattaaagtaataattaaaattcgcaaatgatgggaaaaaaaccggaagttcttgggggaaataagcatatttcacagtgtcatggaaattgagtcctgaatgtcaatattgtttcataaatacttgtaacatacaatgcaatagggatactacatcaggatgcttttggctccaagttacaaaaaaccccaactcaaattggcttaaagagggaagacatttgctcatctcacacaaaaggctactcagctttgcctcaatccaagccatcatgtaatcacatggtgggtatagaaatttgaggtgtacttacacctgtgtacatacctctagatgtaccagtgtcctcaagaataagaaatgccatttgccttttgtgtttcttatttagaagtgagaaagtcttttccagaatctccctagaaaacttgcctataaggtctcagccacaattcactcatacgctcattcttgtaccaactggtggaaagaaagaatagaattcacgggaattctattgaatctgacacagattgatctgacatagatcaacggttcccaaccaggtggagttttacctccagaagacatttagccaagtctggaaacatctttgtgctcgctggggtcccctactactggtatctagtgggtagaggccacagacactgctaagccttctacagtgcatgggatgcttcccacaatacagaatgatctgattcaaatgttaatagtgtcaaggttgagaagccttaacatagaccagttaggatctcacccttcagggccaaggaaagggctgtttttcactgaagcacagggctaaggaggggctatgtggatgttgtgtagcccactgggaatgcccactgccatgacgtccctcggatggagctggtcttctgagctgctcagaaagggaagctcggatttgtgggttttaggctactaaaaattaaccaaccacattgaatttcatgtttttctaattcattcctagtcttcttgcctgttaaactttctgctaaagataattctaatgaatttgagaaggtatttataaaagaatatctgtgaggctgtgtgttgcttgactggcagccaaaagaaatgttgcttggggaaaatggcacgaattaaacattgattgcccatcagtcttgtacttggggtctggggtagtctggaatacaggtagggagatcattcaagcttcacagagaggttcactagtacttataaatccaagcattgggagttgagaattgccagaaatagtcatgtaatgatattccatgttgtataggtgtttgcatttcttcctttctaaaaacacagtggttttggaaataataatatcctagaacagtggtcctcagctttttttggcactaaggacaagttttgtggaagacaatttttccctggatcttgaggggaggggaggatggtttcaggatgaaactgttcccctcggatcatcaggcattagattctcataaggagtgggcaacctagatcccttgcatgtgcagttcacaatatggtttgcgtttctatgagaatccaatgcccccactgatctgacaggaggtgaggctcaggtggtaatgctcactcacccaccgcccacctcctgctatgcagcccagttcctaacaggccacagactggtagcagtacatgacctggaggtttgggacacctgtcctagaacatcctggattaagcaattaaggatctctgcaaatcctagctccattgctcaactttgaaaagttgttggactgttttcagctttgggtacctcatttgtaaaataaagaaattgaattacaggcacttacaggtcctgcaattccccgtaactcagataaaaaatagatccctttctcccttcaggagaactcatgactttggtagcagctagagttagcatttgctcatgcttttattgtgtttagcaatcaatgggaagtgcatcaggtgaaatctctcaggcctgcatatgtctggtcaaagctcattcattgattttttttttttcctgctgaaacttgcacatatataaaaaacgaagacactaaatttaattttcaccagctcagtgtatagtattgtggctgctcatgttcctgaagagcgagttgttctcaaataataaactaagctgtataatctttaaaatatttgaccaggtgggaagcctttctgtgaggacaatgtgtttgtgcgtttggtgcttaagcttcaatcccctggccacagcttggatttatttgcaggggaaatctgctacgtaagaagacaaccactttgggcaacattatcttcatcatcagcatgcacgtgtggtaatgacctgttatgagcctgacttggaataactttcttcctcacagaatggtggatactccatatgtgtagaattactgagagtaattatctttgcaacagtaaggcgtgagggtaagaaatcaataaagcagaagggaaagatattaacatttatcgaccactttctgcatgacagcagaaggcggtcaataaatggcatactttattttaatcgtattaggtgattattgcagtattatcttaatttatgtgtgaagaaattgtggtccagcgaggttaagtcacttgctcagtgtccctcagtattaagtgataaagcagaggtatcaacctaggataccctacaaggtttggcttccatctggaagcactgagtacctgggcccagatatgagacagggtcccagcccagagatttgttggtttatcattccttcagcaaacacagcttacttccaagagtgtagaaattggggctgtgcttcatagcaagataataagcatcagaagggctgggtgtggtggcttatgcctgtaatcccagcactttgggaggccaaggcggttggatcatttgaggtcaggagttcaagaccagcctggccaacatggcgaaacctcatctctactaaaaatacaaaaattagctgggtgtggtggtgcacacttgtaatcccagctacttaggaggctgaggcaggagaatcgcttgaacccaggaggcggaggctgcagtgagcccagattgccccactgtactccagccagggagacagagtgagacaccatctcaaaaaaaaaaaaaaaaaaaaaaagccatcagaggagctacagtgatgctggtgaggcagacatttcctgactcatagcaggttacctttgtttcctcgttataatgagaaaaagttgccttccctggacttcctcctattcatcttttttttcctgtcctcttcttgcttaggatgccaaggctgtgacatttatttctgctctcttccctttgagatatgctgaagtcatttaaaaaaatgtcaggaataaaatgcactaaatgatgactgtcttagaaaagactccagttaagctgtgtgcatccagaaatgcaactgtgctgaccagtttctgcctcccttgccctactgataacatgatgggagatgaagtcgtttttcaaaagtgttctgggtccagagacgtttgctcgacacctgtgccctccattggtctaaaggcattagagtttttctcccacaatatttgtctttgttattttgaatttatgacaccctggttgttggtgtttttctttgcattcatacctgactcttgacctccaaaagaaccagtacatacattttactttaagctgggcatttttgtaatactatgcaaccttgaaaataatcgcagtgatattttgcttttttataaggccttctatccttctttgctcttgcatctctctttcccctttatgacagtatagcagaacatatttcattcttccctgagccctctgcagagcaattttgtaactgatttgagccatgtttttgatggagtatctgctctctggacctttccatctcctggttgcaactgtgaaccaccctgcctccaataatctacatccaaaatgctgagcaggagatttatggaatttgtttgaagatattccctgaactctctgaagctaactagttcctttgcaagtaagtggctggaaacctaaagatcttgtgaactgggttctagaagcatgggataacaaatgtaagatttcagactggaagttaaaagcgagttttcctcttgattcagtttctaaccagtcagctaaatggtctctgaatagttgtagctaatgagcaccatcccccaaacagtcaattgtcttgactattaaatacttaaatccatgtattttcgctggagtgtttattactatgtgttcttaggaccataattataaaatgttaagttaggacgacacagaatatttttctctgagtatttttgcctctttcatcagataagatgaaattcatttttattttattttacattattatgattattattttgagatggagtctcactctgttgctcaagctggagtgcagtgccacgatcttagctcactgcaacttctgcctcctgggttcaagtgattctcttgcctcagcctcccaagtagctaggattacaggtgcatgctaccatgcccggctaatttttgtatttttagtagagacagggttttgccatattggccaggctggttttgaactccttacctcaagtgatctgcccgccttggcctcccaaagtgctggaattacaggtatgagccaccgcacctggccgaaatgcatatatatatatacttttttaatggaatgcaatggaatattgtgaagtagtaaaacatgaataaactatagatacatacaacatgggtcagtcttactaatgactgtgagtgaaaaaggaagctccagagaaatacgcgtattatagcttggttataaaatttggaaacttgcaaacttcaacaatatactttttttttttttaaggaagaaaacagacaaaattcagaatagtggttatagttggggtgaggtgagcccatgagtaaatactggtaatgttgtaatttttggactaaatcatggattcgcaattcttcattatattattaaaactaagttttaaaagacccacaaatgggccagtgatgatagtttttccagaattgatagccatcaattctgatcatccaggatccttggaaataaattgcatggatgagctcattcatcacaaatctggggtctttaaagtttctgctgttcccagttctttggattcatagctatgatccttagagggcaacagatctctcccttctcatggcagaaataaaggtcagatgagaatgggagagccatcagatagagaccactgtggaggagtttgcgctttgggctgagcaaagagaagaccagaatcttttggtaccatctccttctgcatttgagatgaaacttagtcttttaaaatacatgcagccccagtcctctgtgttgccagtcacctgagctacctttgggggtagggttttgattaaatggcacgctttgctcatgagtaaccttcggggcacattttgttggtaagaaataaatgcatcactcatttgaatcagagctgcaagtgccatctgtgatgcactcctccttcccattatcacacaaatgtgtttctgtgtgactggttcctggattttgcaggctctcttgccttgcgccgattgctggctgagaggtctcagctcagcgttcaccacgtatcactatatttctattaatacttctgctcttcttggcaaaacagaagtggggcttcatttgaaatgatgggctggggagaggggaagggaaccatctcactcatagttattgacatcaagctaccatcatctcttgttcggataactatgagatttttctgctccctttatgcccccgccccaccccttcccagccactttctgtcctctgccagagtgatcttgtgaaggcttcaatcagaccagatcattctcctgcttaaaaatccccccgtcgtttcccgttgctcttagaacaacatccacactttttatcctgcagtagggggctctccatgctctagcccctgcctatgttcccctcctcatcatgcctttctgccctttgttcactatattctagtcaccctggccttctttctgctcctcagtcactccaagctcattccctctgcaagaccttggcatatgccatttcccctgtcaagaacgttcctgctctaggtcttcgcaaagcttacatgttctcattgttcaccgaacagtcttccctggccacccaatctaaagtagtccagccccacctcgaaggacactgtctcattgcaccttttattatcatcactgcatttaccattctctgaaattattctattcacttgtgtgtttatggctgtcctgattagaattaattttcataaagagaacaagaatcttgactggttcacccttcaattccttgtgcccacaacagtgactggcacatggaaagcattcagggaataaaagcacaatggaaaattaaaacatactcactgcatgcctgccacctatagaaccaaattaaatcactgccaatatgcatggggaaaaccttcccatttttctggaataatgttacaaaggatggaaaataagtgcacatcacctggatggcatttaataaacgctgtgacccagtagtgtacatttcagtgaatattgccaaaggaagtaggccaacatcaggtaatctgagttaactttcctgtacattgtgtattcgtttcctgatgatcaaaactggattaattagtctacaatgtatctttcctgttagatacgaagattatctgctctatccaatttgtgttttcttagctgagaaatcactgttgaattttaaaagcagcttgcctggtcctcatttcctggtcttctgatggaaatggtttatggaaaaaaaaatatttactagagtcagataattagaacattttatgtattttgcatatgctaatgcgtttgagttcctttgagggagagccgcatggcataaagcagaatgaaaaggatgattcaaatttcttcacccagcctcctcccctggccagatttagcacttcctatataccaccacctcacagcttagcttggctgggagctcctcaggtttccaaaggacggtccttccttctccctcccccaattgccatccctacaccagggtgccaactcccaagtgggctgacaggaagggagattggaaacagctttatagtagatttgatgctgttataagacacgttgtaagacatcaggtaaatatagcacatcagattttattaatcataagaattctttaaaagccttcagcagagccgagatcatgccactgcactccagcccgggtgacagagcaagactccatctcaaaaaaaaaaaaaaaaataaagccttcaacagtggctaaacacaaaaccagaatccctttagatttcttaaaatgcctttgtagttcttttgtaatatgggtccttgttggacaaagttagtaatttgttttttatatcctttacattaggggtttctaacccccaggccatggaccagtaccggtccctggcctgttagaagccgagtggcacagccggaggtgagcagcagttgagcgagcgttactgcctgagctccgtccacctcctgtcagatcagcagcagcattggagtctcacaggagcgtgaaccctattgtgaactgcacatgcgagggatctaggttacctgctccttatgagaatctaatgcctggtggtctgtccctgtctcccatcacccccagaaataaagtttctatgattacaataaatgtaacacacttgaattattcatcccaaaatggtctctcccgactccccactatccatggacaaatcgtattccataaaaccagtccctggtgccaaaaaggttggagactgcttcttttaatgatcatgttcacatacggacagtgaaaaggtgggtcttcttagaggttaaagggaaagtaggacagttgccacaaagctccctttttggagagtgcccagccagggagtgttactagggcccaccttggccttgctgatgtcttcagtggtgtccttgaagtcagcatgggattggcgcaggctcctgttggggcactcggtgaaggtcctccctcctccccagtagctctcatttccagggcccttattttcttttggccatctgggactgaagtcttgctcctggtgggctatctctgttgccctatcacctttagtgatttccactaaataaccctcttttaagcatttaggggaagagggagtagcatgaacgtttattgtgcagtggggtgagaaagtcagtaccagtttcaacacgccctccagctgccttcctccagggaggggacttcacactggctgtctccacagatctgcagtgcccttgccatagctccaactcctggccttctcccactccccgctgcctgctggcacatagagcccttgggccattctctgtgtggtattggcccctgcctttgcttatgctctctgctgtaagcagctaggcttagacttccctaagaggagtcccggacaccactgaggatgcattttcccttcctcacgtgaagagagcattaggtgcccttagctttggagggagtggagctttggagcctggagacaggggaccaggaccagattacccagcctccctagattctgctgaactcatctttcagtaaagaggccagatgagctgagctccacttctctctggctccatgttcctgtgacttttgactcatctgaggttgactttgagaaggcaatcccttttaaatatattggaatccatgtagtatgaccctatccactgtggaatcttactccattttactttaaagagaatgtaaatggtttggctgcacatcactatgaaaatggcctaagtaagcagaacggagaagctgccaggagagcagaggtggagagtggaaggggccaagccggttctaaatcgttttctgcaggctcctgtcctcagatgtactcacttcatgggaaccaaatcacatttaactgctctccagctcttaaaacaggataacttgagccatctgatatttgagaagaatacagcaacccagaagatgtattaatactctattctctaattttccagaataagtcagatcattgacaaatgacatacttgggctgtattaccttcctacagaaagactttcactaggtttagtaattagctatagcttcagccttttgttttgttttgttttgttttgttttgttttgtttttgagacagtctctctctctctgctgcccaggctggagtgtgaaggtgccatctcggctcactgtaacctccgcctcctgaattcaatcaattctcctgcctcagcctcccaggtagctgggattacaggtgcacgccaccacacccagctaagttttgtatttttagtaggtatggggtttcaccatgttggccagtctggtctcaactcctgacctcaagtgatccacccacttcggcctcccaaagtgagcttatgtctttttgaaggatggctatgggaaaagtccacttgaaggatgttttgtcatttatttacttactgattaattaagatgggaaagtcttgctatgttgcccaggctggtctctcgctctgtcatccaggctggagtgcaatggcacaatctcagctcactgcaacctccgcctcccgggttcaagtgatgctcatgcctcagcctcccaagtagctggaattacaggcacctgccaccacgcccagctaatttttgtatttttagtagaaatggggtttcaccaggttggccaggctggtctcgaactcctgacctcaggtgatccacctgcctcagccccccaaattgctgggattacaggcgtgaaccattgcgcctggcctcagctccctttagtttttaaagatagacttcctatcttataacagttttagatttacagagcagttgcaaagatagttcaaggagttcctgtattctctgcatccagtttcccctattattagcaccttaaaatagaatagtacattggttacaatgaacaaaccaatgttgataaagtatgtcaactgaagtccatacgtttttcatttttcctagtttttacctagtttcctttttctattccaagatcccataccatattacttatagttgttgggtctctggatcctccacagcaatttcttagacttgccttgtttccattatgaaacacttcagacataccaaaagtgtgtgtgtgtgtgtgtgtgtgtgtgtataaagaataccaatataaccagcattcagccctggaagcagaacatgaccaacatgattgaagcctcatgtatatccctcttgatctctttctccttccctcttcaaggacgaccaatatcttaaatttggtgcttttgtcccaggcatgttttgaaacgactatatgtagtgttgctttgcatattttattttatcgagacaggatctcactctgtcacccaggctggaatgcagtggtgtgatcatggctcactgcagcctctacctccccgggctcaagtgatcctcctacctcagcctcttgagtagctgggactaaaggtgcatgccaccacgcccacctaattttgaaaaaaattttctacatatgaggtttcacatgtcgaccagggtggtcttgaactcctgggttcaagtggtcctccctccttggcctcctaaagtgctggcactacagcagtgagccactgcccccagcctgctttgcacattttaaaacaatataagtattataagcattgctctacagtttgcttttttccccccacataacatgttttaatctgcattgctctaatgtatctagtttctaagtcagactctgttgtatgaatcccctctcttgttgatggatatctaggtgttttcctttctgttgctgtcatggtcattgcaaacagtgctgaacagacacctttacaagtcaccttatgcacgtgagcaagcattctacttggggagaggaattttggggtttcaaattttatccttaacaaagcagtttattcattcattcagtaaatattgattgactatgtaaaaactgagccaggttctagaggtaaacagaacagaaataatccttcatttatcatgagtttacaatctaattgggaaaatgaacattaaagaagtaattaaagatatgtatgtactatacagctgtatcataaaaataaagaacaatgtattgtgtgccatgaaaaaaatataaggcttattaagggatgtttcttaatgtttcttgtatcataaattacctaaagaatttctggacaggaaaatgctactctcctactgaatttatgtgctttctttatcgaacaatggaagcaatgtaaagcaaagtgtttcttttttgccttagctactaggagtagctctcatgtagatgctgtgcccagctgcagtgcctggaacagcccagctacatttagtatgtttatattttggctttttaaataaatggttttcatattgttctatgtcttgttttgcatgctgaatcattttgaatgtaaatgaggtatagctcttggagagaggacaagatatcattgataagtggttggtgacccccacttttcttttcagagacaaatgaccttgcttttacttggtcttgctgtatttatatagggatcttactgtatttgcatgcttgcttaatttcaatataaatttatgaaatttattatccatcaagagtcaatttgtcctctaaatatttcacttagatgatgattttttttaatcaccaccaacacatacacaaacagaactccttagcaattccatttggctgtactgctatctttaggaacatttatcttgctttaactcctctcttttttacagacatttagttttctgtgacattgtttactttcgttataccttaattatgggattctgataaccatggaggagtaggagagacaataaatggggttttgtgggtgattaaatgctaaagcaaagctgagatctttgataagcacaacagttgtttctgccagtatattccaaaggcaagactattcttgcaattacacaacaagcaaggggggagaaacacctcccacaaatcactctgatatgtttcttaaccactgtgcttttgaaagcctaatgctctttcttctgatgtttttttgactgtcagcctgagtagttggctcttccttggtacgaggctatttaaatgacaggtcctttctcagtgtgaatgtgtcagctatctaaatgagtggttgaaaatgtacctccgcatcagccatgtggaccacggcatggtctgaagaaaattatgtttgagcagctatgattgagctcaattttgcaaaagcttactgagttttaacaaataatttagccctatcaagcagaagtgcatttggctgcaggtaatagaaaactgaatcattggtggttttagcaagtaggttttctttttctcacatgacacagattggcaatactgtcagagacccagtttcttttgtgctttctgctctattttttgtagtctttcagcctttatcgttgggcttattgtctcagggttgcaaaatgactggtctgactgcagattttctaggagggaagtgcaaagtggtggtgctggccacagctttccttctttgtcaggacagcaaaagtttcatcggaactccccagtggacttgctctcttaattcaaaatggctgtaacagtgtcacgttggctgcacctgtttcaaagaaagttcagaaaattgggtatttcacagacacattaagatttcaaacaaagacgagagcattcacaaggaacagagagggaacgtatgtggatggggcaagtaactgccagtcatcagcctgttatgtactgtacacatagagttttgctgtgcagcagcaaatataaaaatgaatgtcatcaccatgaaagtggaaaaccgtatttcaatgtcatgcaaatgccataattgaaatgaaaagataggaaatgctggtgcattgtctacattaatgtatttggttgttgactttattgcataaaaagtatcagtggggacgagatagttttgctttgtttcagaagattttgcttttgtttttcccagctaagaagggaaccttaaaaataatgaggagggccgggtgcagtggctcacgcctgtaatcccagcacttttggaggccgaggcaggtggatcacttgagattaggagttcaagaccagcctggccaacatggtgaaaccccatctctactaaaaaatacaaaaaaaattagctgagtgcggtggcacgcacctgtaatcctagctacttgggaggctgagggagggagaattgcttgaacctgggaggtggaggttgcagtgagctgagattgcaccactgcactctgcactccagcctgggttacagagtgagactctgtcttaaaaaaaaaaaaagaaaagaaaaacacacagatgtatgaaatagagcttattaattctgtatatattcacagaaaacgcatacttttatgccttgattatctttaggtgatcatggggaacaggagcccaaagataattaacaactgtgctaaaacaacaaaacctcaattgggctacaaatgtcaatatcatgtacacaggtggaaaagactcttctttgatttcatatttttcttttatttccttggcatccctgttctggttatgtcttgctgtgtactctagacataggttttgtgggttgactgagctcagccgggtggttctcactggggtctcttatgccctggctcttaaatggcagctggggctcctacacatggcatctccatatggcttaggcttgtcacagtctggtggctgggttctgaggctgaagtttccaagagaccaggggggctgctgcaaagcttttaacctgagcttgcaagtcatgaagcatccactttccgttggttgtgctggacagcccagatgaaggggcaagttcccaaggacgtggatacctagaggcatggttcattagggaccaactttggagacaaacaaccacagtctccttccttctcttcccttggggattgaaagggttatcaaaagctggccagaaagagaagcaaagggtgaggataccgctgctgcagcacgtctgtagtagggaatgaacccagaatgtgaagagttgccattctagtaccctcgagtgtccttttcatgccattggaaacttgacaatagtaattgggagtgagttgaaatcttcagctttctacctttgtattgtcctttcagagcaaaaagaagtaaacattaacttaaaaaatgcttttgatattaatagttacaaacaaaaaacaaaacatgcaacaattccaagctcaaatcaaaaccaacactgagctttgaggtgcaatttctattctatgtgtgtggccatctcctcttgtgttagtggctgagcagagaatgctccattccaaaataaatagaattaattttcttaacagcatctttctttgtgccaagaacacagggttacaggaagcacatctgaatgtaccattggcaggttaaatcattctctttactttggtctttggtgggtttttatgtttgttgcttttcatctgaatgaatggcaatagagcaagttttaaaaatccttagggatctccagagattcctgtcttgctaagaaacaggaaggccgcaattagcagagaccaagaatgaagaggaggagaagggggcgggtgtctttgttgctgtaaactactagttttcaccattctgcaccttgggctgtgttgctgctgctacctggaacacccttcctccccctcctctgccgggaagactcccacttagcccagatgcagcccagctgctggcttctgcatgcagcccacctcttcttgctggacagggtggcgtcttgtcccccacacccacaattcctgtgcctatcactttgtctctgtattccttcctcagattgtagctccttagtggcagggaccagctcttagcctgatatcatcagccaagcaacgtgtaggatgcagaggtttggcaaaactttgaaagcgggaatgtatagtcaactatgtcgatgtctgggtcatttttccaatgtctggtagcaattgtgttaggtggcttatacctctcctggacccacacatagcaaattctaaaaataacaaactggaccatataagcttttccaaaagcctggggtgggggagatgttataatatcctgacatagctgtgctgttgttcatttcacctctgtcacctagagcaaccccctccatgttttccaaaaccgcccccatcctcggggtctggtttgggacccctgtcctcctggaggtcctctttgaaccctctggacccttctctcagagccctctggtaccttgatgtcacagcatttcctgtaatttcatttccctggcctcttggctaagataataggctcctgtccttgctttttctctgtcccctgaaaggggtgaagtcgtgtggacatgtggcaggtgccactattgtttatctgctgaacactagcactccccgtgccttcatgccatcaggcagggggcatttgttcttttgacggtgtggacaggggcagagtttagtggcattgttcttttttagcttaatgagcacgaactgtcagagcttggaccaaatttttcttgcagatatattttgattgacaggcacaggatttttggagataattgaaagagttgccaacatttatcaggagactgtacataaaaatacagagttccagtttccctcaaaaatttggaagttttggcaaaattgagtcccaattaccaaaaattgcttctaaccaagcagtaactattcccttcacacagaatgagcctcccttccctcatttcctgtaaaatggtactgcatgttctcctctttcatttgtgtcacctgcctcattggtgggtaagttgttctagaaaatgtctatcatatgtgctgctgtactgctaagtgcgtagagccctagtacccacagggcacacacaaacaaacctggtatacaaagaacttctgtgcggatttctttcttattgtgcacattttaaggggcatcagtctctgtccatgcatccttagaattgtatggctttttcatgatttgatttattcaacaaggatcgaacagtctgtttgtattgagtatttactatatattagttactgttctaagtataaactcattgatctcacaactctgagatgggtgcttttactatctccatcttacagatgagcagcagtttttttgttgttttttgaaatggagtctctctgtcacccaggctggagtgcagtggtgcgatctcggctccctgcaagctctgcctcctgggttcatgccattctcctgcctcagcctcccgagtagctgggactacaggtaccagcctccatgcccggctaattttttatatttttagtagagacggggtttcaccgtgttagccaggatggtctcgacctcctgacctggtgatctgcctgcctcggcctcccaaagtactgagatgacaggcatgagccaccgcaccctgcctagaagcagctttaataccaggtcacacagccaggaagtagactagctaatgtttcaccttaggcacaggtggagggagtcacacatctgtaagatttgttcccaggacaatatcattttctttaaatgtctgttttgggaggacttcaatgagctctcagatagaaacacccatttccagggagcattcttaccctagaaaaagcttgggacagttgtattcagacagctctgctgttgaccatgtaaggaactctctgccactcttcctcatagctttggcggggattatttgtctttagacttgttcctttttgtgaaagtgacagtagtgatagtcattagtagttagtagtcatggttacttttgttgagcacttacagtgccaaatgtagtaagcactttcaaactgtattactctccccgtttctacttgggaaactgagtattactgtgtgagtgatggggacttcttgaaagatcctaaacatgggaatgtcgtaatcaggttgctgtttcatggatttggttccgaaagccaagcagagagcgggtcaccagcacagtagtaagagtcaggaaaattggttgagactgttgtgtacaggggagagttgcttggggcttgaactaaagggacggtgaagagaggggtaggtttgagagagacttagaagatagtaatggcaaggcctggtaaaagacgggagtgatttccagttttacagtttggacggcagcatggataagaaagaatataaggggctgggtgtggtggctcaggcctgtaatcccagcacattgggaggcttaggtggccagatcacttgaggttaggagttcaagaccagcctggccaacatggtgaaacctcctctctcctaaattagctaggcgtggtggtgcacacctgtaatcccagctactcgggaggctgaggcaggagaatcgcttgaacctgggaggcagaggttacagtgagccaagattgcacgactgcactccagcctgggcaatagagcaagactctcaaaaacaaaaccaaaaaaaggtagaaagaaagactgtaagaaggctaagaaggcatcgtgcggacaggggagtgaagtgtcacaaactgtcagtttgatgtactctgtgactttcagttgaagatgtcacaagattacgacaaggagctcccagtgtcttcacgtagttttcccagcttactcagtaaatatttgttccctaaatgaattcatgatttccatagttactcagtaaatatttgttttctaaatgaatctatctgtaagcaactcaagtaatatcccctcctaccatttatcttaatgtttgaatttcatctccaaccacttaaatcatagtctctgggagatgggagctaggcattgacatttaaaaatgtatgttcggccaggcacagtgactcatgcctgtaatcccaatactttgggatgccaaggcaggtggattgtttgagttcaggagttcaagaccagcctgggcaacatgacaaaaccctgtctctaccaaaaatacaaacattagctgggcttagtggcatgcatctgtaatcccagctacttgggaggctgaggtgggaggatcacctgagcctgggaggatcatctgagcccaggaggttgaggctgcagtgagccgtgattatgctactgcactctaacttgggcagcagagtgagaccctgtctcaaaaacaaacaaacaaaaacctttgtgtccacagatattctaatttgtggccaggtctgacagccactgcttcagttttaatgaaacaacagatgaaacaggtctactgagatgttcttttactcatccatcaatttcatttttgagtgtctaccactgttttgagctccatgaaactcaaaagtaagcattgatgtgttcacctctgtgttcctagtaccagaactgtgcctggcacagaataggtgctcaatagatagttgtagaataaatgaatgttttatgattctgagcacttagagaatactgcgctctagtaacatacaaccatcagtgtctgtagctgtggcaggaggctttctgcttctgaggtctctctgtctggactgttgtgctattatcctctcatgtttcttcaaggcagaggggttgctgcctgggaaaggtgtacactttggagagtgaagtcagactttgctaagtgaacgcttggatacgtgttgtgcatctctgttcccaagtaccttctctgctatggactgaattgtgtatctccaaaacttgcatgttgaatctctacccccagtgtgatgttatttggaaatggggcctttggaagataatcaggcttagatgggtccacaaggctaaggccctcataggggaattactgcttttaaaagactaggacattctctgatcctttggaagtatatttcctttccatcctcttctctattacctgccttccacctgcatcattggagttggcttcttggtgttgacaaaccttacaatactcaggttgaagacaagagcagccgagaaggagcttttgtagggagtggttgtcagtgtctggtgctttaatatttccttccgttgggatttggaaaaggcagtcccacatagaaaattgttccagccgaggaacagcaagtctgtctgtcaatctctgggtatattgaagacatctctctgagtatattccaaatgtactcatcagtgacgtactgcttctccagaaggtccccttaggaagttgaaaaagattctaattcctaacacagtagctcctgctattttcctatgtatgtttttttctcgcttttatcttctgctttaccaaaatacatttacataaacaatattagtatgtgtacagaaaatatgaataaagaaataaagattaaaaaccttagaagaaatgaaaataaaaacttaagaattggaaaagaattctaaaatctcaaggttgaccaagctggagggtttttttgtgcatatttattgcagttctaccttgtgccaggttttagatactttcttttaatcacagaactttacaagatacgtattatctctattttatggattagaacatttaggctctgaaactcaagggcatgtagctgctacatggtagagtcaagattttaatttagcatgcctaactgtaaagcacctttccttggtctaaaggccagtgacagttcctaatgaaagttttcacacgtacacaatgaaacaagaaaatgaagacagtgtagaagatttttgataaagcaaaatacaattaactttaagaaacctgttcattattttaaaatacctatattggctaaagtttggcaatctaacgtcagacccctaatcattatatatatatttttttcttaaaagtctactcgttcgtgaaatcacaagttcacactcagggttcgtgatttaatggtggaacaaaacagaatatttaaagttgggaatgttccagaaaagctagatttacaagattgtcttaaggccccaaagaggaaacaaagatttggcttgctgatcagagttaaacattgtgtacaaaataccttaggaggaatttgagacctccgttatttcagacttaggaaatagccctttcttatctctcatataatggtacctgtctctcaggaagctaggcctcccttgcagtggtaatagctggcctgtggagccccttcacattgcattacggcaattccagtgcctccctttcccgttaggaatctaagcttgtactaccttttaaaatatcttcaagagtcaatatgtggatatctgagtgtcaaatctggcatgcactgtatttaagtatcacttaggaagaaaagcaaaaccctcagccccttgaaatgatttttaaattaactttttggtggaaaagtcccattttatctgtgcaacttaataccctttgtgcaattttagccaacttcttgaaaacacaggaggaaaacaacaactttcattatctcttttgctctgaatagcagcaatcatcaaaccaacatccaccaccttcttgttctcctgaacttacgtatttttgtatatgcaacaacttagggaaaaacataatggcaggaaagaaaaccttttcccctaagtaagaaaaatcacagaaaatcattagtgtgctaattaaggaacaaaaatcaaattgtgaaaggtttcttacccagattgaaatgaataggcctgggcttgttcccacagtggagacagggctcccggaagtatgctggaagcatgcaaggccacttgccgcctagactcagaaatgacacatcgtcacttccaccatgttccattgattaaagaaagccattcaggccagcccagattcaaagggtggaggaaacagaggttgcctataaaagaaggattttgaccatttttacaatttaccaaaggagtgacttggtcgaggatattaactaatttaaaggagttaatgtaggtgaagctcttagaatgcctagtgcatgacaattgttgttttgctattttttattattattactgtattctctctaggcgtttcccccaggagcttattgaacgtcctttaatcttttgttttgtttttaaaaatgatgttggaggaacaacggtgacttttcaggccctggaaatgctacatatgggatggtatcgtagaggtgtttctttgcctcccatgggcgcccccggttttgctctctccccctctaggtggcgctgtcggggatccccagctgtcccacgttgtcttgcttttcctttcctctctgtcaaaacgaattctcattcttgattcttaccactgcagtgtttaccaactttgagtgatatatttcccttttaaagaaaagcagtcttgtgaatttagttgttgttttatatttttattatgttacttaaatatgtacaaacataaagctatgtataaactaattatgcttgctcataacttttatgcatttataaaataaaggaaatgaaacttgaacagaacagatttaaaaattaaaacttcagaatttcaaaatagcagcattaacctaacatgacagatgatattatttttactaaaactacatccagacgcaaagccaccgtggcctttgatgcctcagttaccccacaccttctctgtttggactcctgcaagctcttcgaatacagtgtgctgtgaaattattatcaagttgattataaacacaaatatgagaactgaagttacctgacagtgcttggttataagatggctgtttaacttagtgctctcaaattttactgtgcaggtaactcaccagggatcttgttaaattgctcactttggtacagaggggcaggggtagggtacagaattctgtgttttaaataagctctcaggttatgcctgttggctgatctgggaatgacactttgagtacaaggatctgactatggttccatcatttgtttagattattaaacacacaaatatttaagaatcagtcgaaaacatgtttctggataggtccttggtctctagtctagtcactgcactaaaacatacaagcagttaggttgttagagcattatactagccctatgggaatcagatccagacaccaagcatgaagttgcatgtattgagtatcaggcatcagccagtaatatagggagggaatgatgattgtacaaagacctccctggacattccagatgcaactcacagatgatgactccttgaccagtgggacaggcctgatgtggttttgcctctaataaatcaaatctttccatttttacccaagtaaaattttatttgtactttccttatgatcaccactcacattttgcctggtcttacagtttaaaatgtggtacagctttctttttctatgttaatattctgagggcaaggatcatgttctattcctttttgtacttttcatacagcaggcatacagacatttgtggaattgaatgtattagctagataaatcttgagggtgccctctgctatttgcataaccaagtttttttctgaaaattccaggaattttgctctttctgttatatttcagactcgttattttatttactactgctgcttttttttcttcctaggaaagattcctaagatttaaatgactaaagcttagtctctgatatttgaacataaaccacatttttattgctcttggctctcaggtgcgctttgcttttaatttttatctgagaataaatgttgagaagattagaaacgcttatttagttgataatctgtgtgaccagaatttatcctttctaaatagttccatagcagtcttcgagagagaagttctggtagaagaggaggtagagtgagttgttctttaaaaaggaaatgcaagtttgtagagagatacccaggtgtgggctttatgcatgaaatatttttcctatgagaaaaaggaaaacagtgcctgaccttatcaataaaccattgtaagacgtcttcagcgtaggtcccaaggacattccaactgttcttttggactgagaaactctcaggtagtggttgggagaaaaagatccagaggtcgcagtgggatatttaacaaacatatgaatcagctgtatagcacatcagagaacagagagaccagacataaatgcataataaggcaatattctcatgatattgataagaactttttttctaagttctgttgatctgtctttctacccattcaatcattaatttaacattgtattgagaaattaaacacagactcaaactacacaaaataagcatagtttaatgcaaagattcccaaaatatggtctccagatcagcattgccttggaagttgtgaaaaaagcaaatgtttgcactccagtggagatttactaaatcagaaactatggaggtggggtgtttattttaacaggctcttccgaagcttcccatgcatgcttgagtttgagaaccagtggcttagcatgaactagtatgaggtggacactttgaaaccagcacctagctaaagaaatagacctgccagtcacttcagaagcccctccatgtgtcccttcccagccataattcctttctccttccaaattacccactctcttgagttttccagtaattactcccttgcctttttatagttgtgtcactgaattgcatatccctagccgcaatcatttagtcttttccatggatattaacttatctttcagtctatgcattcccccattgtcccctccttttccatacagtgtatctgatgaagaacttggactgttagacctgttggaggttctcagagtggattttgctggttgtgtactcatggtgcagtgtaacatgttcctctgaacttcctgagtatcagcagctggatataggggtttcatcaaatcttagtcctgtccttttgctaagactataggtgggactgcgttttttgtttttttcttttctttttttcatcaggaggcgcaggaagtctagttctcactgtattttgatgttaacagccatagatactcaatacttagatcgattgagagaagcataatggtgacagtctgtcatttcattttcatttattagctggaaagtcttagatggaataaatttagatcactatatggctaccttgtggtagatttcacacttgaaaagccggttgaatgctcagttttccttttatttacctaattttcaagatactgaattgcttccctgtcatgttcagaaggggaccaattaaagaaaaaaacaaaaaaaaaacatgaactactaggtttaaacgtagtggaagagtaatcaaaccgtagcaaatcatccctattgaagctcaaattgtcccatttttggccagtgggagcctcttcaacttggctcttgattccttttggtataactctagcactatttgattccttccttttttattacaggctcatcttgtgtatttcctgccccagaccaagagtcagccatttctctgagaatgcaccctgctcccccagttctttttgataggaaaaaaatgtcaaaaccacaaaccagattctcataactactgacttgattcttttttactgagtcttttcaatgggcaaaactgggaaatatccacttctatatctatatagctttttctatacctatacatagatgttatatgtatttaaatatatttaaagttaaaatacctcatgagtttatactgatatttccaattcaggactacagggttttaacgtcttctgtatggcatctatatcttctttttcctgcccaaacaatcttgattctcaaggacatagagtatgctagattagaatatgtcataattactcatttgcatgcttccacattacacacacaatattaatactaccaccaccaattatgattactaaaaagaattaaaacatttttgtgcatatgctattctcattttcctctattattttatagttatacctaatctgtttttatcaggtaatagttattaatgctatactctcttccatttaacccccatttaatgttcttagtttcatatatttgatggtcatcaccattttcacgtcaatgacatgacacttggttgtccaaagctcattctgtagtagtcgccttaggaagaagttatgggaacagaataccttgtgttcttacatgttgaaagaatgttttctctacttaatgttcatttttgcttggatataaaatccttggcttatattttctttcattgagtaccctagatacattagatcatatccttctggcataaaaccctgtcaaattctagtgataatccagtttttattttttcttacaagtcacattctctttttgcaagaagcccatagagattttttttctttaaagtcttgtcattttactagcatatgtcttgatgctgatagttatgggttgttattctcacataagtagtttctttttttgtatcttaggacagtttttcttgatttatagtttttaaaatttgttatgttttcttgttttactgtttctgccttctttagagactcctgttgtccttatgttgcatcttacttgtctgtcttcaaaatttatcaattcttgaaggcttcttatctttcttaagttcttttgatttttttaaaaaaatttaatttcccccttctacttttgaagttatttggttttattattcactcttaagtttcttctagttaagcctttttaagaacatttctaattcttttctaagctctgtcaccttatttctgaactttttctagttccaatttatattgttccttcatgtctagcgtgttttcttagtgtcttttggcaaatctggaaattgtatgttagaattgtgatctgattttggagccagttttcttggtgtgctttcattatctgtggaaatgttgttttattcgttttcctcttttatccttaagcaataatgtgtggaattttctctccatgcttttctgttgctcattttcctcacgttttagaaagagactttgttcagatggatttttctaacttcatagagctctgtcttctattgtttttatgtaattttttttaaaaaacttgctttgtaaatttttatgttgttttttccttttccactgttacctgaatcttctctttttttttctttctgttttgctcaattttatttttttcccagcagcttctctccagtgtggtaccttgttttgagagcaggtgctggctaattgtgtaacaatttgtgatttatccttacctatttgtatcttgatgtttgtgaggataccttgtctcccagttttgttgtaaatgtccattaatttttgaacattctgtttgatttcattgctctgtctttcgacatgtagggattctaggagttccaaaaactgtgtcactgctaccactgccatctcctcaggaattcctcagtttttcaaatgatgatttttgaaattttagagtctataacttgagagatatagcatttttggagctgggacaaaaaagtttttaacttaattatgggaagtaatgaaaagaattggcttctaaaatgcaatgcagagatgcataaatgtattctctttatcttgcccaattacagagcaaaatagatgacaatacagaaataaacatggtctggagtagaagtaggttaatccgcatgctttagattgacttacagtatatacactttatttcttcattcagtgaataaatttatatagtgccttacaatggacagatactgtacaacataaaaaatatgttgacccttgcctgtctggcctaccttgaaatgctgtgtataacaaaattacacacagaagacctcagatgtggcaaagtgaagtgagagggaagtgactttcccaataccacacagtactttgagaattagaccacaagcctggatatctgtaactcccaatccaagacttcttccaccccaatattcaatctcattactaagtgtcaagaaagtggatttgttaccaccaaaaaaagaaaactttctgacattgagtgtgtgctgttttttgaagaatgttgtgaattctctgttcttaaaaagtcagtagtgcagctttcaatgtagagttcttttgttcaggcttacacaactatcaccattcaccagataacttgctgtattccagacatcattggctgctttgtatacatattcttatttaaccctcaccacctggcaaagcattgtcctcatctctagtttacagaggaagagacttattttaactcagagtatgttgtccaaaattaccctgctaatagactggtgattctgtggaaacagacactttcttcttttatatgtaaagtgttctgggtaacaaataatacactctcttctcatcactgtgggcaccatggtctgggtgcctcattggcctctctatcccctcccaacacatacacagaagagaggagaggagagaagcatcctaaatgcttgactctctcggcagaaagtctactgtgtctaatggtcttgtaggagggaggcagcgacatctctctccctgccttcttcctttccattcccctctctactaaattagctccctgagcatcagagtgtaaatccagtttctcttacttgtgcaaacatggacattcttatgccactttgtgtgtaaaatttttacatgaagtctataacctgttgctttggtatgtaaggctgtagaatgagcaataacgaaaaccagaaatgtttgggggaaagaagtttttgtctgatcttctatattcattgacccagacaagtgtcacaaggaccatgagagtctggggagcctgggacattgcccacactctgctaatgaagaaactgaaccacacctacatctttgtctagtcacacctagcagcctctgaccttgctctccttgcctcactctgatccctctagaatccattgcacataccaaccaactcaggccctaaaactcttcttttgtgaggttactttccagtctttaacctattggctttttctcattgttcctcaaatcaaatctgaactccactgtctgcaagactctcccgttcttttcctgaccaccttggctgacagctcttggagaagagggcttagattgataataatctgtgatcctttccttccaccttgcctagctctgccagttcatggagtaacattttcttttccacagttactgtaaaaagaaatcgattctttttagctaaagtaaatgacatccaactctccttacatggaaaaaaggcactaaagtgctgacagataccatctcaggaatggatggatattcttgctgtttctcttccaggacaatcagaaacaaatttaactggtgaatggccattccatgtggaagggaagtggtaacatagggcactagattaacctagtgcacttctcagtaggattcatggtatttctatgtaatttccacttacaaattacacatctaatagaatcttaaatgggaagacaaggatgagtcatatgcccaatccacatttatgtcttcaaaatacgctttgaacaacaaagccacatatacatgttaaaaggcctagtaaacttctagaacactagaaaatcctgattgccaggatctgttagtcactccactccagacagggttttgacaaaatgccttttcccaacagaggttaccatcttcacaagaagaccacatttgtatatatgtggccagcagcattcgccagggtacgtacctcaaggaagcttcaaatggccattcagtgcgcactcaaaagggatcctcagaggagcattcagaccatttgcttaaatgattgtgtgctcattaaggtgggcagatctgcagtctcaactagagatctggtagttaatctgggtccaggatgtttcttaactaaacatgttaaaggagccggataggttgctctctactgccaatttatcggttttacttttctccttggctacagtgcaatttggctctttggtttaatccccttgagaagccagaatccattggcatgcggagctctgggtcttagagcaatatggctctaaaatgtacgaggtttattctgatggtccctgtcacattagcagatggtggcatttaccatgttgatgggagaggagtccttgtgctctcagccacagatggcccgggaggctgtcccagcagcagcacctcaccctctccaacacatgccatgtagttagttgttccctctctttgttcctataccacttacgtttgcatttctttcatgcagttcgttggtggtggttatagtcatctgttttgatgcgtgctccccatattaggctgctaaggttttaggggcaggtacctggcttctcctccagggattaagagatgcaacgctatgctcaaggtcacaaaggtgctgagtggcagcagggtaggattctaagcctcattcatcagtctccaaagttcaggcttttaattagaaggcctgtcatatcatagaaatcacaatggtcctcttagggcaaaataatgggtgtgaaatcgtggatggtccaacgataattacaataagaatcgtttatttgtttcttagaaactgaactaatcattttacaggcatcatttcagttagtcctcctaatagtcctatgcatgaggaatgtcatcaccattttcagatgagaaaattgagtgtcatagaggctaaatgacttgccaaccaggtcacacagctagtaagtagctccaagtctaacccagattgatgtgattccaaaaccctggtcttgggcatctgactgagaccccccaatgtatgggtgccttgctttatctaggctcagatcctggaggtcatttgttgttaccttgaatataagaaacacacagggggacaggcagactctgaaaatataaagttcattcccctgaatcaaatgcagaaaacagttctcttatgggttgtcccacttttcatttgaacttagtggggaccacgggaggggctgttgaaaatgaccagctctttcctctgccaggcttcctacacttacacacacacacacgcatgcacgcatgcatgcacacacatgcacacacacaccccacttcatgcttagacagtgataaagtgagtagctggggcaagccccccgacatgtggatgactatggtggtggtgatggtaggaatggtgccttatattagtgtaccttgtacgtttacacatatttatttgatctacctcaaggtaggtgaccaagtattatcagtccctttttcctcatgtaggaagaaactgagtgtcagagtaattgagatggagcagattcagactcaggactcctgtttcctgatggagtgcactttctgctaaagtaatagctttcaaactgtggtgggttgaggagccccagaagccatcataataagtgagggccaggggactcaaagacctacatcctgcttcaactggagcatctctgcttttatttgacgggtatagagggttctgcatgtggttttattttatagaagggtctgatgttctaacagtttgctactgctatgtaacaaaccactaccaaaagttagttaattattattgcccatgcctgtgtggcttggcagggctctgccagactgctctgctgcaggtggtggctgtggggcagctgggatggctctgttcctcaggcctgtcactctccttggacgggggatagatggtgcatgtcctgcacatctttcaggcttagacttggaactggtatactgtcacttccaaagcaagtcgcatggctgtgcccaaagtcaaggggtagggaagaacattgctcataatgaggctatggcaagggaatggacgcagagaggggtgaagaactggggacaataatgcaatctgcaagtccatgaaaaaattgtattatcactgctctgtttaaattaggctattaaagtccttcaagacttatttatccataaaatcaagaggaaatggctgttgtattgtaaaagacaaaggacttctacccagagataatcaggtctgaggactgttgcttctgaatggctgccagtttggattgtggtcagtgttctcatcttttcacagctttactcaggtagggtggatgtataagtgtgtgtgtcagacagagagagaggtgcaaaatagaagcacgcctctgtctatcagccttgtcagcttcgatccttgtttagtctgtgctttatcttctcccgtctgtcaatgatgtcccccaccatttactgcaggcgggtctatagatccagtctctcccctgccagtctctctttgtttgttgccctggtgtcactgcacctctgagctctaagtctttaccttctgaaagccattcctaggacaatcattaaaacctatggtagttgataatttctgaccctaggctggctaatttgccttcataaactgtcagattctgctaaggtcattgaatgctgtcatcttcataatgtggttcaagcaaaatggataagagaccaaacaaggagaaatctccctagaacacagtatgccagcattgctgtatctcaacaattaaaaaatggtgcgggagttacccagtagaatatttagtgaggtgtactctatgtggagttcataaatacaaatgcaaaatatttaatgcacagaatcagagttgcaaaataagatttaattctagaggattagggagacagaactgacttaaggctgtttttcccagtaagcttaattacttggatgacaatcattaaacattgcaagtcacctatcccaagtgatcgaagggcttttcaccaaatgtctgagtgagaaagtgattatcttatagaacaaacaagtatgataaagggaaacaatcagacaagtaattatgataaagaaaaacaagaaaaacggcacatccagcctgttttgtgggaagaatcacagaggcactatgtaagtacggctcctttatctaacagatcatttactaactatctggagtcaaagtcaagtttatctacatgctgaaatctatttccttctaataagattccatccacttggatctcagttatgtggcaatcttgacatggaacgtgtctcggaatatggaagggcatgagaaggcaccaaatcttcaaccctagcgctcgctcagggtttgattagagaagcagaatcacaggattattttacaggatttcttctctggatttgacttacgcagctgtgggctctaattaagcagacaatggaaagttgctgtgtctctctctgatgctgggacctgaggccagcagggtaggcagttgggaagggaaaatggacacgaagctggggaagcaaagacaaattagaacccatggggataagctggaatccatcaagatggactgaaacccacattggtctcttgctgcctttcaaggaacttccatgatggaggcgacttccaggagaagccgactgcccttctccatggaactcagcctgcatctgcccaggagtcagaggaggtgagggaggagatctgggaagggctggacaggcccatctgcttcctgccccctcagcctgctggtgagccagcagataacccacaaaagcctcaacagcccctggccccccatcaactttcaaaggcaccaatgcaaaagactatagctactgcttcagttccttcttccaaatgtcatatgaaatgcctcttaggggtctatactaacccagaactgtgcaggagagagaaatctgggaaacacagttccagcttagctaggttgacttgctataagtcaaccacacctagtctcactaagcccatttgtcatgtgtggcccactcagactgaaagaatctttgttggttcactgttttataagggccagcctttaccagtttgtccagctagggcactaagttcttagatgcagacatcagttctgtattccctgttaaggatctgcttccttaataggaatctttaaactcctgaatttgtaatgacacattcaaaagcattatttgagactaagcagtaatagtgtatggcaagctggacttacagtcctgtgtgatgtagagatacctaaacataaatgggcatggatattgtacacacatatgtgatgcaaataatatacaaatattgacataggatgatctagagttgataccagacagtcctcatcagtgcactgatgaaaccccagaagaaaagaggtttagccagcaagttaacccatgctgatgagcatctaccatgtggcaggtagcttctagaggtgcaggggatacaacagttaatggtacagtgtcagccgtgaggctcttacattgttttccaggttttctcaaccatgacatcattggcattttctgttgggtaattctctgttgtatgcatctgtcctgggcattttaggatgtttaacagtgttcctggcctttgcctactagatgctggtattcctccctctcttcatccccatccccgctgcagttgagatcataaaaaatgtcattaatcattgccaagtgtcacatggggcaaaatcatcctcagttgagaacctgtgtttcagaagagacagaaaaataccactgagatactttcagatgctaataggtgctcttaagaatataaagtaggctgggtgcagtggctcatgcctgtaaccctagcactttgggaggccgaggcaggcagatcacttgaggttaggagttcgaaaccagcctggccatcatggtgaaaccctgtctctactaaaaatacaaaaattaaccaggcttcatggtgggcacctgtcatcccagctacttgggaggctgaggcaggagaatcacttgaacctgggaggcggaggttgcagtgagctgagatcatgccactacactccagcctgggtgataaagcgagactccatctcaaaaaaaaaaaaaaaaaaaaaaaagagagtttaaagtagagtgatatggttacatgactaccaaggtggttgaggaagcccttgccgaggaagggcctttgatttgacatgcaggcagcccctcagagatctggggacaaaatgcatcaagcaaaatgaagagccagtgcccaggtcctggaggggaacaaatgtggcatgttgaaatagcaaaaaggctgggagacttgcagcatgggtgatatggtttgggtgtttgtcccctccaaatctcatattgaaatgtgattcccaacgttggaggtgggggctggtgggaggtgtttggatcatgagaggagatccctcatgaatgtcttggtgtcctccctgaggtcatgagttcacacagcatctggttgtttaaaagacctgggatctcccgttctctctcttgctccagctctccccatgtgatgcattggctcccccccacccttcacctttcaccatgattgtagcttcctgaggcctcaacagaagcagatattggcaccgtgctttgtgtacagcctgcagaactgtgagccaattaaacctcttttctttatagatgacccggtctcaggaattcctttataacaatgcaaaaggactaacacagcaggtgaggaagggaagagaggagggcatggggtagggaaggacagccacaacatgggggaccttgtgcatgggtcatggtgcacgatctacatttaactctggctactcagggcagtcatgggagagatgtgatcggggagtgatgcaatctgatttatgccttaaaaggaccacgctggctactatgtggtggatgcacaaacagctcttccccttctgcctcctttgccttgtgacccacaaggacccatgatacccacctgcagctggctgttgccatctattcggagttgtcaactaataacagacaatctcctctgccctgtgacccacagggacccatgatactcacctgcagctagctctttccatctatccaaagttatcaactaatagtagtctctgtgcctacaaatgattaaaattgggcttgaaaatatggcaccattatcatcagcatttcttgagcgctggccacttgtttctggtgctcgtgtgtgtacatgaacatccttgctgtgagtgctgggccccaccctcactgccatttaaaaaaaaaaacaacaaaaaacaggtgtctgcagcctctggtgaacatcagcttctccgtaaggctataatgggagacaccttcatagattttgagttcggctaaaataccctcctgtccagttactacctataatgctcttttcccttggatcagaaagccttttctctgtggattatttccctccatctataccccacattactaccccatgccttcataaggttttactctttactggcgttatgtccatttatatttgaattacacaagcatgaccattcatgctctttactcatagaagggcaccctgcccttcctggaaaaatgatttactttcatattggataccatttgaatatacccagctgtctgcgtggaaatagagaagtagacagaaagaagcctcctgctacagcctaggagcagaacagtaaacccaggtttccaaaatatctttctgaggtcattacagggtcatagccctggacagcactattcctaagtcatcctgaggcattctttgtgtgacaggcccaatggcatggcaatggatttcataatgaaaataatgaaacattgagataaaaagttaatttcttcctggaagagtctatttaataatgcaggaaaatgttacactttttagttatacttaattataaaatgctagaaaaataggagtggttttggtgttgaaagagttatttatctgagagaactatgaattatccagaatgcttctctaaagtttcctttttcccaaaattttattatttggcataatttcagtggaatcttccaaaagacattagtccattcttttgcttcagtgcatgtttttttggatagatattatctatttttgtgtagtgttgtaaggtttccaggatacgtaaaagttggaggatatatggttggtgcaaaataattccgtagagtaatgagattgaattgggggaggtggtttaaggaatacaaattcagtttgcctaaatagatgtaaaaaggaagggaaggaataacatctgaagctaaggaaggaaacttttgggctggagcatgactagataggagtcgggtagagctttttaacacagttgaagatagctgtggacgtagatcatgggcaaaactggtaatgtgaggatttaggaagcacgtttttaagctactgttgagtttcataggaaaccataccccactggtcataagagacattcaccaatagttttccatgggccttttgtgctagtggtagttttgttgggggcaggatttacaaaaatgaccatgcatttgaaaggtcaatgatgaaggtaagtttgagaatgaattttccatgaatgtcctgcaagttttattctttctgtgaacagcttgaattttcatttggtttgaagattaggaaaataacagtcatatatactcacagatcaaattcaagtactgattttagccatctatgagcaaaggccattcttggtgttagacatgaaacaaacgagagagaaagaaggaaagagagagagaaagatgtgatggactgccttggttctcataatttagaagtgagactataggtatatgcacaaggagctctgatgtgaaacatggatatcatatatgtcctaatggaaatgcacaaatatcctaatgggcttaggaagatttctagaaggatagggattccaatctggtttaaaagaaaagcctgaaaccttggcaaatgaagtcagcaaggatattccggtagcagaatgagcctgggcaaaggtgaggagtggagtgttgcctattttgttttgtgaggatgatagattcctgtaactggagctgcggaggaagtagatgtattggagattgtccttgaaagtatccagactgactcagacagcaattgtgaagttcttgctgatagatttgtactgtattttccatgcaatgcaagatccattagagggatttgagtaggagattgtcatggaatatttagaggatataattcagatttaaaccatggaatattttccttgatactattaaggaatgatagattctttgagctaaaaggagcactagagattatctattgaggtagtttccaaatattgttttagcacagtggaaaccttctttcaaatgacatcttacacaaatgccccagctacaaaacagatagaagagcagttcttgtggaatcatgatgggaagagtcttgatttgctgctttctgtttcttcattcctgtagcaatccctgaggtacctctgtagaaagcacaaaatcatggaacaacctgccgttttaaagatgagtaactcaaaagaaatgaaaacatattatgaaaccacacataccataacatcaccagcagccttattcataataactgaaaagcaggataccacccaaatgtttaacaggagaacggataaactgcgttgtgttcatacagtggaatagttctcagatgtgcaaagaacaacttactgattcatgcaatggcatacatgaatctcagaaatattaagtaaaagaagcatgacccttggatttcatttatatgatacacaagaacatgtaaaacgaatctagggggaaagaaattaggaagtgatggcctgggtggcagggaggagaactgattcaaaaggagcacaagagaactttctgggatgttggaaatcttctctatcttattttgcgggatggttacatttgtgtattccgttgtcaaaactcatcacgtggaacacctaaggtgtgtattttattgtatgttaattgtatcttaatgaataaaagttgagtttgaagattcttggagggagatttgctcagttcccatagctaggcatgagaaagactagcagctagaacttaggtttacaggattcctggtccagctcttttaaccgcatctctctccctcagagtcatcctcctcttcaccaacacagcatcaaggctggcttctccctccctggacatcctcttccctgctcaaaccccaccgtggctgtgaagtattaacttgacgacactgtgctctttgactcagcttttaaactttcctccagtgaaaccagaactggcaaacacagctacacttttcttgtaccatgctttacctgtattgccaacctgctgataaatggctccattccatagccttgagggtcttgaatagcttaaacattttatagttccatgggaatgagacaggggagaagacaccagtggcttccattgtaggcctgtctacactgaaggaatgccaactgcccacacacacttgttgttagatggcctggaggctcatctgcacagacgtgcagtttaactccattagggatcacagagtgatcacacactgtgctgtgctctttggtatatatatgaaaagcatcgctaagagaatgggagaggtggtgagagtttattgctgccttctttctcatggaagcattggacagcagggcagccctagtgaattgttgactgctccataagaatatcttgctcatttaacctcttctgtactaggtcttctgcctggagagtcctgggctacactgcccatccccagtatcccatgtattcatgtcagattcttgcagtctcctgaggatctttcaaggactggaactgcatcttcaccatctttgtgttcccagtgtctgcaacggtgccttattctagaaaagaacatcttaactgggagctgttttgccaggaccatcatcaaaaatgtctgaagatgtttttggttgtcaaaactggggacagggtgctactggcatctggtggataggggccagggatattgcttatcttcctacagtgtacaagacagttccccataacaaaaaattaccccacccaaaatgtcagtagtgccaagatcgagaagcccttctctagattatactttattgtatagaagataatagatcaaccacatcctcaaggctgggaccaatgctttgcattatgatgggtgtcttggtttcttttatttccactcttgattctctaagcatcatattcaagctctgagatgaggtgtatctgactgggtcaggtagccactgagcaaactggaataggcctttctgcagagtttgaacccaagtcaatgttgcctcgactcaagctcagatacctcatctaatcatcagtagccatagtaatagtagcccttagcacagaccactgatatctactgcttagaaggggtttgtgggggtagaaaatgaggttatattaagtttacttgcccaaagtcacacagccagtatgttttggagccagattcaaacccaggttgtctgaaggctccaaaagtcatcatttatcactgtatattttcttcttagctttcttgcatttcctttaatgttcccatctctccctagtgaaactgatttccctcaccaggaggttctctaggaattttggtccagggcttagattcttaaataagagcagggacatcaccatgtttgttatacgctgtcatttcacctcctctgttctgaatcagaatgaggccagcactctgggttctaagttatcgttttttttttttttttccattctatatactccctaagaatcttttttatgcttaaggtacaagtttaaatatggaaaaaaaaatctagattgaaatgaaaagccagacatttcctagttatatcactaattaactgtgttactagtgataagctgcttataaatctttcatcattaagataagattaccttctagatcttaacatttatgatcacagggataagttttttgttttgttttgtttgagacagagtctcactctaccacccaggctggagtgcagtgtcacaatctcagctcacttcaacctctgcctcctgggtttgagcgattctcatgcctcagcctcccaggtagctgggattataggtatgcaccaccacacctggctaattttgtattttttagtagagacacggttttgccatgctggccaggctggtctcgaattcctcctgcatcacctcccaaagtgctgggattacaggtgtgagtcacagtgtccagccaggatagttcctttttattgtaacatatccattttttcttcatttatacctccagtatccaacaagttaggatgcaggaattaagaaagaatcgtcctaaagtaggaaaggcaagatttgatgaagttggtagaaatcaagaagcacagttttgtaagctttgcttgggtgtggattgggaagctatttcttatttctccaagagtgtttagcttctcagacaatttctgcctcagtttccccatattttaatggggggaccaaacacagcatggtcatgcatgacatgtgaccgtaatgaaagtgtgactagcacattggaaacctggtgtggcagaaatcacacttagaatcaggtcaattaggagtcaccttagttttcttattgaaaattatgtgtaatgctgaaaaattaataagagagttccttaaaataacagactgaatttcgaagtttaggtgataattattttccgaagtctgacctgcccaagaccttatataagcacgttatggaaagcaagagtggtatatctttactaataaataagtatttctccaaactttgaaaaacattctgaagcttcaggttaaaaatatgtaaatggaaatgccctccacttgactgtatcacagctgttccctgtccctcatttgctgaaggactgagtacaccccaaactggtcagagcatgatgactttcagtaatgacctaaatgaccttaaaatatcagtaagtgacagagtattcgaagtcacagtctataacattcgcttagaatttccccttaagctgctggctgaagcactaattaagatctgaaatggaaggtaggtgacagatgctttgtgtcctgcagcagaggcacagaatgctgttctttcacttactgtttaataataataataacagccatttaatctgtttgctgatacagtctcctttgctttattatgttgtttattttgtgtgagctttcgatattagttataaaaatgtcactgtgtctgcagctgcatttttcattttagaaactcccagagatctcatcaatttaacctgccttgtacagttcgcaggaaaccactacaggcaaagataggcttaatcaaggttttttcttaataacgaacacaatacacaggaaagcagggcaacgaatgagcctttgattctaggtaaagacttattatgtgaaaatctatatttaaattaggggctttttgctaggattcttaactgcacaagacaaattactgtaggatgtctctaaacagcaagtgtgtcttaggcatttgaaatataatttaatctattaacagtttaccctagattttaagccattcattgttggcgaacacaatctagattctttaaaataaaaatagaaaagcatttgcagtaactggccattattatagctatagaaatcaaaggtatttcttgtataaattttgaattatatattgtttatctctccttaataactttcactatagaaagagctctctttcttgctcaatttacataaaagtatctggaacagttcagtgacaacagtgttggaaattaaggactgacttgagactgaagctccctccataactcccatgcccttctccagtactaagtagtataaaggccaaaagtcagataaacaacataagagaaggtggcagtgctagagatggggatgaggctgtttcatataatggaaggacaccagttgacattttccaaagattttccattataatcttttgcaaaggttctctttcactagttaacaaatataaaagatgccaactcccaccagactccagatgcttgtaatagaattagaaggccctccaacctttctttccaggggtcctgagggggacgtctttgttggcaccccaagcctgagtcactcctagcacctcaggaaagcatgtgttgtgtggcttcaaggataggcatcctaggagattttaccacctatccaggtgccctggctgggtgaaaactgtgcatcttatgcttcctcaatagtgctgtgagaatgctccactgccagtttgaggtatcaggtttgggttttcaggattgcaagactgctgtgctgtgcgtgtactggtgagttggctccctgcctttcccagcacccccatgcctccttcttcacatcccctttcaagtagaatagggaactgataacccaaccaggccccttattcccatcagatagcaagctaatcactgagacaacaagctttgcagtagagaaaagattttattcaccaggcagccaagcaaggagacaggagaatagatctcaaatctgcctcctcaaagatgaggtttaggaatatttatggaataaagaagcagtgtggtctattgtggggggaaaggtgattggaggtgggggaaaggtgattggaggtaagaaaaagggaggtaattggtgatctgcacagacatagtcaaaattcatggctcttcataggatgtatgttcatgaaatggcattgttagcatgatctgagggtggagtttttgtcctctgatgtcaaaagtcaaccaacagacattcatacaggcctagttgatgggttggtggtctcagccagtttgaactgggtaagaactgacctcaagttcctataaaacaatgtaagcaactgttaccatgatgacctatacattagagatgttacctatgaggaagctagtgagagtttagatacttttaggtatataggttttaagatcaactagaagtaagcaactaaaagcaagtgaggcaggttaagtttgtcaggcctaatcaggttagccctcgctttcagagtcatctgcccaagtacagtaaacagatccagctactacttagatactttgagaagtttagggttgggctctttcttcttagctttccccttcatagaggaaagtccacatttacttcacatgctaacttgtttgctgttagtagaaatctgcgggaagtttgccagagaagggtagcctttggggattggccaaccagctagcagggacctctgctgtgagtggcccatgctgtctgggcagctctgttaggtaaaggagaaagccatttggcttgtgtagactgcagctctgcaggaacctctccccaccatctctagccaccacctccagagtacagtaaattgtagacttagatttgctgtttccagcatagatgtcttacactttctagagggttccctctgctcacatagagccgttggttaagtggtggtgctcattttccatgccctgctggctagtccttggacattgtgagcatttttgtctccaatgccactgaattccttaaggccttttgggtgggtgctaaatatttaggcaactcttactaagaaaatagaaaacacttgagttctctgttttgcatgtggctatctttacatcagagccttggaagtggtcaactgtatgtagccaatttcatgaggctgttttaactgggaggacattgtcacctggctgggcttatacagctgagtcaataaggaaaacgcagcttttgttggcttgcttaccttttaaatcagtaagtaatgcacaaaatgggtccctcaccaccactacttcctttaaacctcatccccaactccacatcccatcatcatctctcatctcatctcgcagctttagctgatcccatggtggggaactggggaggcatgaggttgggggtatatgtgtgtatcatatattacttgggagaaaaaaaattgttttaggttttattacaaagcacccaagttaaaagagcagtgttaaaattgtcttatcaaaatatcccgtaccattgcattttcctgtttaaagagactgccataaactctaggggctacccaagtgaggagacgagattatgattaacaatcaaagtgatggggaaagttataaaaataggaaaaaaatatttagatataaagtcactgacctatgaaaccaccttgcaaatggtaggcaaaagaagtagtattactgaaaaagtatgaattgttacctttactctgaaattagtatgtaaaggagcactttgtttactgcactaaatctttgtctccagtttttaaattatgagatttatattgcctaagtatagactgaatacattttaatatttaattgttttttctcaaactatggtttgaaaaacaagataattcttaagctgggtttcattactttgaaaactaacagtgttttctaagagaacacgttactgatttaaaaatgtaaagtaataaaaatagtattcacataaagtttcagtagagttttagcacagaacacaattaaccagggcttaaaaaaaaccatttaattttgaggcaattgtagttatttcttgcagttgcaagaaataacacagagttctagcgttagcatttaccctgttccctcaatggtactatcttgtaaagctatagtacaatatcccaaccagaatattgacattttatagttaagatacaggacagttccattaacacaaagatcctctgttacccctttataactacaacccctcattcccatccctgacccctggcaactcctaatttgttctctgtttctataacttatcacttaaagaatgccacataaatgggatcatataatatgtaacctttgagatttttttttccctcagcataattgcccaagattcatccaagttgttgcacgtatcaagggcttgttcctttttattactgagtagcgttctgtggtatggatagaccacagtttaaacatttgaatgacatctgtgctgtttccaaatttttgcttattataaaaaagcaagcaggacttttaaaaaacacacttatagaaatgcttatggctgtgtcttattacagaatatttataaggagagtaagattaaagagttagagtcacttaggattaaaacaaatgttataaactatgacagtccagctcaaagtagcttgatttcataaatatattctctttatggtatttcataaatgccataaatcaaagtagcttgatttcataaatgtattctcttttgattaaataatcaaacttaagtaaattattggccagtgtccacaatagaatttgtaaatagttacattgtgttcatgtttgcatttctgttctcaacctgaatgactgctcaatatagtacactatattcacttttattaagcactgctctcacatctcattgtgtttgttgaacctggaaatgtgatagcatttgattgtgttgattttttttttttagctgccaagacgaattgttagatgtttttaaaacattatatacccttatgcccttggtgtctctgatgaagcagattcattaaataaacactcacttatgaatagcagagccagcacagtcatagtggatgaagtttataggttattgacggacggtaggaaatcagttgaaagatgcccggaaacatgtggttatgttggtaggaagtagaaaacgcctgcctggagtccttcagatcccacaacgtatgcgtgtgcatcttctcaggctccgtattagccctggtacgcacagagacacacagcgaccagcctattagttgcctggcagatgccgtcagtactggtcattttgtgaatgcttttaatatgattcacagaatgtctgtagtcagtcacgttttagcactgacagtaaaatgtcacctcttcagcagttttcttttaaaaaaggtgtaaagcctcttaaaaatttttgctttaaactcctatcgatcgtttagaaatcttattagcttgctttgggctttcttttagagttggagaaattaaaatttagagaccaggttgggctgagaaaactgcgtggagaaggggaacttgagttgaatcttacttacaccagacagtagggacactaaagaaggcaatactgctggaagataaaagttgacagctttatgaaagaaggaaacaagtgaatgagataattcggctgagagctcccggaaagcaagaattctttttcatctgtgccctcagtccctagttggagtacagcccaaagtaaggttcaataaatatttgtttaatgaataaacaaatggatgaacaaactgaaataagtgttgatatttgttatgaaatatgcctttctcagactgttccacacacctcaccctggctgtgccaagtttctatggctgcacaacaaactactccaacacttagtggcttataacagcagatggaggttcacaggcttccactggacagttctccttgacatctgttctgcagtcagaaggcaactggaactgaggtttccggtggctccgcttgactacagggatgttgggctgtctccttctcagggcctctgctctttgtgtggcttttccagcagagccgctgaacttctaacatagtgtggctcagggcttccaaaaagcacaaagggagaagcttccaggcctcccaaaggctaagacctggaactgtcactgtgttgctccctcttttagttaagcagacaagggggccagaccagattcaaagggagggaaaagaaaccccacctcatgatgaggcaccactgttttcccatcgataactggtatcaacccagcatcctacagctcaattcagttctgacactcaccatcccgacttagtacagaccctacaggttaagggctcagtccccttagactgcccccacttcagatgccagctgaaagtggaatatgcccaagttacccacacttcttcctggctgactacaaatgtgggggttgggagaacccccaggtttggcaattcactagaatgactcacagaactaaggaaagtgctatacttacaattacagtttattataaatgatacaattgaacaaccagctgagaatttatgtagggtgagggccagaagggtcttgagtgcaggaacttctgtccccatgaatgggacatatcactgtcctggtacatcatattttcaccaaccagaaagttcctgaaccccattgttcaagagtgaacaatgcaggcttcattgcacaggcatgattgaggaaataattggccattgatggttaactcaatctccagtccctgtcatttccccagaggtcagggacaaggttgaaagttcctctaattatgtatccatgtggctggcaccttcctggaaactatctaagggcacaccttgagtcaccttgatagcataaagatacagctcaaaggggttcattatgaacaacaaaagatgttcctgtcactcaggaatttcaaatggtttttgaagctctgtgcctcgggaactagggacaaagacaaaatagattttgctgttctatcacagggttgatgacaaagaatgtgtggccatctttaatctgtgacactggtcctctgcagactcaagcaaaatagatgaaattttacaaaggactgttttcctatcatttgcttagaaaattaccctacatgtttatcccactttcccctagagcaggtttctggaaagctaatgctatgtcttacgtatacataaacggatgaatgagacaaagtttgttgcattggtatgtgtgttggggggataggagggtgatgggagagcctcctggaatagtcttagagttggacactgtttccccttgtgactccttttgcagctactgccttgatcccctcttgtgcctgctaggctctgccttggggaaagctcaactcttctgtttccctacacttgaccgactgtctccatcgttgccttgcccatcttgtgttgtgtccacccaaacctgactcagatctactagttttcatctttcgctcacggactattctcttgagccagattcctagtcccctaactcaatcatcttattctggcttctccagtgttctttcaacccaatcttgctaaaaagctattttaatgcccgactgtggatttttggcatcgttatctcagcaggcctagcttggaggttcctctgggatttcctgctggagtcttctttttaggatttcccagtctacttgggatacttaaggaaaattatcaccttgtcttaggaagaatcttattatctcaaatcaaatatttaaaattgcaatgctcccttatctggaattttattttgtaagggacattttctgataagctgccaatgacagcctatgatatgaaattctgtatgtccctttgggttcaacagtaaccttaatgggatagttttgtctccctgtctcacctcaggtaacagaaattgtcaagtgcaaagaaacttttgtatccttcccacatccagagctagcttggagtttgaccttaggcaacaaccaactaactgtgccttgaagataactctctggggagttaattaggatagactgaataattcaaggggcagttttggtgaattaaattgggaaaagattttcgagtgttaaaggttgaagcattcccttcctattatttcagctcttacctctactttctcaatatacattaaagaaaagcaaatctgttcaatagatttgagataatctattaatttagaatgcttactagaagcccaccatggggctaggctccacaaagtttgaattgtggttatactgtcggttgttttttaaaaatgtacagcaaaatcctaggcgatcttcatgaactactccagaggccaccatcctagaaatctaaactcagctctcctttaagattagtcattttcttatccaaacaccacagagctttttacatagctttattacagtgcttcagatattgtcttgtaattatttgtttctcaacctgtcttacctattggacctgattaatttagaggtgggaggctgctggcttcatttccttatccaatcatttaaattaagcatctgacaggtaccaggcactatatttggttctagtgttccaaaggaagtagacaatcctcattttgtatgtattcttcttcttcttcttttttttttttttttaggtggagtctcactctgttgcccaggctggagcgcagtgacatgatctcggctcactgaaacctccacctcctgggttcaggtgattctccttgaactcggcctcccacgtagctgggactacaggcatacgccaccatgcccggctagcttttctatttttagtagagacagggtttcaccatgttggccaggccagtctcaaactcctgacctcaagtgatccacccaccttggcctcccaaagtgctgggattacacacatgagccaccacgcctggccccattttatatacatgctgtatgtttgttgcatgtgtcaatcattttgaagttgcatttccacttcacacactctttttttttaaacggataattaggaaattcagccattttgaagttacttgactctggttatggttgttttctaagctctgttaacacacctggtcaaaagtttggaagtcagacatgttttgtttgtcgtttttttttttttttctctgtcagacatggcctgcaccataagcttctgaaaaactctttgaggccagagacttggcttcattgatcttagtatctttggcaatgttttgttcgtagggaagattcagtaaaaggacatttggcatcagactaaaggaaatgtgttccattagatgtttaaatcacggtggtttattttcaaagccatagttttgtagtgtttctttacaacgtgattgaatttaaatgcactgggatgacttcctccaagaagaaggaaactggggggccgagaagatgtggcaaaagcagaaacatgtccatctctcattgggtagggacatcattcatttatttgttcccgtatcattttgcagattccttttcaacctgtacactggctgtctttctctcatccccaagtttcaagatctctggtggtatttcttttccatatcctttacctaccttgccttgctcctccacattcccaattccttcaatttttttttcctctctaatctgctgttttatggatgtcaagatatactctagttactcagctcttaccttagaattgagacttcagagtttcccactaagttccctttgcgatacacaggaaagggaacattaagaggagcacactgagactttaagcaggaaaatcggtaaacgctgaccatactgaacaattaagtctactattacttactggttttcttcttcagagcataaaccgggcttccctttccccagacttggctactgtcccctggcttgcaataacccctggctcctcaaaactctatgccttatacatatgcctttccaagtactcttgccatttggaggatgggaagatactatgtcagagaatcccaggatctgattggatggatataattgtgactgcctcttcctccactgtcaggtaagtctctgaatgtgcctggctgctctgctttctctgagtgccttctgccatgagccaagcttttctgtcaccataagcaatccactcatctcttcaagcagggacacgcatctacgtgattggtggccagatcaaatttctgccttctagaaggcatctttcatatccagtctttcacccttaccagtaatgttatggtctagacttcattgacatggttcctccatggaagatcataatactgtttcccaacccagacatagcatctttctcaacacagaactctaggcaactgctttcattgattggagttgtcattcaaattcaaaatgaagcctacttggcatccctagcagctagtcttctcttgcctagatcattcctcttcatttatttctagccacttgcctcaaccccctcgagtttaaccattgccagttttgattggaaaacctatttattgaacatctctggtgatttttctgctgtacccagttacctctgaatgtgttgcccatctctggaagaagaggtattcctatatacacaccccacattcactgagggcttctctgtggttagttcataactctctttcatatgtggtagccaatgctccattaattaggaatgatgttgaccattctttcttctaaagtctgcacatattccttctggagttgtctgtcatgatagtgtcacacttcaacaatgttgaggctcctggtaaattctacagaaacatttccattttcctttgttttatgtacagaaatatagttattaattaggtccttgggcacaaaaatggaggcaggcatgtgccatttaacatgtgtgttagggttctccagagaaacagagctaataggagagagaaagagagatagacagataagaggagacttattatgggaattggctcatgtgatgatgaaagctgagaaactccataatctgcagtctgcaagctggagaaccagaagagctggtggtttaactcagtctgaaggcctgagaaccaggggagttgatggtgtaactaactcccaagaaccaggagctccaatatcccaggggaggaggaggtggatgtccttgctcaagaagagagagagtgaattccccctttccccatctttttgtcatattcaccttttcattgtattcaggcaggccctcaacagattgggtggtgtccgcccacattggtgagggcagatgtacttgactcagtctaccaattcaaatgccagtttcttctgaatacaccctgaaagactcatccagaaataaagttttaatagacatttgggtatcccttaacccagttcaactgacacataaaattaaccatcacaatatgcttcacatatgtttttaaaatagcttaattttttgtctataagtcttgtacatgggtagtggttgagttagtatcttatcccttgagtttgccaaccccttggatagggtcagtgtcttgggttctctgaatggcatttaacacatggtcacaaaaaccttggtctgaagaactttataatgataaagttcaaggtactttggtgtcttgaggaactccctggactgtgaggcagagactcgcttggctctagtcctggtgctggatctaactggctgccattgtggggctcccctaaagataaaggaactcagtttcctcatctgtgaaatgtgaggatggaattcatcaccatgtcccctcccagctctaaacttctctgagtcttgtttttccctgctctgtatcctccactttctggcatgttttttatatttactattataaatgtgtccctattttataagttgttacagcacgagagagaggtaaggaatagttaacaaaattgtattctgagtagcctaatattcttttttttttcctgctaaacttctttttcctcaccttctcctaacatttttgtgggggtgggtggactggtgggtgactgtagtgatattgatattcagagaggagtgaaaaatgcaaaattgcaaggttaacaacagatggttatatggtgccattttaggagtgttattaaaagaacaaatctattttcctgaatagtaggatgtcttaagtgtttaggcttaaatctactgttgaaatagaaaaagaggaggaagaggaggaggagaggaggaggggaaggaggaggagggggaggaaaagtcaaggaaacacttagaacatttttgcatgatctcaattttcttcttgttccaaggtttttaatttggacagtggtatgtgcttcagattgaatgcaaggaaatttgttgcaccatttgcctgacagttatcattttccttgacgaaaagtttttctgaatcttgctttgctggagctacctcttcccttgccctgaataacctcacttgcttaagtcatcgatgcagtggactgacaccacctttctcttaaggaattaccctgttctctgggtaggtctaatttacactcccactatcacccaaagaagagacactctctatattgataactagaaagaaggaactgagactgttgtccaaggacatcttatctttagcatagagcgaatatgtggtttatggtaggtgttcaacaaacttaaaaaaaaaaacttgtattagtctgctctcatgctgctgaataaagacatatcgaagactgggtaatttaaaaggaaagaggtttaatggattcacagttccacatggctggggaggcctcacagtcatgacagaaggcaaaagtcacgtcttatatggcagcaggcaagagagaatgagagccaagtaaaaggagaaaccccttataaaaccgtaagatttcacgagacttactcatttccatgagaacagtattggggaaatcactccccatgactcagttacctcccactgggtccctcccacaagacgtgggaattatgagagctacaattcaagatgagatttgggtagggacacagccaaaccatatcaaaacttaatcaaaaataattgaaatgtcaggaaatagagaaacttattgagcttttttagggaagtggtctttgaacctgttttgctctgcccactggagtatgctgtccatcaaattgttagttcagtgaattatggtacaaacactcagttacattaatatgactattttcttgtatgctaatttgagaacctactccctggagatatgttatcccatgtaatttccaagtgaaatggagagaggatgccttagactgttacttctcatgtttttcattccaatcttcctcagtgcccctctctataatcccaatcctatacatttttaaacaaaggaaagccactcagatcacagtagctcatggacattggtgagaaacgtgaggaaatgtagaggatccccaaattctcacacataaactaaggtgcagccactgggtatcaagcaaggtttcctcactggtttaatgactccagttttccacattgacatttgtgctgggagccttacatatatgattttgtaaaaccctttctgcagcccttcatggtaggtagcagaatatttaaccctattgtaagagacaggagaaaccaaactgctttttctattctcacccgccattctacacagttctccagcagaatcccactggatgtcctatagtttggcccggttctaacactgtctacctggagatagcctcagatctcacaggtaaagggctcagccccacaagactgcccttcacttaaaatgccaatcgcaagtcccagattgtggtctgtacttctgagcaactggccataaattgggggttcccccaggccctttgtcatgtttgattaatttgctagagtggctcacagaactcagggaaatgctttacttgctactgcccatttatcacaaaggattttttaaagatacaagtggacagccagatgaagagatagatgcatagaacatggtttggaagcatcctgagtgcaggagcttctgtccccatggaattggggaacactaccctttgggcacatggatgacatgcatgtgtttttgttcacaaactgagaagctctctgaacccagtccttttgggtttttatggaggcttcatcacataggcacaattgtttaaatcatttacataaatatgattgatcaactcttccctctcagatgttgaaggtgggactgagagtcccagccctctaatcatatggttggttcccctggcaaccaacccccatcctgaggctatccaggagcccccagccacaagtcaccctaatactatacaaaaggacgcttattttggagattccaagggttttaggagttgtgtgccagggatgaagaccaaatatatcttattataaatcacaatatcacacctattataaagcactacatataaagtttacactccaagaataaaagatacaaatatggaatcttcaaatgccaagggcctactggatactgtgaatgacaatataagctacatcacctgttattgaaaaccagaatgcaagtgtaaacttgaccagggaacctgcggagatggagaagtttgacacctctccagcagcatcatagaaatgaacatcatgagcgcattgagggggagggttaatgtcttcatcgttcttcctctggtagaattatatttgcatccttcctggtggaaacttgatacttcactgtagtgcacctgtacctgtttttttttttttttttttttttttactttcttggagggagagttcttctatctcagaagatagaagaaatagctggaaactctatattcctgtgccctagcacaggagaccaggggtctccaactggtctgtggccttttaggaactggaccacacagcaggaggtgagcagtgggcgagtaagcaaagcttcatctgtatttacagtgactccccatcactcatatttccacctgagttctgcgtcctatcagatcagcagcagcattagattctcattggagcacaagccctgttgtgaactgcatatgtgaggaatctaggatgtgtgctccttatgagaatctaatgcctgatgatctgtcactgtctcccatcacccccagatgggactgtctacagatgggactgtctagttgcagaaaaacaagctcagggctaccaccgatttgatactatggtgagtatgtaatgataataaagcgtacaataaatgtaatgtatttgaatcagcccaaagtcacccccaccgacccacccagtccatggaaaaattgtcttccatgaaaccagtccctgctgccaaaaaagttggggactgttgccctagcaggtagagcaagggtatttcacttaggcttgaccaatcgaatgccttcattctggattttggatctgggagaagtcttgcagagacgaagcaacatttgagaagggttttaaggctagtttgagtttagtgtgctggtcctggctgccatgcattgagcagatagttcctgtggtaagacctgctgcccaagccacccttggtttctgcctagttttctaacacttctgtcaattctccattcttgaatagtcttctaatataggccttttctgctttaggtagccagacagaactgttccttgcaaccagtgactgtctaattcagtcacttaatgttttgtagctttgttcagttactgggcacaacccactttctgctcaggcggcttggagacagccatgggccatatgaatcgctattattttaactttcatagtaagaacttgctccatgtgggaaagcataattattttggtttctgagtttaataagcagaaagcaaagaagaaaaaaaatactgtttgcactgagcattaaaatataaggaagtaaagttgtttatagatagagtttcagctaagcaccaaaggtttatttatattttttgccatttatattttctgcctagttctgcctaggaaccagggaaatccatggcaaggagaaaataaagcatcaaagaggatgaaaatgttgaataaagtattagaacccagaacacttaaatctttaacatccatagtaagagtccttcacattactcaggcagactttttttttttccacctcttggtattctgtgcctacacttgcatgtttaaataacgatttaaaaatcacatgagaaatgatcaggctttctttttcccacttgactctcagttatttcaattctttgagacttgttaaagaaaccgtttagtgttgtaaatgccaccaagtctctacctagtagagattagaaatcctctcaccaattccaagttaaaaaggtcctgacatattttgatggaattggcccatgttctcatttaccagtgaccagctcatctccatgctatgatgctccccaggaaatgtgcatggtttttgtagaaggtggcgagaagcttcatgggcaccagcatccacaacccacttcttgaaaaacaaaatcagatttatatttagctgaccacctggcaagatctcctgtaggaagagaaggaactatacccctattactatttcagcttttattcacaaagtctttatatttgaaaaatgctttataatcattttaattagtggtttctcaccaaagccctggatgtggtattattggcaccattttctgagaagaccgtgtgccattgagatggaattgacacaagatgttaatgggttagaagctggtactagaatcagaatgataggccataggactcagcaagccatgctatttactgtcatcttagagggctaggtagggtggagggaaggagttgatgactgattgttataagtgaaaagggcagcagtgacccaaaacaccattgcaaatgttaacagaggcctgttacagagttaaagctgggttttccaaaacaacacatctgagtaaaagcgcccttggtacattagccagtatggagccagcacctgagatcacactgtgtttgcccctttctgcaatggctattggtgctggttgcttgtcttggcctaagagttttcagctgggcttttgagcaagctgcatcttgaatctgaggatgcgggcaagccaggcacagaactgtgagggtccttgcaatgggctgctggtgttcctgtcattcataagcttggacttggtccccactgtgtttgatttgggagaggttctttgaccatacaactcttaccgtgtaaatgtgctacaatccttgtcaagacatagcaaactatatttgaacattgttttaccatttactgttgtgtgcatgtgggccatattttcctagtcagatggtgagttctgtgagggcaaaggctgagtcattctctatttacattttaagtaggcatccagagacttggttatattctgagtctgtattattgatcaaagccctcacctggagtttctggggccattcactgacccagaatctggtgacattgacacagggagggaataacatccagctacagatggttaacacaggtctttagtgccccaatccccattttgctgactcatctatgcctcaagaactccaatcttcatgcagattctgttgcccttgagtactcagttctgtctcttctgcatacctctgtggagccttggatcctgtcagactcttcgtgttgctgaagttctcagtcctctctctcagccgagtgtaatagtgccccagtgggcactgtagggacagaactgagtttcttcttttcttttaggagttgattctctccgggtaatatctggagctctctaaagtttcagagagaaatacgttccttataaaccttgtggttgtcatgctggtgactccttgagcctgtcctgtgctggaccgtgaggaaggacacaaggccatccagactcctggactcacagtgatttcttgtcctccccaaagatgcctttgcctggtgcactctttaatagcccatcacttcttgctggctgtgtccccagctgagttcctccaggatatggcatcaactctgaacacatctctgtatattccctcttaggaccataagattcatgttaaacttagtgccagaaataaccttgggtagccatgttccttatggttccttagattacattcctagattacacattttacattaaaaaaaaaaaaacaaaacccaaagcacctagaaccgtgctggattcttgataaatgcttgtatccattaaatacatattgaagtaacttctactccagtgacccctctcttgaggcttactgtttacctcctcactttggggagctacccagccaggaccttctgagagagaaaagtggtatatttagtagtcaccagatagttactgttaacggtgctgagttcttaaaaaaacctgttaattgtactagcttaagactaaagtatatgttcctctcctcgtagagtgatgatgatggttttataaatactggttggatagcactgtaattaatgggcacaccagcttttattttggtaacaatgtattcttataccacatttaagaggtttctctttcctgtggtcataaagtgattaaaaaaaaaaaagagaggagagagatgacatcctttttaataaggcatcccaagcagtctaagtacctatgaattataaatgaaaacttttcagtgattaaaataaatataccaatgcagtccccttctctgcgtcattgcttcgccaggcctgcatgaaaatcactcagaggaagtcccaaggggccctgagatcatttgcatctgttccatgtgtttctctgatttatatcagagtgcatcaagggcagtggccttccagctggtttgggaagagggattcttttatccagaggaggcatcagctgatggtcagttagggctctggagtgcagctccatgtaaacaactagcctttgtagtaatggccatataatataacctagtccatgttttgttccctcaagaaccaatttacaacatttaatgttcaaggatggttccattcctttctttgtttacacaggtgaggctttatttagtagtgggaagtgaagggcagatggtttaaggggttcttaatgctgcaggagaggcccataaactgaagtatccaagaaaatccattctaaataagaggcaaacagagtctcagatggatataaattagtattattcttaggaatccttccttcccatttctcagacttatagcaaagctcttactgatatcagtggccattgtgcaagtgggtagcagggaaatcaccctcaatgaccaaatggaagtacatgaggaaaaagatggagaatcctggataaagaagacaactggctgggctccatggctcacatctataatcccagcgctttgggaggctgatgcgggtggatcacttgatgttaggtgtttgagaccagcctgaccaacatgacaaaaccccatctctactaaaaataaaatacgtaaattagtcaggcgtggtggtgggcgtctgtaatcccagctgctcgggaggctgatgcaggagaatcgcttgaacccaagaggcagaggttgcagtgagccaagattgcaccactgcactccagcctgggcaacagagtgagactccatctcaaaaaaaaacacaaaaaactgtctttttctagccctatttatttcaccctacactccatttaccttttatttgttgttaattaaataacattaatttttgttgtaggattatacgtaagaaactattggccttttgctgattgtgctggaatttaaaagttgtagggattgtgggccattgttctaaaatggctcattttgccaaacatgattaatggcttttggggtgcagtttatgtcaaggcaaaattagtggacacttcagcaaactggaatgtggttctgagctaaggggatattcacttagccattcctagacctttcttctatcagaacacgtctttaaggttgaatatccaacattttcaaacattttagtcttaaattctacctttagagtattattgatggtctgattagataatgaaataaattttctctcagcaatgtctgtaataaaacataatgcaggaaagatagcatttaataaaatatttgtttaatgttaataatatttattaccatcagattagaatcaagttaacatcaaattagtaagagatatgtcagtcacaggacttgtagggatgcgagaaaaagaccaccagagaaactgaagaaacaactggaatcatctttgaagaatttcaaactcatcattgagacattggcgagactgggaaaattatttctgaatcttgaaagaatgatgccccaagaccagatcatttaaccattatgtgtctggagagccatcatgcttcctggtatatttactgtggaaaaccctgactctcaaaaattaaaggaaaattacaactgtaataaattggcctgaattgcatggattcataagaccactctctttccatttcttcctacttaatgttgttttcacatagtgatcacttagcagagtttgggaataataactggcaaaaaagctaaaattcttagtccctaaaggaaaagtttgcaaacttattatttaatgttttaaaacccctttcccccgatgaatgttaccctgtccctaggagaagcttctctttcatgagttcatagatcaacagtggaaagatgattgtatttttgagccttgaggttcaactttttctcttctaagtcttttattctgcaagagcccttttgaatgatttaaaatggcattctccatttattcgtatttatcgaaaatctatttggagcaaggtattacatttaaagacagagaagaaatggttcatccactcagctaatatttattgtgtgtacactatgtagctacaagctgggaacagagtggagagcaaaagaagacaccattcctgctcttctacagttgagtctggtagaggagacattcatgattcattttttttttttttttgaagcggtataaccacccagtgggttcacattgcctgctgccttcacagagccaatgtatcgagacaggggaattgcagtgaagaaagagtaattcacacagagccagctgtgcaggaatgagagttttattattactgaaatcagtctcctgaagcattcagggatcagagtttttaaagataatttggcaggtaggggctcaggaagcgaggagtgatgattggtcaggttggagatggaatcatagaggggtcgaagtgagtttttcttgctgtctatgttcctgggtggaatggcagaattggttgagccacattactggtctgggtggtgtcagctgatccatggagtgcagagtctgcaaaatatctcaagaactgatgttaggttttacaatagtgatgttatccccaggagcaatttggggaggttcagactcttggagccagaggctgcatgacccctaaactgtaatttctaatcttgtagctaatttgttagtactgcaaaggcagactggtccctaggcaagaagggggtctacgtgggaaagggctgctagcaattttgcttcagagtcaaaccatggacagaattccttcccaaagttagttcagcctacgcccaagaatgaacaaggacagcttaaaggatagaaacaagatggagtaggttaggtctgatttctttcaccatcataatttcctcagttaaaattttgtaaaggtggtttcaatggagcctcactctgttgcccaggttggagcgtactggttccatctcagcttactgcaacctctacctcctgggttcaagcgattcttgtgtctcagcctcccaagtaggtaggattacaggcatctgccaccacactgggctaatttttttgtggatttttagtagagatggggtttcaccatgttggccaggctgatctcaaacttctgacctcaagtgatccacctgccttggcctcccaaaatgctgggattacaggtgtgaaccaccacgcccagccatgaatctttagattactcaagtaaatgtaaaattataagtgtggtaaatgacaggagatgtatagtagaggaatctcatctgtctagggataaagggctcccctgtggaagtgatatttaagggaagattaaaggattaagaacaattaatttgggaagggatggtgtcttagtctgttctctgttacctgagactgagtaatttattttaaaaactcagaaatttattttttacggttccagaggctaagaagtccaaagttaatgggctgtcatttggcaagaaccttcttgctctatcatctcatggtggagggcaggaaagcaagagagcacacatgccacagagagcaacagagggccaaactcacttttataacaagcccagtcttatgatacaaacctactctcacaataatgacatcaatccattcatgagggctctgccctcatgacctaaccacctctaagttctacctctcaacactcttgcattgggggttaagtttccaactcatgaacttcagaggacacattcaaatcatagcattctgcctctggtattcaaaattcacattcttctcacatgtaaaatatatttatttcataccaattgctctaaaaatcttaactcattccaacatcagcttaaaagtccaaagtccatagtctcatctaaatcagatatgtgtgagactcaaggcatgattcaccctgaggcaaattcccctccagctgtgagcctgtgaaattaaacaatttatctatttttgatacaatggtgagacaggcataggatagccattcttattccaaaatggagaaataggcaagaaaaaaagagtaactagtcccaagtgagttcaaaacccaacaggaaaaacaacataaagtcgtaaatctggagaataatctccacacccttaatattgtctcccaaacatgcttttttcattctttacatggccaggctgaaaattttcaaaacttttactttcttcttcccttttagttacaaatttgtctttaaatcatttccttcttattttactgtaagtggctgaaagaagccatgcagcaccttcaactttgctacttaggcatttgctacttagcctagttcatcactcttaagttctgccttccataaagtcctaggacatagacacaattccaccaagtttgtaactgtatcacaaggatggcctttactccagtttccaatacactgttcctcagatccatctgagacttcatcaggatggccattactgtccatgtttctaccaacatactgatcatgacgtcttaagtaacctctaggaaatcccagtttctctgcagttcttttcttcctctgagttctcaccagaatcacccttaatgccccattcatgacaatctatgcttcttaaaatcttgctcctccaaattcttccagcctctacctattactaaattccaaagcttcttccgtgttttcaggtatttgttactgtaataaaccctcttctcgataccaattttttgtcttagtttattttgtgctgtttataacagaataccagagactgggtaatttataaagaaaagaaagccagcgtctggcaagaaccttcttgctgcatgatcctgtggcagaaggcagaagggcaagagaacatgtgcacaagagagaacaaaagagggccgaactcacttttataacaaaccactcttgcaataatgacattaatctattcatgagccctcatgacctaattgcctgttaaaggtcccacttcccaacactgttgcatggggattaggtttccagcacataaactttggagaacacattcaaatcgtagcacatggggtacagaattatattgcagatacagacagcagctcatgccaatgctgtgtggtaagagaaagcacagggctattgaaagaatgaacaagggtaagggcactggcacccagagggcaaggaagagtacaggtgggatgaatccagagtgggaggtggagactaccaccaggctatgcaggaccttataaccactttaaaaatttgagaagtctgggtgcagtggctcatgcctgtaatcccagcactttgggaggccaaggcgggcagatcacgaagtcaggagattgagaccatcctggctaacatggtgaaaccccatctctactaaaaatacaaaaaattagctgggcatggtggcaggcgtctgtagtcccagctattcaggagactaaggcaggagaatggcatgaacctgggaggcagagcttgcagtgagccgagattgcaccactgcactccagcctgggtgacagagcaagactccatctaaaaaaaaaaaaaaaaaaaaaaaaaattgagagataggagggtcacttgaggccaggagttcaagaccagcctgggcaacatagcaagaacccatctctacaaaaaaatagaaaaaaattatttgggtatggtgatgcaaacctgtagtctcagctactcaggaggctgagggtgggaagatcacttgtgtccatgagttcgaggctgcagtaagctggtattgtgccactgcactccagcctgggcaacagagtgagaccctgtcttttaaaaaaatgagggttttattcaaagaacaatggaaaatcattgatgggttttaagcagtaaacatgaagggaacacatttgtggtttgcaaagattgctttagtgcctttggagaggagtggtagtaagatcatccagggtgctattgttcccaggtgaaagatgcaataattcaggtggaccccttaaagaaagagatatggatgagttctagagatgtggaagaggcagaatcaatagaacttggtattgattgaatatggtgtgggggcagggttattagcatggcccctagatttctagcctgctgagtaggatgaatggtcacaccattcactgagatagaaagctgagataaaacaagatttaggaggaaagttgacttttactttggacaggttgaattcaaagtatagtatggtgtcataaagtaagctgttgttacatagcctaaaaatgagtggatttttaaaaggtcaagatgggcagaagtagagcattccagttatctaacattgcatgataaagtcccaacagttatggcttaaaacaacatttactgtgctcattaatctgaattttggcaaggcttggtggatagcttatctccgcaccacttggtgtcagctgggggagcctgaggctggggttggaatcataagacagcttgctcactcaaatgtatggcagttgatgctggctgttggccgaacttgagcaggggttgtggctggagcacctactcgtgtcctttacatgtggctgcttagcttcttcagagcttggtctgctgggtttcaaggtgagtgtcacaagaataaagtgagagccagacagagactatcacctttcatgacctcgcctcagaagtcatctagcatcacttccatggcattctgttcattagacatggcccagccatattcagggtaaggggaattagagttcactcttcaatggggggagtgttgaagaatttgacaacatgttttaaaaccaccacatggcggggcagagaagaaatcagttatcattccagctggaaggaacaggttgaaacgggaaggtagaaattatattcaatagaagtggagtggttgctgttggctggcctggagcatgtatgaagggttatgaacagtgtgaaatataggttaaaggaacgtttgggaccaaattatggtggagcccaaatttcctgaaacccattattttgaatctggaaacaaattgtcagagaggaatacaaatcagatttattaaataaagataaaaagtagaagcaaacagtgactggcatgggataggaataattctacttgctgataaaataattcatgccaattttggggtgtctagtctacagatttggggtcatatatctccaaatttaaattgtagacatattcaaatgtctttagttgggctttgtaccttatgccagtcaaaaacatgagtcaaaaaaatcatgcctgtatggttcccttcggaggtatctctcctttatcctttagcagattaagataagaatcttggtctttttgatcctggctgtggcttcaaatttttcccatcttactattgggctacccaaaaggactgcatcagacaagactggtgagttgaatagtgttcctcccaaattcacgtctacctggaacctcagaatgttactttatatggaaataggaactttgtagatgtaattagttaaggttcttgagatgaaatcatcctggatttagggtgggccctgaatccaattattgttgtcattaagaaattgagaaggcacagagacaaagcaaagaagcccatggggagatgcagaagctgaccttggagttatgcatctagaaccaaggaatgccaggagcaccagaagctggaagaggcaagaaaggattcttccctagagccttcagagggagcgtgaccctgtcaacaccttgattccagacttcgggcctctaaaactcagagagaataaatttctgttttaagccacgtagtttgtggcaacttcttatggcagtcctaggaaattatacacgaagttagagccaggcatgatgtattagtccattctcacactgctataaaaaattacctgagactgggtaatttgtaaagaaaagaggatccccaggctctatggaaagcatgcctggggagacttcaggaaacttacaatcatggcagaaggttaaggggaagcaggcacgtcttacatagcccaagcagaaggaagagaaattgctgcgaggtgctacatacttctaaacaaccagatctcgtaagaactcactcactgccaagagaacagcaagggggaaatccacccctaccacccagtcacctcccaccaggccctcctccacattgatccaatcacctcctaccaggcccctctttcaaccttggggattacaatttgacatgagatttgggtagggacgcaaatccaatccatgtcacgtggaaaatatgggtgttggtttgccagatgccaaacagaaacaacatttgatctgttgataattgtgtatcctctttatcaggtctatcttaaggaaatcagagagtagagcatattttcttcatggaatggtgagacacatattagcctgagacaggagctaaggagagtgagtggtgggctccaccaaagtgccttcatacaactacactggtaggtgatcagaacaaagggacacgtagaacgaagacccgggtgtgtaacccaaatgcctaacaaagtccattcaatgtatgaggtgttgctgctgtgtgctgaaggaggaaacctgggtcttagtctctgttatggtaaatagagaagaaatcaagccttcctacgacaataggggatttttaatgaagtaaaggagacagaagaaatgtcccaaaggagaatgaagtatgtcaaaaacagattgcgcatgtaattactttctcaggccttcctgacattatcagcaggacttgtgttttgatgaaaaaacttaattaaaacttaatttttttaagtggaaaatattcagcatggttacaggaagactgaaatcagggcactgtgtaattttaattgccttcgagagatgcacttcacgtgaagactagcatgggggaaaaaagctagaggcacaaagtctgaggggagtggccacgctgaatctctagctgtgtgcttgggcgccattttccccactcttacagttgacgggatggcatctcaggtttcacgtgtaggggaggagagtgggtctgttctggagtgtgccggtcaggccatacttggcatacacattgtagaaagtgtcttgatttttattctcctaaaaagggtaaaaagagattgaggagattacatatcccatgaggcagcagtttttaaatgccactctctggatcagttctatcagaaccatctggttctgattcatttaatctgttttaggacctgtgcacagtgtttctattttaaaaataaacctgtcctactcattcttggagtcaggtgtgggaactacaggtttttaatggaagaaacatgaacttgaaaatgagtaaatatgggctacgtcctttacttcccaaggagatttgggttgactgcttagtttcctccatcaaatggggataatatgcttatttgatggggttttgtgaaaataaaagataacacaggtaaagtgactgacacatacagttaagtggtctaaaaatgataaaactgtagaagaagagttggatcaggctgcttgctaaattgggaagggataaggtagtgttcttcagatatttcaagggcagctgcatgagagagagagagagagagagagagtgtgtgtgtgtgtgtgtgtgtgtgtgcgcatgcagcctttagaggtcagactcaagtccagcaggtagaagttatagggagataaatttcaacgcaacagaaagtggaactgtctagtgaatggtccagggatgtcatcagtttgctccagagggtagtacgttccaaatcactggagcaattaaagcagctgccatattttgaggatgtacagggctgtggggcagcaattgaatgagaccacttggttcagctctgtaatagggtttctggcttcctgtggggctgtggctgacatacagttgttttgtaaactaacaacacttgaagaaggttttagcagaaaacgtttaccagtaagatatgtcaggtcaagtacactgttttaggtattctttactggggacattcttgtgaccttcatcccaggcctttcagaaaagggatggggcatatttagaagttattaatgactgagaagctcctctggcacttcaggggagggaactagagctataaaatgtcctgtgattgttctaggactttctccttagtttagctaacatctgggtccttgtcacacggctatgaaatattaggcttacagacactttgaagggtgagaaaaatggaatttattgggtaaaaaggaaaaaaagggaaacagggatgctctgcagagccagattcctgctagtgtgcttcctgcctcacagactgaatcccaggtaccacccaggaagaggaggggccaggctcctccccactgcaaatggcatgaacttcccaagacccctcccccagtgtgcaggccacttggaggttctctggtgacccctttatatttggctgtctcattatgaatgggacaggagtgcgaaattatcccacttcaaatgtcacttgctctctgttgggaaaccctatacctcactgaagcccagatgatctccctgaaccagcctttgagggtcctttttggagccctttggaaacctggtattggatgggttgggttacagggctgctcagcctgacagcctcgcattatctggtgaccacagagtttaaagcagaacattgggaagaaggtagactgggccagttgcacaaagcagagtgtgaagagtgatgggagatgaaggctgtttgcctgcttttcactggggaccagatttggatggatgctggtccaatatgagtgacacagttaacttatcagtgagatccctcattcttctcatcagtgagatagctgggtattgggggaacctgcccccagtatttcaatgtaggttctttctattttccataatatcagctggctgagaaataaagagaaagagtacaaagagaggaattttacacctgggccgccgggggtgacatcacatatcggtaggaccttgatgcctgcccaagccttgaaaccagcaagtttttattaaggatttcaaaaggggagggggtgtacgaccagggagtaggtacaaagatcacatgcttcaaagggcaaaaggtagaacaaagatcatatgcttctggggaaacagaacaaagggcaaaaggcagaactcctgataagggtctatgttcagtggtgcacgtattatcttgataaacatcttaaacaacagaaaacagagttcgagagcagagaactggtctgaccaaaaatttaccagggtggagtttcccaatcctagtaagcctgaagttactgcaggagaccagggcgtatctcagtccttatctcaaccgcataggacagacattcccagagcggccgtttatagacctcgccccaggaatgcattcgtttcctagcgtattaatattaatattccttgctaggaaaataatttagtgatatctctcctacttgcacaaccgtttataggctctcggcaagaagaaaaatatgtctctttttgcctgaccccgcaggcagtcagaccttatggttgtcttcccttgttccctaaaagtcgctgttattctgttctttttcaaggtacactgatttcatattgttcaaacacacgttttacaatcaatttgtgcagttaacacaattatcacagtgatcctgaggtgatgtacctcctcagcttatgaagataacggtattaagagattaaagtaaagacaggtatgaattataaaagtattaatttgggaactgatacatgtccatattaaaatgaaatcttcacaatttatgttcctctgctgtggctccagccagtccctctgtttggggggggtccctgacttccaacagctggggaccacttaatcagggtaagggcagtagtttgtgttcacagtttgatctccctgcatggtgctaaccaggctgcatggggatctaatgtctgactttggccacggcatcaggctccagccaactgacgtgaaagcaagtttccaaatcgtctctttctaaatagataaatgatactcagtgttcctttagccttccttattttttgcaaatgcctgtccccagtggttctgttgtttgctctgattgccgttttccccagtaagtgggaaaaccccacatcttttccccatcagtattccctaatgaggcttgttccctcaaggggaccttgatgagttacaacagcatgaccatgttcccaagcagcatgctaagaaaaacaatccccagtgatgccctgcaggcaccatttaggagcgggcggtaatgaatccctgagagaattcagtcctccgtatgaaggtgatccagagtgaagtaaacaatttcaccgttaggtggttcaccctgcatgcctcattgctggctttctggaaagccagtaaataaggcagaaaaaatgtatcattccctccagagtgcagggtcccctgtcacccacacaggactcctgcctgtcactttgagtcacagctgggctttctggaacccggattcttgtctctggttagctcaggtcttgcagccatgccaaatccaaactgtgacattgtctgaacagtagggcatcctgttccctggtttggctgagctctgcggagcagaacagtggccgaggttaacatcagataatttcctccaccattcctgagtaccctgagggcttgttacctggaatcaaagacttgtcagaactcaagatgaccttaaaggccagcttattcaacctcccacccaggatatgacttccagaactaaccacccacaatgcagattagtaatatcatacgtggttactcaatgcaattgtgtcatttcaggagaaatgacctgttaccaaagtgtcatgaaacccacattaatgagctgggctgtagtggaggtttactttgatttctgaccttaattattagtggtttggattctttacgtttatgatggattttctgattaccaattatgattcactgtaagccatttttaaaaatatgacatgaagctctgacccacttttaacaacacagtggcaaatgccaaacaattggcaatttccccttctaatatcagctgtttgaatcatcacatctactgtggtggctggggaccactttatcttcattctctggcttcagtattcttttctggtattgtcattactgacctaggtgcatatctgtactaggctgggacctcagctctatgccagtgagaaaatgaggttcaactgggaaaacggcctggagcagttgctctcaggcttgtctgcagattagaatcacctgtagacttttaaaaaatactgacacttgggttccgctcttggaaattctaatggatctggggtgcagcctgggcatctggaattttacagtctacctgagtaattccaatgagcaggtgggtggccttgcaaaccggggtctgaaggggctggtcagcaaggagtatgggcaaaatagtgctggctggctgggcgcagtggcttacgcctgtgatcccagcatttgggaggctgaggcaggaggatcatgaggtcaagagttcgagaacagcctggccaacatggtgaaaccttgtctctactaaagatacaaaaaattagctgggcgtggtggcacgggcctgtaatcccagctacttgggaagctgaggcaggagaatcacttgaacccaggaggcagaggttgcagtgagccaagatcccacttggctgccactgcactccagcctgggtgacagggtgagactccatctcaaaaaaaaaaaaaaaaaaaaaaaaatagtggtggccaaggggtgtttataaaacagagttgtgatacatgttcatacattcacctttgaggtctgatttggtggtagcaggagtttcaggggaaatgtttactgatcaggttgatgagtgtccagggacaagatgtgtctgctaagagttagattgatggcaaagattgggcagattgatagttctctagcaaataagatgagatctgctatttcagcaggaaacaagtaaggaagttgaacaaaaagctagtggtatgggccatgtccacaagctgtggttaaaggcaaaggctgaagcctgattggcgtgcccacactgggctgggcactgtcagggacagccaggctgactccagagcctgccttctggttggcttctcccggcttaagtctggccctgcaggaaaaccgacaggagttttcatgccaaccaagactgagacaatcagagactggcaggtttggaaccaggaggtctggatggggaggttggctctgaatctgttgtcattatcaggtgagtcattaggaccacctggaaaagtgaagctgttcttcaccttctcttcttgtgaaagtgattcaatctcccaaacccaggttgatcataccctttaggtctaatataggaagtgttgaattaggtgatgtctctaaagaactctctctgggttccttagagaaaaatagcatttgaacattgtgcctcagcaggaaagaagatgcaatttaagtcctgcaccaaggcattcagggctcacctcaaagtggactcctaggaacaagaagcaaatgattccgtggagagggttagatgtctggccaatggaaacggggatgtagttcaggttttctagccccagaagttcagaacctttgggttcctcggtggacatgtctgttactcgcttgaaactagggaaagtctcttgtgtagaaaacctgttgcatgtcccttgactaccagtagcagcagaggtgctatgtgtggctgaagaattttcctcctttttctgagagatgatttcccaggtttccttctccacaattctgtgggcgtgtactgctgtgataagatgtttgttctctggcttataaattacaagatattttcaggaccacttggaagaaattggaacattttcctggaggcagtgggggagctgctggaggttttcggacaggcgggccacatgctgagagaggtattttgggaaaatgcacttggcagtcatgtgtgggtgaggataataatattaatacttaaccactggcttgttgggaagagtaaggggaacaatgtaagtgagtgtaaagatgcaggaccaccattcctttgttcattctttttttttctttttctttttttatactttacattctgggatacatgtgcagaacgtgcaggtttgttacataggtatacatgtgccatggtggtttgctgcacccatcaacctgccatctacattaggtatttctcctaatgctatccctcccttagccccgcactttgtccattcttttagtttctctgagacctggtgccccaaggataccatcttctcctgaccagtgtatcagtttgcgagagttgccataaaaaaatagcacagactgggtggcttcaacaacagaaatatattttctcatagttctgtaggtgggaagcctgagaatgaaaggcatcggtagggctggtccctcctcagggccgcgagggcagggtctattccaggccttcctccttggcttgtagatggtcaccctcttccctgtctcttcatgtcatcatctctctttgtgtccgaatttcttcttctcgtgaggacaccagtcatattggattagggcccaccctaatgactgcattttaacttaattacctctgaaaagatcctgtctccaaagatggtcatatgtgagatactggggttaggacttccacatataattttttgaggggatacaattcagtccataacagccagtctttttgaagactttctcttttgggggctttacacttaggtaattacaggatattttaaggggtatttcaagacccagcaacccccttctccacccaccatctcccccaaattatgttcgtcacctcctggtacctgttatatcatcactagaattgcttggttgaatcaagtaatgtttcaagataatttccgtaaacatgcactctttttatgtaagaggggtaataatagagccagtgaaatactggatgaattcatttaccaaactacgtaaaagtactgatatatgacaactacttagggaacctaagatttgggacatagagcagcctatttagaatatccggtataacattgcagggaatagcaagggctctagagctttccgcctgggttgaaatctcagctccacccttttctttctgtgtggcattcagcaagttacttaacccacctgtgattcttccttcatctgaacaagcagcataacaatagcatttacctcatgattctttagaaggtgaatgagctaatacctaatatagtgcttagagtagtgtcttgtctgtggttggctttcaataaatgttagctgctattgttgttgttaaactatttaacaaactacgaagcacattcctatctgctttcttctttgcccttgtaacagccctgtggagtagaaggagttagttacattttacagatgaagagactgaggctctaagacattatgcgaaccatctcagggcatatggcagtgttattcagaacatctatcggtaaagaacaagaattccaaaaatataggattttccccaggaaggagggccagagtgtgggctactgtgggatggcctccgggcagagtgtgagggtaggcgctccaaagagtaaggcatctggagaagagaaacaatgaaagaggcaaacgctggatgagaaggacctcaaagcagaactttgcctctcggcctctcagtcaattgtgatctgactgacatccagattgtgatcttgttcaggtggctgaactttgaacccttcttggccatttgatgctaaaggcagtctttgaatgtgatgttttcctagatcgtactggtggaatttagttgcctcagatttcccagtcatgtgccagcactgccaagtgatctccatgtgtgggttttatgatgtgtttccagtgctccacatatggcctgtgatttttttttcctatggctcctaatgaaacactcagaacactgcactgaatagaagtttctccctattctccagagtggggatccttattgcatcgtcaagcatggacaccaaaaataaatggggagaaatctctattctcttagtgatgaggcactcttggaggaagatattattaacatgactacgtcttgccaatttgaaactttgcaaatatctgtaaggttgaccagtttttataatttcaagattttaagttcaacttaaggtactttacaaaattatttttatcataataaattacagttctttacacctgtgtcttttaccgattagattgtgagctactttatgggtgagcaccagtatctacttaactttgtactaaatggctcaatattgcctggaaaatagtaggtgcccaataaatagtaaatgttgttcgatcaaatcataaatgtagatataagctaaacctcttccctgggcaactggaaatgcccatgttatgtcttaaaacacattgaattcaggtgggagaataaaaatgattttaacaaatccagtgtgctttttgaaggcagaactacaattacttcttttttccctcataatcaaatcaacctgtgaaattggaagccaataaatatgtaaaaaagtcatcaaatgtcataggagaggactactatttgattcacacgtgatctttgtcgtttaattgcgtgtggcaagaatgaatggaagtgatattaagtggagaaaaactcagtcccattggtgagttatttaccttgaccactgtgatgggctgaattgtgttcccctaaaattcctatgttgaagtcctaacccccagtatctcagaatgtgactgtatttggagatacagtctttcaaaaggtgattaagttaaagtgaaaatgaggcctttgggatgggtcctaatccaatatggttgttgtctttacaagaagaaaacatttggccacatggagagatacaagggatgcacatgcatggaggaaagaacatgtgaagacatttacaagccataaaaagagccctttcagagactaaccgtgctgacaccttgactttgaacttccagccctccaggactgtgagaaaataaatttctgttgcttaagtcacacagtctgtggtattttattatgatagccctaccaaactaatacaaccacctactttttagaatttgtagaatccaagcacttaagattacaaaaatgcatgtttattgtggcactattcacaatagtgaagacttggaaccaatccaaatgcacatcaatgatagactggataaagaaaatgtggcacatatacaccatggaatgctatgcagccataaaagaggatgagttcgtgtcctttgcagagacttggatgaagctggaaaccatcattctcagcaaactaacacgagaacagaaaaccaaacaccgcatgttctcactcataagttgaacaatgagaacacatgagcacaaggaggggaacatcacataccagggcctgttgggggctggggagctacaggagggatagcattagaagaaatacctaatgtagatgacgggttgatgggtgcaccaaaccaccatggcacgtgtatacctatgtaagaaacctgcatgttctgcacatgtatcccagaactttaaagtataataataaaaaaaagcaataaagaggaggtgatggtaataggcacagacttttgcttgcgttgaggaaatattctaagtttcacaatggggtgtggaagaatctgtgcgaatctccttctgacctctcgtggtaccatttcctcattactcagtgatgaccccagagccagtcttggatgaggcggggtggaattttccacacaggtgccatgagctagggggctcaaaacagacactgtggtgaggttattactgaaatattctgtttctatgaagtttctaacgtaattctgggccctctttctacaaccttagcaagttgctgaactacaggagtgcggagtaacaatgcctttcatgtcaattctgtttacagccaggcttgcttgcattaaactggacacatccatcaactagagtgctggataacagatgagaaaaagctaagtttgagttgtcttttatattgtataatggtgcttctattttctttgttttcttcttgttcttaagttctgtgggaaacccacgggaagaggagtctatccagggtatttgacttcaaatcatttcatctcttctgttcttcctctcatctagtcctctgtgttcttgtaatatacgcaagggcaagattaatagtagaacagaattctgctatgaaatttaagtgatgtgaattctttctcaaaattccaagaatgaaaactttgactatgatatagccaataatttgcacttgtttgcatttgacattgctcatttacattaactagcgtaaaatacctaattagtacagcagaaaaaaaaaaactatatgaggaaaaaaagaaatgattgctcttttactcactggagggaaaggttggatttatttcagctctgtgtttagaaaaatacctttgctgggcttcttggagtgtgaaaagagtggaccctgacccacctctattccctgctgggccatctggaaggattttcacaacaaagataaggctaaaccactctgcaaaatgaaaccagaggaatttcatgagttctggggagtagaaagaagtagggtgagctctgacaaggatgatggggttgggcatgtgatgtctggagttggggctaaggaggccagtccaggagatggtccctgaggtaggatgggagtggggccaggcaactgtaagacagcgatgtctcatgttattgagctttgctatttcgtaacctctatctgccacactttctaaaacctttgcataactactgggtatctaccgagaggaaaagaagtcattatacgaaaaagatacttgtatatgcatatttatggcagcacaattcgcaattgcaaaaatatgtaaccagtccaaatgcccatcaatcaatgagtggataaagacactgtgagatacacatatatatatacacacacacacatatatatacatatacatatgtgtgtatatatatatgatggaacaccacacagccataaaaaggaatgaataatggcatttgcagcaacctggatggaactggagaccattattctaagtgaagtaactcaggaatggaaacccaaacatcatatgttctcactcataagtgggagctaagctatgaggatgcaaaggcataagaataatacaatgaacttcggggacttgggagaaagaatgggaggtgggtgaggaataaaagactacaaattgggttcagtgtatactgctcaggtgatggatgcaccacggtctcacaaatcaccactaaaatacttactcatgtaaccaaataccacctgtttcccaaaaaccaatggaaataaaaaattaaaaaataataaaaataaaataaaatctttataagactactgtacctgttagagcctcctttctgggaaattaaaactctaattgtttccacattagcttatgaggtggttggtaaaagagaatgactacaggaaatgaaatgccaatgaggttgataattcagtgggaccaacaagtcacagtcaaccagtgatggagatggtaaacctactaggaatccacagaaattttgaggcaggtaccggactctcaagagtgtgtgagattggtgaggctttggcctgagccattgaaaataaatgcataaatagcaacacttagcagaccggaaaacatgggggaaaacccagacaagagacacttgggatttgtcagtaaaaaatggagttgtgaggctgggtgcagtggctcacgcctgtaatcccagtactttgggaggctgaggtgggcggatcacgaggtcaggcgttcgagaccagcctggccaacgtggtgaaaccccatctccactaaaaatacaaaaattagccaggtgtggtggcactcacctgtaatcgcaactactcaggaggctgaggtaggagaatcacttgaatctgggaggcaatggttgcagtgagccaagattgcaccactgcactccagcctgggcaacagagtgagactccatctcaaaaaaaaaaaaaaaaatgcagttgtggaagctttgaaatccctgctgtgaggttatggaaggagaatgtttctgttcaagtatgaatcttttttgggaggggtggcaagaggaaggtatgcaaagggaatggtgaataaaatgaaaaggttcgactttttggtggttagtcacctaagaaggttttgtgggggaaataatgtgttttagccagcaaggggattgtttaacctgccctctaccagtctgccgtgcctcacccacttgtctacagctgtcctgttagttgtagcattttgttttcttttatgcaaagggattttcttatgacactcaaggagaacccaggagagggaaggcatctctgccttccagggacaaagtttcagaactgtactgctctacagtggtaaaaagacaacaaagtctttgatttgcaggttgcttgtttcacttaccctgtgaagtggagctcagttggaatatttcatctggccactctttagatgttcacggcagccctgcctggccagccatgaggtcgggcggagaaaggaagcaaggatgagtgaggagggagagaaatggccctggagtttgttgttggagatcttctctgtgtcaaacatcttaagggaatcacctcatggaatcttcgccacaacccattgatatggggattattttccattttataatgaggaaatgaaaccttagaataacagcaagaagctcagacaactatgaagtggcagggtgcagttatgtgactcaaaaccagtgttattttcagaagtgggaaatgtcatgactttgccctcccctccccttctctctcttccttcctttttgttggctatcttgagctgaatggtgataacgcttaactagtggaggtacattttgaataaacagcgactgacttaaatttataatcataattttattctagagttttaacaaatggtaaaacatttagagttatttttccgcagacttgacaaaggtgatgcctgactgtgcctgccgtcatttttttctatttataaaatcagggtaaatttgcaaacttctaaagaagcagacatggcttcagcaaccagtcagggtggaggtgagaccaggaaggttggagctcatgaaaggtcctcctcttctgtctaaggggcacttacttcattggtagctcagctgatactttgggaattccaagaaagagccaggaaccctgctaggaatagagaagcaaagaatccagggctctcactttgaattgctcaccacgtctagaacatgagtcaggcacagacacagaaaagtcagcataatgcgtatgtgcagtgattatgagatgcccatgcagcgtctttacaccagccagggatgcaaggaagaatctccggagaacatctacccaacaggtggatttgcttgtggggaacagaatctgtcaaggagaaacaaagcagtgcagtagttgcatcatcatgaggaaggatgatgtgcagagttagtttcctaagtggcatcgcctataatgagcagcgtgttctcctaccaccttagctgcaagcagttatgctgtatagccaacatctttctcctagctcacaattcaaaagcacattgctgggattccttgggggctttgcgtttatttgttgtggtctagtggtttattctggcaaaatacactgcatggatttttacagtttgctttgtgcttggacatctttccacccaagcaaaatgtttacaaatgccagcacgtcgttttctgaaaatattgctgaaaagaacaaatgtgttgtgatgtgccatgtgtttgaagagaccaggcaaccaaacactaagattgcctcttcctgtcagtgtttttgctcggaatcattctttattgtgcctgtttctccagaactctgtaatccaaaatggtcctgttctctgtggacatgtgtttattctgcaagttaaaaccctttcaagcaattcttgctgtgttaaatataacaatgcactgataaaattctgtcatacattctagaaaatacctttgtataaagtactcatattactgaatttaccaaaacagcataggtaacagattctaagatatcttagagttaattgataatatgtatctgaatgttgtaaaatttatctttcctatgcaaatcccttcaaaccatcccttctagtcccatttttgagacacacacacacacacacacacacacacacacacacacacacacagactgactttgttattccttactggtttttactgatggtcatagacgtctttcttctctgctacttccattatcttcctgccttcaaaatctccactttagttgcagttttgttttactatatttcttatttttaaaaatatataggtaaatagaaattgaaaagctcccattttttgttagattcatgaattcctttatgtaattatttttccaaaattaatcctgaatacagactagtaaatttatatgacaaagaaaatttctatgacaaagcaaaattaatgctgaatacagactagaacatttatatgacaaagaaaatagggaactgtgttgtttcacatactcaggagcttctgaattcaggaattttctagatggagaagatctcattatatggtgacaccagctagccaggtgtactactgaggtctgtctgtgttagactttagaaatagaccaaggatggagggaggtttgagaaatctaagtaaggaagcataggagaccttcttgtttgaggtcaaagaataattggaaggagtggttccatctcacaatttgaaaatgttctaaggaacaaaacgtacttttttatagacctattgatctcagaagatataacacagctggtggagggtaatgatcaatcgccagactaccaccattctattttcttctctgtcaaacgtactcactatattgtgagtgttttcactgcctaatttttcatggcaatttttgaggactggtagctgaactaatttaattctcattctctcacttgttcaccaaatcatttcatgtgtgtttttgccaggtattgttttaaatattgggcactattttcggttcagtaattcaacctattttaatcccttactagcccagttgtaaatttcaaataagtcattttttttcataccagttccctgctttcgagtctctgatgaggctacgctcaagtattacccaggattaggtcctatctgaaagctcaactggggaaggatccacatttgagcttgtttatgcagttgttggtagaattcagttcccttaggacggttggactggggggcctcagctcctagctgactgtgggccagagatcacccttggttccttgacagatgggcctgcccattagggcaaattgaagcatctaagtcagtgagggagagactctactggcaagacagaagtcacaattatatataatggaatcactgaagtgacatctcattatctttgtcatattccattggttagaagcaagttacagcacccacccacatacattcaggagggtgtgtattacacaagcacgtaaacaccaagagatgggatctttggagaccatcatagactctttcctccataccatctgaacatttaatattaatgtagtctgtatttctacataacagttctctgaaaggaaactttgctgtgtgccagataatactttttgatcttcttattttacctttccttaccccacccatgattattactatcaaagctttagggcataacatagtgctaaaatagaacacttactccaaaaatttaattaacaagcaacatgaaataaaaggccatttgcatattgtaggcaaataaaaacattatcaccaggagaagtgagtcagaatatatcaaatataatagctaatattaaatagctgggggtgagagttggaataatgagcagcctctgtacagagggcatgtcaatcaattactctggccctattggagcacctgcctagaagtccttgctgtgcctggttaacccatcagttgctgaatagtggggaggtctctggtggggattctgggaagaggggctgagcagtaattgcggagaaccctaggggatcccagcagtcactatttactaagacatttttattacctaatactctatggctaaatagttaaaagaattaaaaattctcaaatgctttcaaggttggagccagttcatggggtcaggagagctatctccaggcctgcattctactccccttctttttccatccctgccccatccctttcaggcagcacctggtgcacactcaggtgacccagcctacatgtcgaggatccacgtaaacacccctcaaacagatggtcccccgcaggcctcggaatgtggcaaggtctaccattaggaatgtaggctcaggaaaggctccttcaggccctgagagtggacgtggaatcctgatggcggggaatcccagggtcctgtgacccagagcatggtctagaactgtgctgggcagcacagcagccgcacattggctccagagcactggtcgagatgttccttaaatgtaaagtacacaaccaatttcgaagacttaatacaaaaaataaagggcgtaagatatctcatcaataatttttatgttgattatgtgctgacacggtagtgttttggatatactattgggttaaataaaatatataattaaattagttctaactgtttttttctaatatagctactaacaagtttaaagttctatgtgtagcttccatttgtggctcccataacatttctgtggaacagcactgctctagaagggagaagtacggctctgctaggacacatctcctgctaccttggaccccttgccctgtgaggaggaggagctagagcagagccctctaaagcgtggagtcccaggcaggagcctttcttgccccagggtggttttgctttaaggtgatatttatagtctatttggtctcactctgtcatggctaaatgactccaaatctctctcctttgcctacttctgggttttgcccaaggcaagaaaatagtcttcctcaccttccacctgcccacccccactgccactgccaccaccaccgcttttgaatcaatataaccaggcacagaaagtaaaattgttctgtattgacatgtatctttcaagaagctgttattctttgggtgaaacagaatctaatcactaagcaatttttctacagagagagggagacttttcactccccttccccttggtttgtagagtacattcatctttgataattgattcttcgggtggagtaatgatgtaggctcaggaatacgttttttgattcaaagggtataaaaagtgctatgtgtgttaggggttaatgtaagctctgtggaattacaatacggatgtcttctaaagaaaattcactaatctaatctctagagaaggaaacttttagagagtcccttatgactcccttaagaaattattgtggatagtatgttgctgtatgatggctttaagaatttatggtgaatgcttcagaccatggctttagtgtttcaacagaaacagtggcttacttagggtggtggtgcatcttgctcttgaataaatctgatctgagcttacaagtaggaaggagtaatgatttagatgtctgaaatctctttagtttattgtttcttttcttatcgtggcagagagtgactgttaaaactttttcctcctgggcacgtagctggcctacatttcccagcatcccttacagatggctgtggccatgtgactgagactggccaatgggatgctagtggaggtgatatattcttgtccaatcatctactctttctccttttcttctgcctatgagatgcagagtataggggcacatgggcaccacctgagaactctttaggaatgcagaatctttaaccttctcctaggtgtagggaatcagaatctgcattttaccaagattcccaggtaatacctatgctcattaacatttgagaaatattgccctttgagatgacagagccagtagatggaaagatcttgggtccctgccttgtggcttagaggagagccacccaggagtgtggcttcttgaagcagcctgtttagattggtacataaacaggaagtccaattttatcatgatgaggtcactgagattttggagttgtttgttatagcagttagtcttccctggataatatactcacaaagtatttaaacaatgccatgtacctacaatgtatccccttcttaccaataaattctgccaaccaaaatgatcatattgtacctacaatgtccaaaatgtttaatacagactgaggtagaccttataaatggtattggtgaagcctagtggacaattttaagaaatcaccaacattacaaaacgttgactggcaaacttgcgttcaccctatatatgctctgtaaatgttcctagctccctcacttttttgtctttttcttcttcaacggcctccttcacttttcagtagcagcaagattaagaggtgaaaactgccattactccagtgaatgggtgaggtcactgatttgcacaattcctatgagagcccaattaaaagaagatacagagataagcatgtacgttttcatctctcttaactccattatcttattgtcatttggctatgatttatttaggtcaacattgatttctgtagcttatttagatagctagaatgataaaaatatctttttgttatcacaaggagtacaattatttacatatttacctattcatccattcattcttagtatacagaacagtccaatcaggaacaatctgtagtacctatgacaggtacagaaaagcccttaaagattagcctctaaggtgttaatgggagagatttactgatttatatttttccctatggatctggagatacagggtattaacaagatggatgagttattgggggtgcatttgtatgtctcagggtgcatgctgtctctgataattgctgtctgtgtttgattgggcagagccagtatcttaaaaccttcactagaatttcctatattgagacatctaaagttaagaaatctaggtaatttttgcttatcggtttaaattgtgcatagaactaaattattaaataaccagcatgtctaagccttacccttttctttaattacacacatatccatgcatgcacacacatacatgcacacacatacatgcacacgtgctgaggaggaaaaaaaagctgaagggattttgtctgtgcatacatgcgtacatatgcacagacacacacaagaggcacatgtacacatgtatggacctgtgcatgaacacacaaatcccatcaacttctttttttcagccagtcattatagagaggaatgacagcttttatttgctgcaaaaattcaagtggaagaacgtcatatacaagaactaccagcctagtggtagagaaaagaggattctttgaagctctttttagtcagtctgtactagcaatagtccagtgtttcccaacttgagggtgccctcaaggcgttgaaaacataaggtaccactgtgatcgaggttttaccaaattttaactttccttcacttctcacctaaaatatcttgagggtgatctgtgctcagatttgttttaagggttggggggagtattcaccttctgaagtaaaagaaggaacaatttgtcctctgtctggcttctatcatgaaacttcataacccaagagcacatcttgacttcagctttgttatttttagtggtagaggagaggaaacagtaatctgcaaagtgtgagttcaattaccctgacctttcatattgaaatctgaattcttaataagtgttttatgtgcattttatcatttaacccttacaacaaccctatgagataggtagtgttattataccactttgctgaggaggcaactgagacacagaaattaagtaacttgcccagcatttcttgggattctaacctaggccatctggctccagaagctgaactcttaaccacactgctctcctgcagggtcgatgagcttgccatgcctcttggtcattccctaaggtgtggcattttgtgattcgggatctggctaactcatttaaatatggaagtttcacaaagattcaggctgctcagggatacaaaatggctcattggcagggtggggcttccaaggaaatcgatttcattcctttcctaatgggctgcgctagtttgcaaaaatcaagaactgtgacgatttaagatgcatctgaactcttttagatttccatagaacctcactcagcagtcctttcgagatgatgtcatagttcttttgtgtaatctagtaatgccttttaggggaggaagccggtgtattttacaaatgttatcttatccttacaacacccttgaagcttagtaagtgatattagttactgtttgggggattacaaaaattaggttgtggtttttaatgtttatttttatagcaatgagaagtggtacacacacacccatacttatatgcatatttgtaaacatgtgttatgtatattattatatacacgtatgcatcctccccccagcattgatgtgtgtaattcaggtggtatttggttgactccctcctaatattttgcaactgccactaattgtgatggttgttgcactttaaaatgttaaacttttagaatatgtgagaagtgagcaatttggcattggatctagcactgtgtcctcaagtccctttcatgtgctcagtggatttttattgagtgccaattgtgtgccaggcagtggcattacaacagtgaccgaaacaaagtcactccacttgaggacctgaatgtctagtcaaggagctagagagaaaacaaatatatcctctgtcaggtgggggtaaagcgcttctgatgacaaataatgttggctgagctatggtgacatttcagcagaggactgcacgagctctcccaggcttttcttgctctaaagcagtagttctgaaccaggggtgagtttgcagtaactggagatatttttctgccctacctggggcagggctgctgccaggatttcccattcagagtgatttgagaggatctcagtccacctgtaaagaggaaaataccctcttagatttgtagggccacagcctcttttgctgtgcctggaacatactggcagacacctttcctgctggggattttgcaaaatctggggacgtttttggtggttatgcttcggggaagggtgctgctagcatctagtgtgtgaggctggaagtgctgctaacatcctgcagtgtacagggcagctgcccacaacagaatgatctggctcagaatgtcagtagtgccaaagtggataaacctctagaaccacactccccaggggttcagtagactttcccgagtgggcatggaaaggtaaactcaactccctttctgcacgacccctttttctggcccatgagagcctatgctgtggccagtcgctgtgacagaatggttttctgcagggcatccatgctcacagcaggatcagatgccatcttcatgctttgacttgccaaggacattcaccaataaaatgcgcgttcagggagacagctgtcatgacacaacacgtttttcccatgacacacatttcttccgtccctctccaataacctcgactcttgaatgggtgagggacatttcctcaagagctgtttatctgggctttggggctgtcttgtgaattctatttaaaaatactcaaagtccctgagatctttggatctaaataacatactggaaccttcccgtcccctcctctccttggggctatggtaccaacagaagatgaaagctttatttcattttcaaaagtattttatatttctttattttgtaccctcttgataattgatcctcagctgccaggatttcccattcagagtgattcgagaggatgcccaggccacctgtaaagaggataatacactcttagatgtgtagggacacagcctcttatgctgtgcctggaacacactggcagacccctttcctgctccgagtatgcggtaagggggcaagaagctgtatggtggcttctccctggagaagcagcttcagccccttgtgctcctgcactcctgtgctttaagggcgagaacacattggattctttttttttgaggtggggtttcactcttgttgcccaggctcaagtgcaaggcacgatctcagctcactgcgacctctgcctcccaggttcaagcaattctcctgcctcagcctcctgagtagctgggattacaggcataggccaccatgcccagctaattttgtagagatggggtttctccatgttggtcaggctggtctcgaactcctgacctcaggtgatctgcccgccttggccacccaaagtgctgggattacagttatgagccactgcgcccggtgaccacatctgatgctgaaccaaaggcagctcttgggaggtggctctgagcctcccagccgcaaggtaggggagctcaaagatgttttaggagtaagcttgacaagagggtatcaggaaaaattgtttttctttgaatctccccggaatatatcatgtaattcacctcttgaggggtcctagaaagaccacttgccatcccaatatctagccagtcctggagtggacccagtcagagtgcatgaactgtgatacaaggcctatgtcttggtttttttcacctcctgcaagctaggagcctcccaactacccacagattggaagggacttggtgcagggatatggcttcgggtgacaacccacctatcagagctattcaaccattgaacagcatggctgtcagtctgaggtcgcagtgatgtcaggaggtggcagttttggcagctgacagccctcacagatgcccttgtgcagaatgaacctatcaagcattttctctactggctatgaaatggaaagtgaggcaagacattcagttgctgcacaggaaggaaagcagtcagggtggttgcctgagcgtccaggtcccagacaggtctgttctccatggaatacattaagggattgatttacctgtcttggagctgcttcacattgcagtagagggactgtgccgagtgtcatgcaatggccagttatcttgcagaacttgtttgtttctgcaattattaaaagttttcctggcagtttttttgttttgaccgagagtctttcctccaaaaatcattctctccatcctctcagaaccctggataattctctcctgtttgtcgtttgcataccatgtacctggaactcttatgttctggttaagtattctagcataagagagaggaagcaaaataagtcagcagaggatactttcagcatactgtgacttttagaatgttcagttagtgatactaacgtttcatagcctgtaccaataatcaacttttctttcccctgaagacaaagtagcatggttgtgacctatctatactgacttgttttcttcatgcatgcattcaacaaatcttaattgagtgcatgttatgttctaggcgtggggctgggctgaccctctgggaaatgacaagatgaaatgagacacattcctcctttcaagaaagtttgtgtggaatgtagaagatcattcattggttgaggagattgtaaactatcctggaacacagtggtttaggatgaaacaaagcagtgcacaaatgaacgctctagtcagtgaggctccattagaggttcctcaagggtggggactgcgttgagtgtcacgagactcctagggtcagcacagtgcccagcggctggtacgtgctttctaagtatcagctgaaatgctacagcagcacggcctagtggggagggagagagaaagggaggaagagaggggaagggattgaggaaactgacctagattatgggcagtgctggtcccccactctcagcccatgtggcttgggagaatgagcctgtctcttgatgctgtgaactatcaccaagagatcccctaccttgctccccaagttcaccaccaggcttctctccatctcagagcttattgaaaggacatggaatcctctggagggagttctccattgaaaacaaagacaataaattccaagtggcaaatctcataggtggccctgagtccctgtgatttttccagtccaccccttagttgaagtaaggcaaaatttgttttggggtttcataacagtgatgtaagtgcattgctttgaagcagtttttgagggagaggggaaaagcctgagttttggagaactacatttgtggaacccaagaaagtgatacatcttccctcctcccacccctcattgggggagatgacatggggcatacttccctatgtgctttagggggtctctacagaaagggggaaatgggattttgctccttgagtttgctgagggtaggacctgcagacttgctgtggtgccttcagagcaagagggaaagaacacagaaatagataccaccaaaagggatgaggatttcagatggcacacagagcctgctgagcgcatagccatgcaccgctgtgctgtgccttttcctctgacatccctttgcccacatataggagacaatccccttacaaagagccaagagcaagcctgaaggcttctgggagtccagtcggcttggaagtgagggaggaagctgggaaagagtgagcttaggtccgtgaacagtgatgagttcatgaaaatatttgaatctacctgaatagaaagattattttaaactagggaaaatttattttaaactggaagaggctgaaaatataaagtccactaatcttgtctgtctccatgagcttttacacatacgcacatgtgcacacacacgctcgcccatgtaatgttcacttaggtcaagatacagaccaacccaccaccccagaaggagctcttgtgcccctttccaatctctccccaagataaccattattctgacttccatcaattaatcaattttgcctattctttaacttaacataaatgaaatgatatgtgtacttttttgtgtctgactttcttctcctcaatataacgtttatgaaatttatccaagattttgcatgtatcatttttttaatgctgtgtataattccacagcatgaataaaccacaatttgtttatccattcacctgttgatggaaatttgagttatttctaatttttgtttttttcaaatgaaactgccgtgaacatcttgtgcatatcttttggtggacataggcacccatgtctctcagatggataagattcgaattataggttccataggccacatataggtaggcctatttgtatctttatatttgatttgttctattcttctgcccatgacaaaggtagtaaacagggtgtctttgagcagggaggctgaaaatgctctcttgtgagcagggtaagtagatggcttgtgctggtgcagaaaggcaggatgctggagaaatcccaggggaagcatggcaccagtccaaccagagactagggaagactcattaagaataactttttactacatgtaggtccagggaaagctgacatgggaataatgattaaaaggaatcaagtaaaggggcagagaggtagatttaagtaatggaaagatttttggtctgctttctagttttgtcctctagcacaatacgaaataattggctgtgggtatattacaggatcccttagatcttattgtctcatttataaaatataaaggctgtacagggtagttcctaaatggcctttgagctttcatcttctcataattgcatcaataatggcttagttgtaaatgaccaattctagtaataggagaaaatcgcatggaaattactgagaaaagcccagtttacttcatgctgttatcttaacatccacaactacatgtcgagagaatacgaaaatgtgttcttaggcttttccttgttcaaccagtctagccatgtgccattggtccttcaagggcagtggctgagcctcttttcttcctcccccactttttgctccctaccagacaaccttctcccataggtgctagtctgtttcctccctgactcgcattcctgcagccaatgcacctgctggtctgctggctgttgtttctcactcactgaaaaccagatctcaggatggacataggttggtggaccattttcttccagtcattcattcattcacttacagattaactccagttacagtcactgtagctagcatcacatacactaagctatctctcatactcttccagacattgcctaaggctgtggccacccagcccctgccctactgggtggagcccacacttgtgatatctcagagtgcttcctccaaccaaagaacccagccttctgcaggagggacacccctttccccctcagacagtcctgattctggcatattaccagaggccagtctttcctgatctcctcctatcctgagacgttctaggcctccttgagttccagttcgctctttcaagagctgcaccaaaacatctttacaacttgtgtttattatttgctgaagtttagctatcttaataaagaattatacttgtgatgaagtcagggccaggtcagtttgtctttctattcttggttcttagcttgttatctggtatatacaaaatgtttcatgaaaattcttcgtattgaagaaagggaagggttttgccaaaagccctactcaaggctgggaggtactgacgcattactgacacctagggataggctacctaaattgcagggtcatggactatgacaaaacagagtgttagtagtgaacatctcaggtaataccacataactttttaaaggggaaaggtcttcctaatttctataaatagttcaaactttcagacttagaatagtcctgcacttgtggcagtgccctcatagatccagaaagaactgatgttatctgatcttggggaaagtccccgccttgggtttgtaaatatccttactgacggtttctagacatttatgcacgacgttttgtcatgtgggatccagcacatatttctgacctggcgaaaactaagaatatctcaatcataaaaataaccagaaaatcataaaacagaaatctggcccaagattttctctggaaaagtaagaagctgctttgaaaggtgaaaatagaccagtgagcccccgcattggaacagattattccaaaaattgtgagcaaaggtctttttctgtattgtgcaagttaatctcctttgcccctttttgtggctgaaatgcatgcctaatctgcatatgagtgcctgccccaggtgggatggggcatgctgggattcctaaaattcagctggcttgcttgaagagggctatcaggctagatttcatgtctcaacaatttctagccggtctccctgagctggcaagcaccgctcagtttataatagtgcctggcacatggtaggtccagtgtttattaaactaacagatattcccaacaggtgtgggcagcagtgctgctaattagcagtaacatagccgcatggcagggacaggaaaggggagccttctgtgtgtccctactatatgcaatgtatgactccaatctcaaaagaagcagagaatactcagccaaatatttgcattgattcctgccaacaccatttttttgtgatttgtatgttcccttccccaccccccaccccctgtactgttaacttcatatttgaagggggttatacttttaggttatttgtgaattgagtcagctcatgtaacagtgattctcaaagtgtggtcccaaaaccagtgggatgggcatcacctgggaacttgttacaaatgcagattattgggtcccaccccagacctactgaatcaaaaatcctggaggtgggtccagcaatcagtgttataatgagcctaccagatgattctaatgcacattgaagtttgaaaaccaccattgtttaaggatcacaacaaatccaacagcactgtcagaagaacaactccttattctaatgggtcaggtgctttctgtgttggctgtcctgcagagcatctctagtgatagttgtattttcaggattagaggtgcaaaactaatgggagtttaagaaggaagtttgagcctttactgctgggagaatcacaagccaagtttatttctcttccattatttgtatggtagctaaaactgccaaggactactgtgatccattgaaacatcagtgtatcacatctcttcttacatctgagctggcattttgggtgtagtgcttcagtaacagttgtattcccaagcaaataaaatcttagccaccagaaatcttgagttggactagacaaaggcacctctccagatagcagctgttgttggaattgaatataagagatgcttaatcaatgtttgtgtaattgaatagaatgggaaatgaatggctcactccaaactttatacaagacagatgaaggcaacttcgatcttaacctttatgatacatagcattttgtactacccttgagaaaatctcagtctcgggttatcatagactcaattggctatcatgggaaattctgtctcagtgatgctccatatctatttaattgaggtttattatcaatttgaaaaatggaaaattcacctcacatattttaaatagccaagatagccagagtgtatgttgtggtttcaatatgtccccaagagttcttgtgttaggagcttggttgcctttgcagtagtgttgagacgtggggcccttgggaggtgattgaatcgatgctgttatcatgggaatgagtttgctatcttgggagtggggtcctgatataaatgatacatttggctgccattttctcttgtttcatgtgcttgcttccaccttcccccttccaccatgggacaatcctctccagatgcctgtgccatgctcttggacttcccagcctccagaactgtgagaaataaatttctttataaattactgagcattctattatagcagcacagactaagacagtgtaagaaagctcttatattataactctctccttctatttgtattcaggttttctcttaattctggaaagtttgggcagcagctgggaatgggaatttattataagacatcccttcagtgtctctacagaattgctttaattaaagtactttgttttatttgtccccatttaattataattcacatcagagaaagctattgttaaaatattttggttagttcagtgtggggaatgggattttccatcccttgaccttcatgactcagtaaggagcagataaaataattttctttgctgggtgattattatgcctcagggacaagtcatatttaagacctgatagtttgattcaagctctcataattgctgtgcagacagtgttcaaagccaaagtcttcctgatcataaggtgctgagaggacattcattttttgccatcattcagagctctgcaagagagcaaattgcttgttacttaaatgtgttacctttgaagaataaaaatctgaattgacactgctgttatttgagccttcaggtgtagggacttggagcacctatgtataccatggaatgtggcttaacaggactaaactgattccttctgcataatgtgctatatactgatttgcactgtatggagtaaaacctcttcaaccatatttgaaagattgatatttactctaaaaagcctataccttgatgatatggtaaaataatcaggttctctataaccttgaatactagtaagctgtttctttgccttcctaataacatgagggtttttagtttttgtttttaaccagcatttgagtacctactatgtgcctaatagagtcagagtgactcacattaaaattaactagagttaccaaaaatttgtccttcttacacaaatatgcaatgacaacagaatgattatcagtaataaatgtatgtgcacttgcagattactaagtgactgatttaccacaaaaaaggaaaggaacattacttagatttgttgctgtccactccttgtttttcattatggttcagtttggattttcaccacaattcagacatgaaaactattctttccataatgaaatcaggtgtgaggttttttttctcattcttttctttagaaaatgtatagcttaggccaggcgcagtggctcacgcctgtaatcccagcactttgggaggccgaggtgggcggatcatgcggtcaagagatcgagactatcctggctaacatggtgaaaccccatctctactaaaaatacaaacacattagccgggcctggtggcacacgcctgtagtcctagctactcagtggtacatgcctgtagtcccagctactcgggaggctgaggcaggagaatcgcttgaacccgggaggcggaggttgctgtgagtcgagatcgtgccaagagagactccatctcaaaaaaaaaaaaaaaaaaagcaagcaagaaagtaagaaagaatagcttatattttctattaactccaaccaagcaaaatttaaaatgctaggttgcactccttgcactccgtagtgcaacccaatagcaccatggctttttaattccctgagagagagatggtggacagggtgttctgggaaactgctgacagtaacatctgtccataccgaaagtcaagtgaaaacttggttcacatgagagcaaatgaaaatatgatgtttttaaagaggctgggaaaaagtcagagaagtgctcccactattttagatgagctcagcagcaagtttctagtaggtaagagggaaaatccattgtggggaaatgtgccaatgactgtttttggttaaaggtttgaatgggcacgatttagcagaactttacaaagctgtgtcttgaagagctttggaaaaacatttagtgttgttgtcgttgatgattttttttcatactctctgttgttcaggttatatgtgactgaaagaaagaatgatgtagtttcagttacttccatgacccaccccgggctagcacctccttcagccacatggtaaggtcccagaaacatttgatagagaccacatgaaagtagatgcttatgcagatgtgacttttgaaatacattcttcctggctttcagatgtgctattaattgcaggtttaaaagcccttttttgtttgatctgataaggtaggcttactttatgtcaccttaaaatgaggttaagccaagaattgcaagatataaagtattcaatgactactctccatttctgctgggaaaaagaccatctgcttaggtaattgcattgtaatactcaaacctggctgaattgcttctgtccctgcaaacgtctcttctgtcttttacattcacagtcatatatctctcctgcatgtagatccaagacccagtgtagccttttgtataatttgtaggattaatagactctgggtctggcctagtacttatattgtaggtctataaattatcataataacataggtataattgcaggtagagttttatatctgggtctgcagtggtttgatcattgactcactgagaacaattattaatcttcaactccaaggtaggacacacagttccaattggtacataaatagtacatacatttacattacagcagggggacattgtctttgaaagaacatgaataatacgttaaacctggaagctgggagggggacatacagtaagtgggaaaagagatattgcagaaagtttaaaaacagagaagaagaaaataaaataaataccaaagcaagcatgctgatatcttaaattaggtgcaaggaattctttttccttctgtgcctcagagctgcctctatgtggccatatgtgccttgagggggaaggagtatagtaagctttgggaatgatgattcttcatcttgcaggatgtagttgctcgtgttggctcaactcagggtaaatattctagatgattgatgtatgaaatcctaatagtatgccatttaggagtttgtttaccatcagtctccacattcagactttttcttgtgggtttgaatgttctgtagtttctgtaatattgaattcaaaggtttgcttttgattggactttcctaattaaaagcaaatttattgtccctacaccttgcctctacttagcccaatctcacacaccctgtgaggctttttcccagatgttatttctccttcttgaagcttcttataggcagaaactggacctcattcatctttttatcttttacagtgctctcgcaaatatttattgaataaataaatgacataatttatacagtctgtgaggcttacaaataccttctttaagctattagtaaaacaaaagtactggcacaaagtgatttcttgttcatataacagaagtattttactttcaaacacacacacacacacacacacacacacacacacacacacacagaaagagggagagaaagagagagaagcccaacccaacaaaccacttaagggaaaccatgaaaatggtatctttgttgagagttaatgagtttatagttaatttatgctttccctggaatacatattatactcattatgtacaagtaaactatgactgtttttacacctatcacagatattccagatcttaaaatgctctgtttgaaataaaaggcagaaggggggacttgggcatattcccttatagttattcttgtgtctcttatggaatagatgcaaaaaagtctaatttgcctttctgtcacttggcaaagtttattatttgcttaagcacaagaagataaatgttttatcctactggcaaaaagtattgtttgcacaaatgtaaaattctgttaaatgtatttatatgtattgtcttagtcagggttctctagagggacaggactaataggatagatagatgtacatatgaaagggagtttattaaggagtattgactcacatcatcacaaggtcaagtcccacagtaggccatctgcaagctgaggagcaaggaagccagtccgagtcccaaaacctcaaaagtagggaagccaacagtgtgcccgaaggcccaagagcccctggcaaaccactggtgtaaatccaagagtccaaaagccgaagaacttggagtctgatgttcaagggcaggaagcatccagcgtgggagaaaaataaagaccagaagactcggcaagtctagtccttccatgttcttctgcttgctttattctggctgtgctggcagttgattagatggtgcccacccagattgagagtgggtctgcctctcccagtccactgactcaaatgttaatctcctttggcaagaacctcacagacacccccagtgacaatactttgcattcttcaatctaatcaaggtgacactcagtattaaccatcacatgtatgtttctatttgagtgtttctgtaaatgacatgctttagtttttgacaagtcaaatcctaccaaaataccctcatagaaaactcttgatgagagtaatggttatatccaagtcctctcaataacaaatttatttcaatcaatatttaatatcacaaaataacagtatgacaaatgaaggatagaatgtggttaactagtgtagagtgtgaattatttggactggattgtgaagtagatgtaactgatactcatggatgaacttgcagtaattatagataataaaaaattaccagccaagtgctgtggctcatgcctgtaatcccaacactttgggaggctgaggtgagcggattactgagcccaggagttccaaaccagcctgggcaacatggggagaccccatctctacaaaaaatgtaaaaagccaggtgtggtagtgtgtacttttatgtaatcccagctactcaggaggctgaaattggaggattgcttgagcttgagtcaaggccgcaatgagctcaggccactgtacttgagcctgggtgacaaagaccctgtctcaaaaaaaattataatgcgtacataattttttcacacatcaaccactttcctaacaagtcattgatcctcaaaataatcctgtgagtattattctcttctatgtaaatggaggaactgagtatctaataggtgattgccacatctaggcagctggcgtggagggtgttgaagatttgagtccggtgcctttgaccccaaagcctatggctggagatgcctgccaaggcaaaactgcccttaccaaagcagattttatcagctgatcccatttctctctcactaaactgagtccatgaatccttctcaatgtagacaaaatctatctgctatcctgacctatgttatttctaagtgtattttgctgggcattaacgcagatggaatacagccgagtttgcgtaagttctgtatagtacaccaccaagcaccttaacaggagcctgcaaattgccgttgagggaggtaacttttagcatctgaggctttgatgtgtttatcttctccaggaattttgttttgcctcctttgggaggggagaggtcttctgctaagcatctacttcctttatttcttactgcacaagaacttcggtctaattggccaactttgagtgtgctgaggtgacctatttctgtctgggataataaaaacattccagatgactgacgccttttactggggacaatttgacctgattctaaccctcctgctctgcctgccaaggaagatgattactacaggccttagtaccgacctctatttacttcatctactttttttttttcattttcttgcaaaaatagcaggcttgtccaagtgcctagctactatggcaataagtgctatttaaacagatgccgatgccgaatacatgtgtcccagcttaaatgagtcagtgggagcagttgtaggatctgattgcataaatgcatgggaataatgtctgtctctggggcaacagaacttcttttgagcccttgagaggaccagttcagttgcagaaaggctgatgtaatgatcacacaccttcaggtgaaagggtcagtttctccctgaatggaaagtgtcaaaaaatggccatttagactttctgctttgtaactagagcaaatgcctcaagaaagagaaaatgaacaggaaagccctcaaaagctttaaagggcttagaaaatgtaaagccattattgttggttattcaaatatccctctgattcaaatagatgcattgattttttaaaaaaatctacagttaacatcaagaaacttgagcctcagtaaatgagcactgccttatagaatattgctgaatatgtcttgaataagttgagaaagcacttggctgtgtataactactcatgtaaaatgctattggcacaaagatgacatttttttcaaagatgcctctatcatgtggctacaagtagattgtgctgattctattcctctacaaagctcagggtcacaggtggtctattagtagttgttggttgttagctctgccataagaagatggcatggttccttaggttagatgcattcagagttggtggtggacttgagtgtctacttatgcgcagagattttcagtcttttatttccatcttgacagtagacagagaagcaggggacaggcttgaaatttcagtcaaatatcaatccagcatgaaggaggacaccctgattttaaacacccactaatatttccttggaaaaaaaaagagcctaacacatctctggctccagctcttctctcctcccctcccttccctcagcccccaattctcttttcttttcctgtcttcagaatatgtgaaatgggggaaatcataaaacagtcaatcttcattattcacagtttccatatttgtgaattcactacttgctaaaatgtcttcgtaacggcaaaatcaatgctcactgtgcttttgtggttatttgcagacatgtgtggaacagtgaaaaactggagttgttccccatgcatgtttctagttgaagttaaaccaggtgacagccctttttgtttcagccctcatactgtaaacaactctcctttttgtggtcagcttagtgccacattttaaaacatttttctgcttttttttttggtgattttactatttgaaatggtccaaggatagtgccagcctactgtccagtgttcctaagtgcaagaaggctgtgatgtgccttgggaagaaatatgagtgttagataagcttcgtccaggcctgagttgtagtgctgttgctgtgagtccaatgttagtgaatcaacaatatatactcaataaacagtctttaagtagaaacacatgttaaacaaagttatgtatttatcagttgatgaaaatgtgaccagaggctcacagacacctagccctgtatctctccccagagcaatgcttcagtatttgctcagaaccaccacaagtaatgagaacaggctaacctaccccttggagttgacgtgaggatctcatgagctaatgcccctaaaatgcatggtgccttacagtgtgccccataggtgctaactatagcagttatcatcatcatcatcatcatcatcatcaatgaaaatacgggagaagaaaaaattaccaataatcccactattgtacctcaacaactctcttcattttgggtattcccttcagtcattgtttcgttgcattcacatctttgtataactgcattaaactgcatacaattttgaatatttctttgctatcattctgtcatgtgcatcaccctgtgttgcgacacagcctccatttctgtggtcttcttgatggaaagcggtaaaaactttgttcctgggctcatgtaagagcagctctcttcaagcatagggatgacttcattgctcacgacaccaatatgccttaaaattctgtgattaattgtaaaaaagaactctctctgaacactacagagaaaactctcacagagcagagaaatttattatgtgatcttcttctctccagaggaaaatggtgtgttttaagtcagaaggtttgggtcattattcagtagaacgaggtgctcgagggattacaaaagaagagtaactctaatctttgtgagagtgatggcctaatacaggtgttagcaaacatttcccgtacaggctcagatagtaaatgtgttagaccttgtgggccatatgatctccattgcagccactcaactctgccattgtagccaaaactatggataatattaatggataatattaaacaattgagtgtggctgtgttcctataaaaccttatttacaaataaggcacaattccaaacaaaatagatctgaacaccaaagtgggcagttcgtttattgctttattcttccacaaaacttctagtatgttaggccttgtcctggttggcagtaacatcagcaagagtagcaaaacatttttctatgcctcatgaagtttatagtctgaagggggagagagcgatcttaataaaataattgtataaatgaatatataattgcatgtgttgataaatactgcaaaggaagaaaacagtgggaaataggactgtgtcagatattcaggcacgaagtttagggaaggggctgcactttgaggtggccgccagacactcattgaaataagagggccttgatcattgtgcagtaagtgatttttattaacaagaacttagtcattacatacctagctgtaagtagatgctagctctgaagaatagattttcggtggtcagtttggcattcaaccaggaccaaaagagaatcccctcattcgctgacttggggctggatttatgagtgtcgtcactccctttgtattttctttttttgtcttattggtctttctaggcagaaatgaataccacatggttgagacacgcataagattcaggtccatcaggtcttgagcatctttctggtaacttaaacataagccaggatccacatatctaacggctacatgggatatagggcctcgttcataaaaacgcatacccatacttcttaatatgcccttgcctgttcctctttagttctctcaccccctgcaaatattcttcctttttaaaccctcagtttcttcaccaaactttcccagacaacctatccccaaggactttctttatccctctttgccagccaacctgtgtaccccttttcttctggaggtgcactgaggacttttccctcctgcctgatcatctgggcctctctgggctacccgggccttgcagcttcatggttcctccctgagcctctctccctagggagggaagcacaaggaactcactggagtgggcagttctgttcacaccctggtaaatgaaatcctctgcctcattacactctgcagacaatttcagcatccagtcatgcttatttcttgaaggaaaaggactgtttttccaccatttgggtctatgactccactggggattaaggaaagagacaacattgtggaatgtgtgtgtgtgtgttgttggagacagcttttgcttgggctggtatcatgtctactccaggattttctgaagtgactgtgggacaggaagaggcccattggtggctacttagcaacaccaggcccttcacgggcagtggaaagtcactggggtaatgccccagaccctcaccctcaacaggctacacctggacagagacagggcacccttatggggctttcagggatgagatgtgttcatccacaaataagggagaagcacagagacttctacaagtatgtagaggagaatctaggagatacaatgcaagggctgagaatttgggatatacacttattactgttggtgtggtcctagccttacaacaggttgtgcagcccaccaaagcatggattacagtgttaacatgcagaaattcctgattgtacctcttttccagctgttcaatcctacatgaggcctttcaaaacccctgtgatttcttacgattagagatgtaggctgtcccatctagtaaatttgtcaaaccactactgggtatcaggtagaaatagagttccctttcatcactagcaatatgtttcttttctcaatggtttgctctcctttgctcattttccatggaaggtcttcattactcctgtattttaaaagctatcttgtcaatattattccaagcgaatttctcagtatattttaaaagggaaaactaataatgtgatcctcttgcttaaaaccctttacagcttcccaagagtgttagaattaatggggctggtactagcatgcaaaatttaagggaatgtcaaaaaagtcagtagtcaagataaataatatttaatgcactattttaaaaatgttcttggcaaactttcgtccacacctgcgtttgtaaatgaggtttcaactcacaccgtgcatgtgacttgagaggccactgcagcacggccaggcctcagtgcactctctggcctcaacgtaactcccttgaccttccatgttgtattagtcctttctcatgctgctaataaagacataccccagattgggtaatttataaaggaaaaaggtttaatggactcacagttccacatggctggggaggcctcacaatcacggcagaagatgaaggaagagcaaagggacatcttacatggcagcaggcatgtgcaggggaactgctctttataaaaccatcagatctcatgatctgtgacttagtcactatcacgagaacagcatgggcaagacccgcctccatgattaaattacttcccactggttgcctcccacagcacatgggaattatgggaactacagttcaaaatgagatttgggtggggacacaagccaaactgtatcatgtaaccaaatatgttaagctccatccatgctgactttggtggtcatgtccatcccgggcctttatatgggttgtcccctttcttcacatctctgctgagctggcccctgctcatccttcagaactcgatcaagtgctccttccctcttgttggccaccctgagccccaaggtgggatcaggctcctctgctaggtgtcctcagggtggtgcgtgggggtcgttagtgtttgtccttagaatacctggcaagcagacatgcacgtgggtcattttgtttattaacaccaaactcctccagttgattataagctccatgagggcaggactgaatttgtcattcttatcgcacagtggcttacatgtcagtcatcactgaacagttaatggtcatttgatctgatatgcttctggtataatttcatgatatcagatctggagacatgaagtcattgttttcctggtggggagtgtgacaccaccatcttgttcaccatttgcagagttctttcctgtcttcgggcaagtagattaggttatatcgttatctctgtttatagctgtctcaaataaatcctttagaagagggagaaagatggtacaaagaaaaaagaagccaaggaggaaagtgactctcagagatgctaatgactttcccaggaaggctgtcacacagcaagaactcagatatgggttttacaactcagaaactcatcctgttctaggccccaacctcactctctcaggagaaggtcctggaggagattcccctctcactttccagaaaaaggacaaagggaattaggaatcttttcttaacattaacgccttgccaatttctagacctcccctcctgctcctcccttaagacatcctatttgcacgtctctgctcttagaggctattgggtttaagcgccacaataaataaaaggcaataaaataaataaaggcaataaaagatatctcctggtaggatataattttctttctttcgttcactgtctcagagttattttatccttttcaccacgagggactcaattggaactggctctcttattagccttcaggttcaactggcttccatggaggcattgtctcctcatagacctgttcacttgacagaccttcacagaagtttcatcagtataaggacccaaaacaccatctaaatggcttcatccagccatggcagatgccctttgctgctgggttgggtttttttttttttttctttcttttttttttgagatggagtctcactctgtcactcaggctggagtgcagtggcacaatctcagctcactgcaacctccgcctcctgagtttcaagtgattctcctgcctcagcctcccaagtagctgggactacagacatgcaccaccacacctggctaatttttgtgtttttagtagaggtggggtttcgccatgttggccaggctggtctcgaactcctgacctcaggtgatccacctgccttggcctcccaaagttctgggatttcaggcatgagccactgtgcctggccctgctggttttacttctgcctgaaacccactggggtgaaaggacaggccttggaaatgttgcattagtagcaactgctccctctaatgggaggacacatcccttccccatagtcagtgcaggagtcacagaagcttgagcacgacctcaggaatcggcttccattcattcattcaacccatatttactgagccccagtgtgtgccgggtacttctggacccttgggatatgaggtgaacagctcacagatccctgccctcctggagtttacattcttatgagagaaacggtcaatgaatgagtagtcaaataagttttacttccagtaatatgtggtatggagaaaaagaaatgaaggagaacagagataaagtttggtgatggtggaaggtggcagacagggtagccaaggaaagccttgcaaacgaggtgacatttgagcagagacatgacatgaagttctgggagaaaagtttatcaggcaaggtatatggctggtagaaaactctgagtccaaggcaaagtgactatccacaatcagccagaggtcaccatggctgggaagcatggcaggaagtgggaccagggatgcatgcaaaggccaaaacaggagggagttcatgctgctcatatctgttctggaaggacactggagaaatgtgtgtgaagaggaacatgaactgacttatgctttaaagggaccattctgaccgtcatgtgcaatgaatggagttgaggggctagtcaggagtagggcagagagatcaggtgagaggctcctagaataatccaagtaaaagatggaggtgactggattggggtgttggcagtggaggtggtgaggaacggtcggtcagatcgtcatgtattttgaaggcggagttcattcaccattgttgctgtaccagttgtgggctaggaaagaaagcagtgtgggtcaagcatcactcattcattcattgacacatacttgttgaatacctatcatgaacctgcccttgttctgggtgatggctataccggtaaacagaatagtcaaagcttcctgcccttgtggaacttacactttattattttatttttatttattttgttgaaacgaggccttgctctgttgcccaggctggagtgcactaatgcaatcatagctcactgcagtctcaagctccttgggctcaagtgatcctctggccccagcctcccacgtagctggaactacaggtgatgccaccacacctggctagtttttgtagagacagggtctcactatgttgcccaggctgatcttgaactcctggcctcaaatgatcctcccaccttggccttccaaagtgctgggattacaggcgtgagctactgtgcccggcctggtttacattttagaaaaagaaacagaaaataaaggtaaaaaaacaataagtgaattataatacatgttcagaagatatttgttatggtaaaaagaaaaaaatagagcagaagagggaccctggggcaggggagcagctgcaattttaactagggcaaccaaggtgggtgttcttaaaaggtcgccaggttttgggccctaagtagttagatggaagctaatactactatttaatgagaggtctataaagattacacaaataggctgggtgcagtggctcacacctgtcaatcccagagctttgggaggccgaggcaggcggatcgcttgaggtcaggagttcaagaccagcctggccaacatagcgaaaccccgtgtctgctaaaaatacaaaaattagctaggtgtggtgacacacacctgtaatcacagttactcaggaggctaaggcaggaaaatcgcttgagcccagaagtcagaggttgcagtgagccgagatcgcaccactgcactccggcctgggcgacagagtgaaactccatctcaaaaaaaaaaaagaataaagaaataaaagtgggaagaggagcaggctggaggttagggtggggtaaacaagctgttgtcatacttgagtccttgagtattgaatttgagctgtctcttagtgacaataccaagtagatagttggatattcaaatctggggcttaggcagaggccagggctatgtatatacatttcaaagtatcagagtctagaaggtctttaaagccataagaccagatgaggtctacaaggatgagagtggagagagaaaaaagagggcccagggccaggggctactgagtcctcagagtagagagaagaaaagaggaattagcaaaggagatgcagaaggaatagccaggaaagtgggagaaaaatgaggcgcttgaacgaagagctgaagaggtagaaagcaagtcacagcgctcaaagcagcaggtgagatggtgagtgggttgggaaagtgactaggagaactttttataagcgacttcctgagcagcaagtgatcaagttaccctgttgttagctatttgacggtggtgtgtagagtcacagaaaggtggcctctccctgtgtgcccacggaaacaccagggctgagccctttgcgtttgccagtgttcatgtgttcacttaagaattaatattattctccaaggcaaggcagtgggtacagatcgcagaagagtcaataccacacacaagattttgaacttaaatttataggcaatggggatttagataaagtttttcagcaggagagtgacatatgtaacctgttccatgtaaatagtttggggagcagaagggaggatgagttggaggaaggagaggtgatagggaggccattttagtagtggagccatgaaatgggggagggggagactgaaccaaaggagatgcagcgagaattcgaaagcagagatgcgagagacacggagaaggtggacatacagcctctggtacgtgattgtgggagggtacaatgagaggaacattgaagaccactcttggggttctatcttgtgtgactgggggatggagcccactgtgggtttttgctgggagatggagaggagaggctgtcagattaaccagtttatggattaattattaagaaacagcagggacctgggatttcccctcctcactgattagttagctggtaattaggcagtggctgagaatgctactgtctgtcccccatcgggtgggaggagcagagctgagcctccccacagttgctgtggtgcatggagtggggacctagaatcactgctatcacgtgacatgccccctgttcctcctgggaacccaactctgaaggggtcttcttgacatccgattttctccttccagagctcttctgaagttcttgcctaatgaagaaaaagcaagaaaagggaaaatatgtgtaccacagaattttccttctctctggtggtgttttgcaaaaatgccatggcaactttcctcttcaaatacttgggatttgtttctcttgcatctgtcaagtgcacatcaaagttgaattttccactttggaattatgatttgtattctgcttctcccatctgggcttctgttctcctgaaaactgcctattctactgtgaaatgagcattccccaaggctgatgtagccgcttcatgctaagtgttgatgggaaacctgaagctgagttgggcaaatgtttttgagatctgtaaattccccagagacttaaattgcttgaattattgagggacattttgacctcttgttggaccaatgagaatgaaagaaaagattggttaaatagaagaaatgttcagaatccccctcagccctccaaattccaaatattttcttttttctttctttttgtttcttttgagacggagtcttgctctgttgcccaggctggagtgcagtggcacaatcttggctcacttctacctctgtctcctgggttcaagccattctcctgcctcagtctcctgagtagctgggattacaggtgcacgccaccatgcctggctgatttttgtatttttaatagagatggggttttactgtgttagccaggctagtctcaaactcctgacataaagtgatctgcctgccttggcctcccaaagtgctgggattacaggcatgagccactgcacccggccaaatgttttctagttaagttcatatacccatgccagagtgcctagctcacacttcattataaatgtctgcctcaaacagaagtcctgggtccatgtttccactgtcctgcgagggatacacaagaacacttggcaaacgaagaagggaaggcctggggctacagtgggtagggagtaccagagacccaggggacaatatatgggttaaatgaggactttatttaatagtatttttaaaaattaaaattgtgacaaaatttaggaatcagtaattatttaaaaatccaaatattctgcttctcttgaaaaatcagaagacatggcatctcggggcccaaatttctatttggcagttttcagctggaggtcagctggtgtccccctaaactcaaggcatgtggtccccagtgggtcacgcccaccagaatcctctgctgtcttgatagctctgaggtccttcagggatcactggggaatgatgttctcctagaagactttctggatcctccaggtccaggttagatgctaaccaatgctcttaaagtagctatagcaacttttattaatatagataatattttatatttttcatattatataatttttgttattatattttaattgcttcctgacttatctcagtcctcttcagtataatttagtctccataagaataagtacttgttgtgtttgttattaatctccaacatcttggctgggcgcagcggctcacacctgtaatcccagcattttgagaggctgaggtgggtggatcccttgagctcaggaatttaagaccagcctggtcaacatggcgaaaccccatctctacaaaaaataagctgggtgcgatgctgtgcacgtgtagtcccagctactcaggaggctgaagtgggaggctcacttgagcctcagaagtccaggcttcagtgagccaaaattatgccactgcactccagcctggcgacagagcaaaaccttgtctaaaaataaaaaattaacaaatctccaacatcttgcataaggcccaggccataagcagacattcaaataaattaatttactaaataaggacaatagactaaataatccctggggtccattttagttgtactattctattgctctgatgtttctctttaaagaaacagattcatgggttttctattagagtaagacactgtatttgtctctacacatacctgagtaagaatgctttgggttagatccctcttttttggttcgtaaaactagagaagagaacagatggaaaggaccttgaagttcagcttcctaatttgcaggtggagaaacaggctcagagaagatacgtggacttccttcgagtcatatagttgtaacccaggttaggacatgtgcctccagggcagagtccacctgccttggtctctagtctgaaggaacaaatgaccagtgtggtagataagaacaaagtatattcaaagcctataaaagaaaagagacagagagaggaaagtggtactagctgacaaatgtcaccttagtggcaaaaacagtaaataccgtagaggtttataggacagaaattacttcagaaacgtaacaaggtttaagcaatccagtgtttattagcaatggttctctgactggggtgtccaaatgcattctaaggggactttgagttccctttgaaaacagtgaatgtacaatttcagggattttcatcatttctgtgagggagtatgacactttcctggccattgaaggggagaagggaattgatttgtaaatgatgtgtatacacaaagtgaaggcccagtgatggaatggtgatggtttgcagtagtttggggctgtggcaattagtgacattttgtttttacattataaacagtgatgtaattggagtgaaatgccattatccactgcgtcattttaatgcagtcaattgttactggcttcgtatttagtttttacacttatgttggtgtcagaattatagaagagttgtaagcaaaagcactttgcatctagttgtgttagttttgtgtacattgatgcaacattgcaatgaaagtaatctaaaacaatgccaacagtccaagagattttatctttcttttagaaagagtctatgcattattcaagcttgttgtgaatgctgacttcctatagcacttgcatttaagttatgagaagttattggcatgagagataatttaagtggcatgagctcatctgctgtcactgcatgaattacttgggaggaacttggtgtgggagatgtgatatgctctcccctcagtaggtggctgttcccacaggcaattctagattctaagataattctgactattgttttattgactttagaaccagatcctttgtaagatgttatgatgtacagggtctaagtggtggaaggatgtgtctttcctttaatgtgatataagccagagttcagcaaactatggcccatggaccaaacacagcccacagtctgtttttgttaataaaattgtattggaatttaggcacactcatttatatacagatggtctgtggctgctttcacactataaatccttagtccaatcatttcgatagagatcctatggcttgcagagtccaaagtctttattatctgacagtgccctaggacccagggtctaaatataaccatttctgcactgtgctttcagcttctgtgtattttatttgtttctctaaagtgacctaattaatctgtcctattgggataattagggaattctagatggttgttgctttgtggaagattccgtgatttctctaataagggaatctagtctattctcaacatagattcctactttcttaaaataggatgctagaagctagcaagatgctgtttgattcaggagccccacctgccagagctagcctcaggctgcactgtgaatgagccacttgtgtttccacccgtccgccctgcttttcggaacccgcttccttcatcatgtctttgcgtcactgccttttcactccatcctgcctctcagtaacatcagtgaaggctctgatatctcacttttaccaccatttaagttcacttcatttgtccacttcttgcttcttccaagggtgtttgcacttgaagctttttgtccccactgtgtataggaagctttgccttccctgaaaggtttgaccaactcagaggagtggagggagaagggatgagggggcagcacaggacggggagtggtagggacagggctgtccctggaaacacacagtcctcctcagtgactgcacggctcattgcacctcattcctgggttgctgtacagatcagagtctacctcacctcaaaagccccacagtatttgttaaatgtctgggggattccagatacttaacaaataatctttcaatgtggtcgacttatttagggaacaaacacaaaaagactcacacaaaaggcatgggagtcaaatgctctttgggatacttgactggagagggctttctacttacacgtgcctagggaaatagtcaaaggatgaggggggttggtatgatttagggacagttcctagaaggagatacttactcctgaatgtgctctgcttaaaaaaaaaaaaaaaaaaaaaaaaaagaagaagaaaagaaaagaaattgtgttgggcgtaaccacagccttcttagccagcctgagttggcattgctcaccctctgaggattaggtcagccacagtgagctttctcaaggaagtggtgccttggggagcccgcgttggaaagcaatagcagatggctgccgtgggatgtatatggtcctgcttttttaatatgtggagaaaagagacctgcgctctctgtatgttcacatatatcaggatcattatatgttaattgcttattatggcaactgatgatttgcctcctgtttcttatgtgttctgtcagttaacatttattgggcacctactatatgtcgatagaatctgcacagtggcaggtaaagttttccctgtctttaaagagctcaagtctgataagaatgacaactcatgaataattgcaatctaggatggagaaacgggggaattctcccttagaattatatccccctcattgacttcacactaaattcgactttttaaattcagcagtgattatctaaagcctgagctgttcagattgttaaataacagtactctaagttaatctacaagaatcttaattaaagaagtgaatttgggtatgttcaaattataactcagctgaaaaacagtttctctactatgcattcccctcaccaatcccacttcccaaataaactgactgaggtgggataaaagggtccagactagaggatggcaaactccagccccaaggtcaagttacacctgccacctgtttctataaatagttctcctggaacacagaaatgcccactcatttacataatgtctatcatctgtggctgctttcaagctacaaggcagaggtgagcagctgggacagaggttgtgtgtggccagcaaagcctaaaatatttactttttgtatcacaggaaaaaaaaattgccaacccttggtctagagtaaactgaacacccataaaaagtaaaaacaacattattcaccacctctgactggcaaaatgacttaagaaccagcacactggtacattttaatagcagttaaatctagacacatttggatttaaattgaaatccaatatcctcctcttcatgatgaagtattaacatggttagctagctaagaaatatttgaccctcacgtacttaaaatatctcttgttttggtgtttgtgtacacaaattagggaatacaaattatgttcatgaagtaagtcatcttcaccaacggaaagaaatattctccaaatcgctgagaccatgcatcaaccctactgcacagttagaagaagggccacattaattacccgaggatacagaatctcttaggaagaggagtggccacagagaacaagagcatatatagtgcatttcagagaagtttctcctgccctccagattcccctgtggacctactctgagtccattctgcaagggggcatttctgcatttgagcagctcccgttcttacccattacacatccctgtgtatagggggcttcaggaagaacttacacaaccaatcgatggcctcagtttaatataacatttaaaaatatctcgctctcctgattctgtagccaaactcagaatcatcaaggccacttcctctcccaggagagtaagcaaacttactgcccagatgtcccccaaagtgtctttgccttcaactttgctgcaggctggaaaggctgtttctctacaaggactggagatgcaaacccttggaggggagggtcctggggagggcaggcacgtgttaaaaagggcagtagatgaaagcaaatgtggctgcaattgtccgcttctgcttgaacagcaagtctgtcccatgctataacagggattctgtaggatggatcctgttttttgttttgttttgttttgttttttgaggcggagtctcgctctgtcgcccaggctggagtgcagtggcgccatctctgctcactgcaagctccgcaggagaatggttcacgccattctcctgcctcagcctcctgaatagctgagactacaggcgcccgccaccacacccggctaattttttgtattttttagtggagacagggtttcaccgtgttagccaggatggtctcgatctcctgacctcatgatctgcccgcctcggcctcccaaagtgctgggattataggcgtgagccactgcaccctgccctgatcctgttttttagagaaagtagattgttaatccgtcactttatgtattgtctctaagatagcatctatcatgtatataggcacaaatgcatactggagtgaattcataaattaatagatgaattaagacctcagactctggagacaagcaaaattgagtttaaatcccatctttgccagttaatagctgttagttatctatcgctgtataacaaattgtcccaaatttagtggcttaagttattatctcacagcactgtgggtaaaggatctgggtttggctttgctgggtaccaaggctgcagtcatctcaaagcttggccaggtggggaaggacctgctttcaagctcacacatgtggttgttggctggcctcaaatccgtcatggctgttggctgacctcaaatccatcatggctgttggctagagacatcagttccttgccacctgggcctctccaaagggctgctcacaacatggtggctggcttcccccagagaggggaatctgagagaaagatccaagatggaagctacagtgtttttgttttcactgggaatgtgggcaaggcattgaaaaagatttttgtgtgagtgataaaatatacacaacattatttgctattgtaacctttctttctttctttttttttttttttttttttgagacagagtcatgctgtgtcacccaggctggagtgcagtgatacttccttggctcactgcaacctccacctctcgagttcaagagattcttctgcctcagcctcccaagtagctgggactataagtgtgcaccaccacacctggctaattttttgtatttttagtagacggggttttgccatgttggccaggctggtctcaaactcctgacctccagtgatctgcccacctcggcctcccaaagtgctggggttacaggcatgagccaccacacctggcctattgtaaccacttttaggtgtgcaattaggtggcattaagtatattcactgtgttttacaaccatcaccactatttatttctaaaacttttcatcaccccaaacagaaacttgaagctacagtgtttttgcaacctaatctcagaagcaacataccaccattctgttatattctgtttcttggaagcaagtcaccaaacatagcccacaattccagggggagggtatcttgaaggacaagaagaccaggaggaagacatcctagaaggcagtcccagaagctgcctgccatacaggctatgtgaccttaggcaggtagtaacctgcctcagtttcaacctttgtaaaacaaggatgatatcttagtctgttcaggctgctataacaaaataccataaactgggtggcttatggacaacaggattttatgtctcacagttctagaggctggaaagtccaaaggcaaggcagagtctgtctggtgagggcctgcatcctcacaggtggcaccttcttgctgtgtcttcacatgatgaaaggggcaaggggtctctctcaggcttctttttaagggcacttatttcattcatgagggctctgttcccatgagctaatcacctcccaaaagccctacctcctaatgccatggcctaggggttaggatttcaacatatgaatttcggagggacagaaacattcagacctagcagatgattttgcctgcctcatagtgctgtacttatatccagggggagcacccccaagtttctactctttaatataagattaaatagatggccccaagccatgatgtttggccaccatggactccaggcagggttttcctgcacggcttctcagatcttcatggtgcttcagcagagatcacatctttagatctctgacagcatgagcagatagagggcagagcagaggcagaactgtggcaatacaaaatatgattcctacatcttcttcccagtacaatctttatggggagcagagcttcctgtaaggaaggagaagcctcccctggacagtgttgagctcccatgtcctcatcatatctcctctgggagtggatccacccctccctcagttgctcacattcaccaccaagatactatccttgtacccattatggtttattctctttcttccatgcacattcccagtatcactttaatgtgtccgccctctttcctggtgagctgtcctgtgcagtgaataagaaacagttacttcccctggagggcttgcatatgactatgcaacgtgcaagcaggctgcttttaaaactattatttaaaatttttcaaaatggtagtatctctttccatccttgtcccctctcacaggtcaaacctaaacaattcagggtctcattccaaacaccagctcatggatgtgttctgagccatcatatattccagccatatctttatacttctgtggtcctgtggaatagtaccaatccagatccttaattagctgaaaattaattcagatgattgcatatttaagccaaagaaataaattaatattgtgtgcaaaggtttctggtgatgagtattttggaaggactgttaaacacatttgaaataaaaatagtttactggctaaggctcagaaaaaaacaaaaattattactgatcagtgttttctaaagtgtgttctgcagaccgaaatgctgtttatttgcccactgaccaaaattacattgataatctgtactaatctcatcagggttgatgagaatatggtaaaacagtcatggactgttttctgctgggagtataaattggacatgcctctaggcaagcaattttgtactatttatcagaatttaaaatgtatatgccctttggcccagcaactctacttctagaagttaatcttaaatcattcttgcacatatatacaaggggctttattgcagtactgttcatagtaagaaaacgttggaaacaacttaaatgtatgtctataatagaccaggtaaatcaattataatatgcctctactcttgaatattgtacaacagtcaaaataatgagcaggcttggtacaggggcttatgcctgtaatcccagaacttcgggaggccaagatgggaggatcttttgaggccaggagttcaagaccagcctggtcaacacagtgagacccccatctctaaaaaaataaacagcccacctgtatgtattcacatggaaagatggacatagtattttgttacctggaagaagcaagtcgtagagcaatattttaatataattacttctataggaaaagatatatacatatggtattatatatataatttctgtgtgtatgcacaatattgtgtgtgtgtgtcacacacacacagcatgttttcatgctgctaatacctgagactgggcaatttacaaaagaaagaggtttaattgaacttacagttccacatcgctggggaggcctcacagtcatggcgggaggaaaggaggagcaagtcacttcttacatggatggcagcaggcagaaaaagagagtttgtccagggaaacacccatttttaaaaccattagatctcatgagactcattcgctatcatgagaacaatgcaggaaagacccatcccataattcaatcatctcccactgggttcctcccatgacacttgggaattgtaggagttacaattcaagatgagatttgagtggggacacagccaaaccatgtcatatatgtatatatataaaatacatgtacaaccacatagatttgtttggaaggatacacaccaaactgttaatagtggttattcttcctcttgagaaagaaatagaattttctagagggtaggagggttgcttcctgctttgctgtgtatccttgcatattgtttgaattttttataattagtatacattgcttctgtaatttatgaaacaatttaaacatctcttaaactcatagacataacatatttatttttaagcaaattaagaaaaagaaccatgtaatctctctgcccaaatgtaattactattaatcttccatacctttttctatagatgtattgtttgtttttaaaaaatgtaatttttccatttagaccattttgtaatctgctgcttttatttcacaatatgggataaatgtgattattccctgcatatttatgtgccagtagatattcagttatatttctaatgacttcaatgttatggtttttaggtatatgagattactggaaactaggcatttgaaatgggcaaggtaaattcctagtgcaatatcctgttacctggcttcttgctttcatcttgttcatccgtacatctagattgtccaccctttatgcctaatctctgtcattgtcttgaataaaattttccatggctgcccattgccctcaagataaatttctagtttccttagatagattgcaaggcccctcactttccagttcatgtttcctctggcacatctttggccaacacctttatcttcaactcccatcaacagctcacctcacccaggcttattctcactctgccttccggtttcagctccaatgactccatttctgattcagttacttctctgtttctcagagcatcttccacttcttccatctcttgtttttgccacccaataggcactctcccttttcctgacaaaacagttcattgtgtgtgagagacttcgggcaaggttattaagctgtccacgcttcaggcttatcatgattcatcatctattaataggacaataatagtaccgacctcctgagattgttaattggaggaagtgaatgaatatctctcagtggattagaagtgcctggggcataataagggctctatgtgtttgaggctgcagttgctgtaattggaatcatctctcttttactcagtccacctagtttggttgaagttggttctaccctctgctctaggggttgctaaggtaatcagtaaatctcatccttctagatcctgtgatgggttcagaagagaacacaaaacccgatttgagccagtgagagtcactatgaagactttactttctgaaggagagaaactctctatctctaggcatgtgcataatgcatgctaggcttactgctattggagctgagacattgcagatggaagcccatcagagcatggaaccaacacagagggaaacacagctgagcaaagagagagaagtcctgtcctggtgatactgggatgagcctttcatgaagcgatgcctgaccagctcttcctccaattcctcagtcgtttgagccaaaatacttccttgttgcttaaaccactaagggttaggttttctgtcacttacaacccagagtttcaagagatatataccatgtcttaccaacatcataccttagtataatggtctttctattgatctctctgctgcatgagaccttaaggtctgtgaggacaggcctgggtcctatttccctttgtatctccagcttccaacatagtgcttgactatattagatgcaagtatttgttgaatgaaaaaatgtctcagaggctaccttgactatttcagcataacttgttcaatgctactggtttatccaggtctaaaagtctgctaatcgtatcagcaaggcataataggatgggaaaagaattaatattattgaatgcctgtcagtaactaggtaatgtatatgatactttacatcatgtcttttaatcagaaagcataattgctttctcccttcctgctatcccatgataggtctattactatacttccaagtcagtaaaataagaataatgaaataagaatatcaatgaaataagaatatcaatgaaataagaacaaaagtcagatgtggtggcacacacctgtaatcccagaactttgggaggctaaggcaggtggattgcttgagctcaggagttcaagatcagcctggacaaaggtgaaaacccatttctacaaaaattagctgggtatggtggcacacgactgtggtcccagatacttgggaggctgaggtgggaggattgcttgagcctagaaggttaaggctgcagtgagctatgattgtgccactgcactccagcctaggtgacagagtgagaccctatctcaaaatatataatatatgcgtacgtttagtatctaacaagaaaaatgaaaggcagataaaaagtatacatattctattctttaaaaggcaataatcatttgaatcttttgagttcaaaatgctgtgttttataaatttataaatgtgtctataaatttttctttctatttcttctacttcttcttagcattgaagtgagcaattttattaaaatctgccattttggtagtaaaacatttaaattcaaagtcaccttaagtgagtgatgtgcttgttgccagccacttaattagctgggggatgtgacacagttgtctacatgcaggacaatttcaaggtcactggtggaaaccctctcacctccccatgctgccagcttattgtcccatacatggtaacattcagatttgggactagatggccaggagaaaagcactgagtagcctcactccagaaggattttttgtgcttggctccctgacttctcctttcgttcagggagcatgcagtggtgagaacacctaaatcatgatccttgtcctccatctataactaattcgtattgttttaggttagtttctcagagcataagaatgaagactgtagtatggcccggctctttcttaagaaagcactcttgatgaaacaatctacataagtagactgaccagttaaatatggttattaatcattcagttttatctgcgtaatggtcttatcaaaactaattattgccatattaggtagatatttagagagcacccttttatggaccaaactctttgcagaatacagatactcaggaagaggatctcttgtcttgaaggagctgaaaattgagttgagttatcccagaatcgcttttttcctttagagttggaattttgacagatggagaaaattatctaataaagtgttcaaaaacttggttggcccgtgtgggttgaggattaatccgttagagccacaggcagattgagcacactattcttagctcagaagaagcaagttattcagagaaggatgagagatggcacattccctctagttcctttttgctgctagagaggtgagcttccaggggctcctagttcaggttgcttgtatttttttcacctacatttggtctccacaagccttcctttcatcgtcagatttgtccaaaatttaacacctgtgtgtgtctaatcaaggaaggacatgatatcacattatgagtgtatttaggtgagaagtcattgaggaaaataatgtttgtcatttgaaagaaagaagagtgttttatttttgagtcacttcaggtctttgtcctgaagaacagattcactcttgtttaaactctgtctcagtgagaatgtttgcggggatgggaggtagcacttcccattgcatctaatcatctagaaaacaagagactacaccttaacagtgcaaatccttttggaattgatctacctggtcttctgctttttcctttctccactctgctttgtcctgaattcccagaaatgccatcttaaaactcttctaaaactgctggctactctttcccctgtttttttctaccagtttttttgtttttgtttttgtttttttttaaaccatcatataaagagacagcttccaaatggtactctgtaattgagcaataaacaacaaacttttgtctgtatgtatccatactaccagtcaaaatacttaataacaaaatatcaataaaaaatggccaatgtgacatttttcatcttgtgtcaaaatcagaaccctttgttttaccatttgcttttaaatctggggggtacataaattcctgagaaaatactaagcatatacatcaaagaaattcagacaaatatatgtgaacagagcaggtcactgacactaatcttggccataacctagagttattcagaaaagatgtccagagacaaatcttggaggttttgaagaatcagaaagataagaggaaaatctggatacagaggtatcacagaagccaaggaaagtgttttaaaaaggaagacgaggtcaacagtgtcaggtgcagctaaaatattaagtataaagaggactgaaaaatatgtcttgaatttagagacttgaaggttattagtgaccttaacaagcattgtttttggggagttatgcagctagaagtcaaactggtaggttgaggaaggagtggaagctaaggcagttgagctgtgggtacggacacttccttcagattagctgtaaagacagtagtaatagaacagtggctgtaggaggataggggactgaggactaggaaataatttattttagatgggagatatttgaataggttcaaagcttattggaaggattcagctgaagacagaagtccggtaacaagagagaaaatataatagaatagataatgttaagttcccaagatccacaatgacccccaaacgtaagaatcatcttagaatagacttgggatacgaagttcaactgcaaaataccctatttttagacagcctccgaatttaggaaaccatgtccagcccagaggaaaaaagaagagggctgagttactattttctccatgtttgattctaaggaatgtagcattatttggatattacataaaaccttggaaaataagggaaggggcaggccgtgaagatatgtgcaattaaaattagaaactagacatggccagtaaattgattacaagttaatctagctttgccataacctgagagaggtgatgtagtcaggaagttaggttttatctcaggttggctttctaaatattgaaagctgtcaccaaagaaactagcatagaaccagtacgttacctgggggagagcacctagagccacagatgttggtgtgcctgagaaagtccagaattttaaaaataaaattagaatagctgtgaccggcagtaccctccagactcctcaattgcacacagctccctttgtgtccattttgaggactcagcaccaagacttctaagacatgaagcactgggcaatgctttggggacatgacaatgctaattatgctaaatactcatgatatgttgtctaatattgatattgataacctaagcaaagacttactttagctaagctgaccttgctgaattgcctgtgttagctgccaacaatgtcaacagagaggagagtaatggtcaaactggaggcagatagtgttatgatttatgaggggccatgaaggcagtgtttttgtccatgggagctgtgattagatgctgtgggtagctgaatacagttgagatttttcaaaaattggcaggcatgttactttggaagttctccagtgacacatcagagatttaattattacagttttgtattcttgctttctgtgacatctctcccctttgtgcttaatcaatgtttgtttcccagtatgtgtttgtcactattattaattttggaagatacaaggaaatccccaaatcagtaaatgccctctaggagtgattctctagtcttgtagttggacacaaacccacaacataacctcctttgtaggctcatgcaagaggaaaggaattcagcatagtgatggagtaggcccagttccaaggatgccactgggtatcctgtacatccagagaggaacagggcaacttcctgactcttttacgtcactttctgaaaggaaagggaacgtttcaaagtaggaccatgcacagatacctgaccacctatccctttttaaagtcccacctgtcaagtctctacaccagttgtattgcattacctgggtaaaggagtcaagtgggaaggggtggagggtagtcccaagctaatgagaccagcattcccctgggttattttatagtttatcttattaatcctagaagcttgactatgaggcctgtgttaggaggtttctccttggggaaagataatcttaccaacatctttgggctgttttcctaattcttaacactactcctgtatatttcaaactgggagctatgaaatagacaggtttgcctctcgagactttctatgaaagcttttttgatgttactcctgggagcttctcagtgggccaggaaagaggccccaaagccacactgtatactaggctaagtcaccacatgacgtatgtaagattcacagaggatcctcttgttcacctatgacgaggccagacacaggccctccaaactccctttctctgtctcataaatgattagctgaacgtttacccccctgtgatcaatctggacaaaatacttactaatttgatttgaccgctgtagtgaagcttgtctcctcctccacagcctgtaaactttgactcattcctgaagctaagcaagtgttggaactgggaacaacccctccttaatggcccttcctgagactctccattggctgcaaacaaatctttcttgttcagctgtcacatcatcccacgtgtgcatcccccatgcctagctccttctagccatgtttattcctcttcattaaaagagaagccctttcagcctgaccatctggatgtttatagatcttatggtcagagtcttttccctattgcaaaaatgatcctgtccatttggcgtattctttaaaagtaaagtctgtccttacctaagtctaggtttgtttttatttgacactactctctatattttggtatttaatactgtgtacattgaacacgatcttttcttgatgacctagcttcatctttaagactattatcacattgtgctgaagaggtagttgtcagtgaggccaattctgggtgggatattggctgacctggcactaatgctggagccaacttatttctgggatagagcagctacttttgttttatgcattttgagttacattaaactcatttggatagagtataatggtgacctttcacttggccagaagaaaaaaaactacactgtttattttcttatttttttttttttttttcactggggtctcactctgtcacccaggctggagagcagtgggtgcaacctcggctcactgcagcctctgcttcctgggctcaagcgatcctcccacctcagcctcttgagtagctgggaccaaaggcacgtgccaccatgcccagctgattttttgcatttttgatggagatggagtttcaccatactgacactgttttaaaaataatcctagaattcgtaactttctagcgtgtgtatgtataaattacaatctgttatgtttagaaattaacaagaatcaaataatgaagctaattttccaaaacgtgattgagctacaatgcaggcgtctgaccatcttatttttagcccccaaggcatgcaaatgttagaagaaaaagaatctttaaaattgcaattgatagtaaaattgcttaattatatgtataatatgtggaagaatatgtatatacagccatttatcaaaaaagaggtcaggaaagttgggtgcagtgtcacacacctgtggtcttagctacttgggaggctgaggtaggagaattgcttgagcccaggagtttgagtccagcctgagcaacatagtgagacactgtctcttaaaaaaacatggggagtagggtaaggaaagaaccaggtaaggatggaagaaaaccatccagccatgaggacttacagagcaatatgatagagaaattattctcatttcttaatataaataagaaaaatgagatttgaagatttgcaatttgcataaatttacctgacttgtaagtgccagaaccagagttagaactctgttattctattttctggtctatgactgtcatcaggacactgtgaagcctttcctttagtgagttccaggtaacacagaccagaaaacagtcctaattgtattcgttgttgttcatgtcactgtcagactctacaacttgttgcttccattactgatttcaataccaggggctgctatccactcttctcttcctccttttctaggaagccttactgttcaaatgtgtaaaaactcattcttgacttccagccaatcagccagagacatgaccttcatgcagaccatcatctctttgaggctgtgtctatttctgagtgcttggaggctgctgctttgctgacggggtagagatagaaagaaagggactgtttctctgtttctccctgttagaaatgcttgttgcccagtgccataaagaaatagcacttgaacataaatttaatttcctcagcaaggccattttttttactttctgcagaaagggtacactcaccagcagttttgccatgaaagtacaccaaacaaaagaggcagggtcatttataacctgatgcgtccaccctactgctgtgtcccgtttccattggctggaacgggacctcacattctgtatttgtcctgattggctagcaacttagaactttttaaaagaggcaaaggcagaggagaacaaaggaaggaggaagtaacttgtggaatgccgagaaaggtaaaaacaccttcaaataaggaagaggaacaggctaagacctaatgcttgcttggaccagtgtaagcatgccagggcaaatatttaggctaaattgtgggagctaagaacataaagtacattgatttctttattatggctagcagatatttaagaatgttagcacaggtctttgaataatttttgcttctaagagaagttactatttattcctaattagatggggaggaaagtctttgaagaggaacccctactttattttctatactccctcaccttcctaggtcgtctgaaggtttcctgaggttctggaaaacggaaagtatcctaaatacttaaatagtattatatgctaccaattaattgtccactctatcatctaaagatctcacgacaaacagtatatggaagtatatgtttcaccttattctgtaggtccaaattctcttttgagaattatgtggacttcagagctagtttgtttcatggaggtagctagtttgtttcattgacatgctgcatgcctcacttggtaaggctcaggcctcgtccagagcagggtatagcctttggtctagccaaccttgctggatgttgtaaagtattttagctattggattatgctttctataaatgtaaagatgtcacgggacctcaggtgtattcatgcaggctttgccatttatcctagctccaattagttaccgcaggtacagcaaaacaaatgtaaggcaccgcaccaacacgaggaattatcagtcttgttactaagaggacagaggaatccctaccatgtagggtaaatttctttctaggccctttaaatgtgaaatgtaataaggcaatttaaagatcatttcactaacatgtaaaggaaaatacaaacatgtgcacatctaattgcaggtcttacaattttggttctaaggaaaataattaacataagctcaaaatgacacttcctgcctgggaacagttctggcgaaataatgaacctgtagaaataaaattgaagagctaatcagccttgaacggcgctgaggtgtgtgtttctctctctctggttgctgttcatctcttgcttgtctctctgctttcccctatgcctttgatgagacacataatttttatgttgggcgacaaggtgacagttctctctgataattacatagatgagaatatatttggttttggaggaaaaaaatttactttacaaatgtatatatagaaataactttgaccttttggtaaagataaccaagttcttcctcagcaacagaaaaacaggcacattcggaggtgtgtgtttcattttatagtggtagctcctcctaataaaaacctttgtaaggaaaaggacaaagttgttggttcagggggctagcggtagaccccttctcctaacagctcaaagataaggtaaatcaaagtgccccccaagagttaaatgagagaaaacccacatgcagtggatagcattagccgtctgtggtgggaaaggaacagattgtcaatgaatgcatggttaaagagtttgagaacacccaaaactttaatcaaggtgatatgggagcaatctcatgaaagtagaatgggaggatggttgcatttagccattacaacctcatcagttgcattcccacaggaagactgcctggatattaagatgatgtcatcacagagctgggattctcacagtgtggtaagaagacctctagcatgagaatctcctgtaaaaatgcacatcctagggctttactgcatagacaccaaaaatatttggagtgggctcaaagaatctgcattttgtttatattcaactgaattttcttttttatagtttttttctaatttaaaaaaaagtaacacaatatgggctcattgtaaccaggaatgcaaatatgaggaaaggaaaagtaaatcttggttgatccttctttttctcttaccctgaggtagcaatactagtagcagttgttactagcaacaatactggtgagcatgagcatccttccatgccatttttcacacttacaaacatatatacatttttaagaggttttattttttgcttctcttgtttgtttttatatactaggtcatattataaaatttggagatttacttttctcaagtcataatgccaaacactccaggtattttaaaaatgtatgtacatctatatatgtattcacacacatttacacatatacatacaaacacccacatacatatgtgtgtcaggttgcttgaaaatgcagcttaaaacccatttagggctaaatactggcacagtagtccagtatcataaggaaaagttgaaaaaaactttgaagaatgacattcttttaaattctatagttttctatggaatggattattaagatattcaagcgtgtcccataggtgaacattcaggttgttttctattgttgctgcatgtgttttatttcattgccattacaaatgcctttattttggggatgatagatgagcagaaatgggatttccgagtcaaaggctatgttcattttaaattctattagtattataatatgactttcctaaaagcttgaggtaaattacagttgattatcatgattccacttagttatgtcctataaaatcaccttgagcactgaagtagcagacactgactcactgtgttaatgtattaatatgttgtatcaatatattaatattgaattaatatgttgtatcagtatattaatattgaattaatatgctgtatcagtatattaatattaaattaatatgttgtatcagtatattagttattaactctggaggaaatacagggttaggtttctgcaagctccttgtcacacatttttcaacccatcaatacataaccttgttttacatgtgtttctgtttaaatacatcttatttatttatttatttatttgagatggagtctctctctgtcaccaggctgtagtgcagtggcacgatcttagctcactgcaacctctacctcctggattcaagtgattctcctgtctcagcctcccaagtagctgggactacaggtgcacaccaccatgcccagctaatttttgtatttttagtagagatggggtttcacgatgttgtgcaggatgatcttgatctcttgacctcatgatccacccaccttggccttccaaagtgctgggattacaagcgtgagccactactcccagtcagcttatttattacatattattgataacctagcattgaactcatggccagcaatatgtcccatgcctgaacaatgcttatctaacacatggactttctctatcaggcactttacagactaaagtgcctttactaaagtctgtaaagtgcattatggagaaagtccatgtgttagataaggattcagccctgtgcagaaaatgtggcattaaattgaccaccaaaaggatactaatttacattatgagggtgaaacaagaaaggagaatgtcatcttgttctgcctggactgggaacatgcatgctgggtgaccacactgcacgtgaccatgaatgaccacaaatgatctccaaagtgccacaagtattggctttggggttacaaatacatttgagagtgtaggcaaatttgtgaatacagaatccacaaataataaggattgactgtatattcccaccagcaaagtgtttgtcatgttgattattcttcgtcttcactgtttcattttttaaaatatttgtgaaattttaggggaaaactatttcctcgttgccaactaactagtgaagttcagcctattttcttaatttattacacatttaaatgcaatctttgataacttacctgttattatattttgccctttttccaaccaagtgacttaatttttttctcatcaattcttagaaactgtatattagggatatcaatactttgttatatgttatgtaaatacttttttattctattgcttgtcttatttttgttttgggtatctttgctatatgttttaatactcaaatatatcaaccttcctcttgtgatttaaggtctcctgtcttattgtatctccaagactacatagaatttcacatttttattccaatatttttattgttacatattttgcattaaaatcttgactccatccagaatgtttttgtttctagtgttaggcaggggtctatgttcattttttttcttccagacgaacattcctcagttgttccaaataggaagagaggaaatcaacctctccatgtttgcagatagtacgattctctgcctggaaaaccccattgtctctgcccaaaagctccctgatctgatacacaacttcagcaaagtttcaggacacaaaatcagtgaacaaaaatcagtagcattcctatataacaacattcaagctaagagcaaaatcaagaatgcaatcccattcataatcgctacaaaaagaataaaatatctaggaatacagctaaccaaggaggtgaaagacctttacaatgagaattacagaacactgctaaaagaaatcagagatgacagcaaattgaaaaacattccacatgaattttttttttcccatctgaattgttcctggatctacattatccatgcctggtttccaggccctctcagagattctgtaaactacttatatcctttattgatccttttctacttagcctggataaagtagattatgattttgcaactaagagtagtaattggtgctggaaatatttgtacctaatggactgtcaagtaaatgggaacctggggttagctatttaacatagttgagtttgaaggcatgtggagcaaaacatttccgtaaatattggctttggttaattggagtgaagtgcctactgaaggcagcattttgggaaactcaagtggctgcttccgtatagtattttaagaaacgtggctgtactggctacatggaattgtgctaaaaatcttaaggaaagaaaaataaaacaggctcaaggttttaaattattgcctcaatgtagtctcagaaaacaagagaagttttgactggcctaaaagaatatcgtcttttatagcaacaaggttgatgaacttgaacatcaaacatatgctctgattctgtgacttattgaattacaggctgcattgaaagattggctgtgtttcttaagtgaaatttaggacattgggaagaaaagaatgggaccctgagaattagagtagagacatttgggaggattcagatgactcacactcccaacctccctaaatcctccttatcagcagcagcagcccttatcctctgaaggacacaaacctgtctgaagaccttagaaagaccttgcctagcttctaagaggatgccagttcctcatcactcactcctatcttattacctctacttatctatttgaagtcagatcccagtgtgtcccagagatttaatcataaagtcacaccttgggagaaatatatttcttctactactgccactgctattgcaattttttacataccaaaaaatcacaagattttgcaatttatgtctacaaaatttgcataaagttatccattgctcatcctaattttcttcctaactaaaagggacatctgtttttgcaatggctctagtagaatactacatttcccaagcttcctaatatctaggggtggccgtgggacctagtcaatgagacataagtttaattgtactgattattcctaaaaaaaagttttggtatcctaagaactgctcttccttcttctgcattcttccttactgcgtgggcttggtcacaatttctggaactatagaggtcatcttgcactcatcagggaaaggccagaagaattgctaggacttccaatctgacatttttaaacccctgaacaagtgacgacaatcacttttactttttttttctgtaattaatggaagggaaacaaacctaattgatacattcagccaaacacaatcatcagcagtgatgatgcaaaaatgtagcaaagacatagaaagcacctattttccccttgaaaaagtgaaaattcttgagtttcactgattttgctaatttagatcccataccaacactttattcaattagtttggccagagagtcgctgtgtgctagttggcttaggccagtagggccctccctgggagctggggtcaatcccattaaccccacttgtttgcagctccatgggaagaagtgctaagaagaaaaaaggagatgtttggatgtgaaataggtgagtaacatgtccacttcatccctattgtgaatatgtcattaaaatttactactcttattccactttcatggtcactgaacaatctgctggttggatttgacttctcatgtaatttataagagggatatgaactaatcaactaatactagcattgtgatctgattgctggtttagttaatacatttacatagacgattttatgaatcagcatctctgtctgagcttagttaatgtaagtactccacccccacctccaagagatctgctctgcctgtgatgacaagccaggtcttgagtctgtaaggatgttcagggccagatcccagaacagggaattctccaggtaaatggcatcctgcccactcactgcctggggaactgcctttgctgtactttttagcttctccttgaacccttgaaactgttgtagatgtcatgagtgttatttttcttcatgtaagatttcagcagtagcatgtgccctgtctccaggagtaccaaagataccatgcagggtgggacagagccagttcccatcttcctggagtcaacatgattctagaaccttcaccactatagattgtcatcacttcgattccatttaagagtgctgtggcagatgtaactagaatgataccaattgcagaaatgcagggtgagcttgcaaaacaaaaagtcattgattctgtaacccataggctaccaagtgtcatgcaaaacatctggggtatagttaacttgccaatatttattgagtacaataagatgtacatctgactaatagagatgttattagtaatactcaataggataaagagagttctggatgggaagatagaagctacactgctaagtgctaattttctttactatggatgcctccatgagcaaatcacttcaattgaacggccttcaagtttttcacctccaaaactgaatactgtactcacaatagttaaatatttcctgagcagttttatttatctcattaatttactttaaaaggcctttcttcgtatcacaaactccaactggattgtggtttctgagcaaattataacaaattttgtgtttgtggaatccaaattaatgagatttaactgcatgctaattaaaacgccttagaattctgcaaagactttcccttcaagagttcaaatttgttgatgaaattttctcgttagacttcacaatgagtgtggaaaacaaatgatcagtctgtaagccctaaaaaaagaaaaactttaagatattcttcccaggttttaataacacaacctggcagcaatggaacaacctcacaaacctggccttaaggttatcttgcaggttaactccctctcttaaagagattcttgtaatgatttaaaaccaaatggcgacgtagcattgaggttcaattagcggattccttagttgggtcttgatcacatctctgattgtcacctctaatagggcgtattaaaatttccattcattatagtcattagtctctgccagtgataaggttgtgaacaaatctgttggtgttcaacttctaatttgtgtgataatttgtttatgcttagaacacttactggttgtggatggagggggtgtgacccatttagaaactattcatgtagataaatctggaaagtttgcctggaatggctaaggcatggtgatgccacctagtctagtaatagacaagggccacttagaaggtcagatgagtcttattccagagtcaggaagagaagtggtttacccagagatgcaatggggttgcttcaaatgatccagaagggggtttttgcatggaaagaaaggttccattcggtcattgttactctacaaatggggagaaaagcacctgcatcagaatcatctgagaagcttattataaaggtaagctcttgggctacactccagacctctggggctagggccctggaatctgtgtggttagtaagcaccccagattacgcctaggcgtgctgaaattgagaaccactgcaggagacacctgagagcagagacacagaaacaaattaggtatagcaaagacatcaaaacattttgtagtaaagtattgagaaaccattcaacttgcatttatcattgggatttttgccgtcaacagctgaaatacaatatttaagaggaagaaaatttcaaatttgcaacaagccataagaaatggggcttggcaaagtgtcttactcctgtaatcccaacacgttgggaggccaaggtgggcagattgcttgagctcaggagttcaaaaccagcctgggcaacatggtgaaaccccatctctacaaaaaagtgcaaaaattagccaggtgtggtggcatgcacccagtctcagctactcaagaggttgaggtgggaggatggcttgagccctggagggagaggttctcgtgggcaagatggtgctgttgcactccagcctgggtgacacagccagaccctatctcaaaaaaaagaagaagaagaaaaagaaatggtttgggtgtgggtttttttttttatatactttagaggctttcaggttttttcttgctctgtgtggtcttattgagttatttgtgtttgagtttggtacataaaataattttagtacttcttattatatatacaagaatcatggatatgctcaactttatgtctcctatgcctgaaaagttgtgcaccaataactcataagtttttttaggacactgtacactttgtgaatctgatgaaaggcgtggaacttgattcccacaaatgtgtgtgcatcagtatataaagcattacatttaatctctggggacttagagatcagtgctctctctggactctacatcaagagcctctgacctgagcctaaaccacccagcctgctgcttcacaaagtcaagtagctccacctatgactcagccatagcaagcagggaaaggccatggtttgtgtgggaaaaatggatgaaagcaaaactgaggaattcagcagtcctcgaggcctcgactcacacctttaaatctgttggaattgccacaaaaatatttgttttcctacaagaatattagagatttacccatcttgagtggcaagcctagatgccccattcactcatcaaggcctgatgccatatttagcaaaagagccataactgaaggtgcgtttgatgaatttaataggattatgtcttactaatgacattaggctcctgggtcgggcttagcctttatatttacgttttatcactgcaaatgaagatgatattctctggcatatgagttttgcaacctcagggttagtcttgtgatatgtgaagtggcccttggcttgttttgggcccattataaattagatttttaaaaaaacattcactgtgtttattttttattttatttttgagacagggcctcatgctgtcacccaggcaagagtgcagtgatgcaatcacagccctctgcagactcaacttccctgggctcaggtgatcctcctacctcagcctcctgggtaactggggctacaggcatgcatcaccatgcctggctaatttttttggtattaattttgtagaaatgggttttcatcatgttgcccaggctggtcttgaactcctgggctcaagtgatctgcctgcctcagactcctaaagtgtcaggattacaggcatgagccaccacgcccagccaaaaaccattcgctttaggaaaaagaaaaatcaaacttcctataataccaccaccaaagatacctaacgttaataatatagcatgtattcctctagcaaaaattctatgctttttgcaaaaatagggtcatactatatttagtgtaatcaaatctggcttcttcacttatatcttaaatatctatttcaataagttccatctatcatgttcactggctgctaatattctccaatatttatgtatactttaagggtcaactaatagatgcttcagctcattccataaatgagatttttctaacatctttctatgcttatagccattaacatttgggatttttgctgctgttatggttaattttggagtctctgaagaaacaggtgctttgtagcatccagttttcttgcttaaaaggaaattcctcagagtttaagggtgtttagatgtaattttcacttttcactttgttctggaaaactaagaataaataaaaatccaaatctatagcccatgtccacccactcctttgaaagtaatcaacctcagtctctgaaatttcaaaggaaaaaactgaaaataccactgaaatcatttttaattagacatttagcagttcctaaagcaagttataatttggccttcaaaagcagtatttttaaagaagggagcattttaattggtatgttctggcttagcatattttctcagacattaaaattttaaaatctagatgtcatatcaaagtatatgagatgaaaaatatgatttcttctatctaactagctaaactgtggcacataactggacgtgtctatatggatggatctctgggagaaaagaaaaacttttctattagctatggcttgatatatctgggggcccagagctgccaattttatatcatgcatatgctgtgtagtatctcctactcaaagtgtggtccacggaccagtggcatcaatatcaactgggaacttgtcagataaatagaaccatgaatcccagcccacatatcctgaatcggaatcttcattttaacaagatccccgggtgattcttatacactttattgattgattgcttgattgattgagacagagtcatgctgtgtagcccaggctggagtgcagtggcgcaatcttggctcactgcaacctccacctcctgggttcaagcgattctcctgcctcagcctccaggcgcattccaccatgcctggctaattttttgtatttttagtagagatggctttttgccatgttatccaggctggtcttgaactcctggtgtcaagtaatccgcccaccttgacctcccaaagtggaggcattacaggcgtgagccactgtacccatgcatgctgttgaggacaccaaacaaatcaaaccaaccagatatatacacaacattcatctacttctctccactagatatacgacatttctttcaaagaacttgattcttgcaggtgtttgtaaagtgatttaaaatatgaagatgttgtatgtgcattaatataggaatgtgtgtgttcaatcaaatggacataaagagttacatatagtgaaacttctcactttattttgataataggagatttggtgagcaccttcattccttcttttcattttaatattgcatactgtgcagttttttaaaatttgttttagacacaagatctcaccgtgttgcccaggctggacttgaactactgggctccagcaatcctctcccctcaacctcctgagtagctgggactccaggcaagcaccactgcatggggcttggaacattttcttaatctggagacatctaaattaagactacaatattaaaatgatgaaaaaattgaataaagatgttcaccaaaacccctagtgttttgggcaataatgattttaaggctttgaggccccttcccaatgccagtcattctacaaattgttcataagcacaagcaaaatcgtaagttgtaatttggccttcaaatacagtatttttaaagaagggagcattttagttggtatgttcttgtttagcatattttattagatgttaaagttttagaatctagatgtcatattaaagtatatgagataaagaatatgacttcttccgtttaactagctaaactgtggcatataactggatgtgtctgtatagagggacctctgggagaaaagaaaaacttctattagctgtggcttggtatgtttgggggtcccagagcaagccagatacttgactggggaggggggaagagcaatttatgtgccagtaattacaattataaacacatgaatgtcctgggattggagaacctgttctgtatgagggtaccaggagatcttaacagtggaagaacatttaaactgaatcttgatgaataagtaggattccccaaggggaaccaggaggaaccagcacctcaggtaactggaagaatgaatatgaaaatacaaaagtaggccaggcacggtggctgacacctgtaatcccagcactttgggaggccgaggtgggtagataacttgaggccaggagttcgagatctgcctagccaacatggtgaaaccccgtatccactaaaaatacaaaaaaattagccctgcattgtggcgggcgcctgtagtcctagctacttgggaggctgaggcaggagaattccttgaacccaggaggtggaggttgcagtgagtcgagattgcaccactgcactccagcctgagcaacagagcgagactctgtctcaaaaaataataataataaaataaaaataaaaatacagaagtaggttaccatgttaacaaatacgttcatcatcttgttagtagggacccattggagggttttaatcaaggaatgccattagatttgtatttgagaaagataattctggtggttcagtagaaatagagcaaggtgaggtcagaggcagggaaatcaactaggaagccgctgcaaccatctgagtgacagaagatgaacttgaatcgaacattgaatgtagcaatagtagtgtgggactaagttcagagacatgctggaagtggagcaggcaggttagggactgagcaaagaggtagcgtggggagactagaaagacaagaaacactttgaagattctagttcggggctgggcacggtggctcacgcctgtaatcccagcactttgggaggccaaggcagccagatcacctgaggtcaggagttcaagaccagcctggccagctgaccaagatggtaaaactccgtctctactaaaaatataaaaatttagccgggcaaggcggcaggtgcctgtaatcccagctactcgggaggctgaggcagaagaatcgcttgaacctgggaagcggaggttgcagtgagctgagattgtgccactgcactctagcctgggcaacaagagtgaaactccttgtttctgtcttcccttccttgtgaaatcattgtagatacatttgggaaaacaacacaaagagattccactgtcccccaatagtaacgtcttgcaaatctatagtaaaataaacccttctaaaaattgtatgatttatgagcaattttaaattaaaatatcagtatactctcatgctgatttctaactagtcatttctctgacctcccacccctcccctcaccccttggcccctaccaccctcccacacacatacctaatggctctccagaccaggtcctgtccccatgctcccctgatcaagcagatcttgaaccttgtggggaaaatcacgtctctggtggtcactggatgcctggtgtccatcctgaccctctaaagctagggcttcccattgtgggctggtactccctacatgtaccctccatgtcctcttgtagggaccccagcttcagcagtgctctttaccatgttgttaaatatatggcaggttggggtttgattctggccacagctctccccagataactgacagagtcatttagggcctttgtcccacatttctgggaaatttgtttctataatagttaggactttggtatgctagtgacagatgcacagatcaaattaacttaagaaacataaatgtactggcttactgagttgggaagtccagggataaagctcccttcggagattctgggactcaaacaatatgatcaagattctctctcccttgcacttttgctgatttgttgacctcatgctcttcatggtgtggtttatatggccattggcagatctggagatacatccttatatctcagagtgacacatgaggcataagactcgcttctccaccatcactgcaaaaccctactggagaagggctctgtttggcctcatttacatcctgtgccaatcctgtgggccaatcacttgtgcagggcgatgtagtgtattttggatgaatcaaccaatgactcagcctgagctccttatcatctgatagacttggaattggggtatcaaattgtctggcttagtagaaccagatggaaagggaagaaagagtttttcaaaggaggagatattgacgggatgggctaggcagaacagctaatgtccattttagttattcctggatctagcgtcttctcctgtggtgaggagagaggaatgtcacatggcacctatggttgtctcttgggagttatggtcagtgttgacagaagaaggcaaggatggctgtaagcaccaagatgtttatatgtatgaggttggaatttagaggtgttcagaactaatagccttaattgtctttgtgaaattgaaaacaaaagcacttgtgaaaagacaggaaggcagggtggggagcttaaaaagctagttgagggtttgaaggatgagagagagatcacaaggacagtgtagaggactgctaagagatattgaggatccaactaagattggaaactgtagcactcaggattctccagagacacagtaggatggatatatatgcgtacgtacacacacacagaaatttatttcaaggaattggcttatgcaactgtgggggttgcacatctgaaatctctaggacaggactgcaggctggaaactctcaggcaggagctgatgctgcagtctcgaggcaggatttcttcttcctcggggaaacctcaattttgcttttaaggccttccaggtgaagagatgaggcccacctgcatgatcaagggttatctcctttactgacagtcagctgattgtagctgctaaccacatcaatcaaatacttccacagcaacacctaaattagtgtttggtgggataactgggtaccgtagccttgccaagttaacacatacattggagtgtcacagaggcctaaactctgtgagccagtctgcatgacactagatgatctatttttcctcttcagttccacagagataaatacctagcaaatagaagccaagagagtggattgttaaactgattgatgattggaggaatcttcaggctggggtcactggagtctcaaggggagatcttgacgttgctgtcgagagaatggtggacaaagtccctcagggttgtggctggactgagaagttagttccccaagcgtaaagtgacaagagcatcaaccccaccagttaaaatgaataatgcatgaataatacttatgttgggcactgaactaagtatcacattaattttaaattattatcattgttacgatttcatttaattgtcaaggaactgacactacataaagtcagagtggatttagtgggagtaagagggtgagctaaatgtggtatattggagtttatttatttactcaaccaccagttatttaataagcattgattatgagccaggaactgttttaggtgctagagatacagtggcaaacagaacagacaaagtctctgccttcatggggcttaattctgttggtgggaggaggtatctgctaataagcagacaacttcagcaagcaacactagccccaggtccagtggtaagcgtgttatgaagaatagtaaagccaagttaggcaatagagagtgatggggccagacagggctggggtaggatgctagacttataagagaaaccctttcggataaagtgacatttaaacaggaccccgaaggcatgaagggagagcgtgggctatgaatatatagggaagagcgtgttcgagagaaagaacatggtgtgtgcaaaggtgctcagaggctggaggctgcttctccctgtaagtgaggaggagaggggtgggggatgaactgggataggttgcaacaaggagccatgttgggtgtggtgggtcattataagttctctggagttcatgctgagtgaggtggcaagacagtggagagttttgaacacagaagtgacaaggttcttctctaagggccgttttggaggccgtatgaggctgtatgaagggatactgggaggacaaggatagaagaaggagaccagtgggaaactgttaccgtaatccaggcaagaagaatttgtggtctgaaagccatgctaggtatgagcatgaccaggaccatgccacgggtatgcattgctgaagcagcctgccagcgaagaccaagatggcccaggaccctagagcagcatgtctggaggggtctgctgtgttgacatggaacttcttcaagatggagacaggatgggtgggcatggggagaagaactctgacccagattctgaagtcctccaggagagggaagatggtggaggaaagcagcaacggggtagaaagaggagcattagctgcatgcaggcaggtgcttgaggctcctgcctctgggtctttgcatgcacttctttcttttctgaaacattctcttcctaatatccacgtaactcagtctcttccttcccacctcagatctttatttaaatagattggaagactgctgtcaggacatagtttatgtaagaatgaagataactctcttgcctccatccttatgtcacctggcatggggtggcatgagcagccactgcctggaaggtctacttggaagtggtgtcctcaatggagaggcggatctggcttgaggctgggaggtgaggggactctcctgtgaaaggggtaggaatgctggggaccttattgaccatgggctaggggtttcagcaggcactgtggggagtgtctttagggaagtcaggaaaggagggtagaatcaatggggatgaagtaatgagaggaccagagggaacaggtgctgggatgggagctgaggatgccagaacatgggattgactgccctgggagggcctggcaagcctgaggctggcgtgcatgcagcctgtacgcttcctggggcaccaagcagagcatgggtggccacaggagacgtaagggagcgttgtctgaggggatgtgaggaatgaccaggtgctacccacctacagagctctcaggatgcttaactcctgaagaagctgtagcctggaatggcttgtagacctgaatgtataccaggtgtaactggcagagagggagcaggccccagaaggtccttgttcatcctagtcaggtccttcatcctgtcccacttcagggcccaaagtgctctgattctaatgccagcctctttggccttgcatttgtagagaagcgagttccctatcattggaggtatctaagcaatgaagtggacagccacttagaaggagtgtgcaggatggaggcttgggtatttcttgggggctggactcgaagacctttattttccacttggcctggagcgtctgtgagtccttgtcaaatactgcctggcacttacctccatcgggacacagtgcaggcatggctcaagtgggtaaattgtttatggaatgcaaacctcgtgggacttatagatggcttatcaatgtggaaactgtattaaaaataagttgagatcagcaccttccacagcctctgcatatgaaatgtcacttacatttaaacccacatcaaaggttctgggttgattctttgtatacttgttagtagtccaatgcttaggacaccattttcaggtagctgttttttagtgtgtgtttggcagggctggttctatacaaacgttcacagtgagcagagggacagcatgatgtctcctgccatggtttcacaattagctagaagagagagggttgcaggctcactgggccagaccggacgctagaggctgtattcagtaggtggggcagtggcatggacctctctgcccatgatgtggacatcctggcagatgggctgtttcgagagcaagccatggcttcaagaccttggctgtttgtggtgatggggtgaaggaccgaatagttagagttcgtactgagtgtctgtggtgcagggagattctaatcacatcatttgggggtagcggctgtgcttagcactggttaagggaacgaacgggcatagttgtgctatgcttgtgagtatgctcacttcctggagatggggagagtcaaattcttagagtgttgtgtggcttatatattttattaagcacctgtgttctaagtccgataagcactttgcgtacactgcctttaattttccgaatcattccgttttgcttgttgaggaaggcaagcagttaagacaggctcatctcttgacatgaccccacatagtgactgtacctcagaggggtaaccattttctgagagctgggtcccaactgtgttagggtcaaaattctgatttgcataaccagaggtgaatgaagacctgggaaactgacacatactatcttgactcataagagactgatgtataaaaacagaaatgatgccagctgcttattttgtgagaagaaaaaaaaaacaattctgtgaaccagatacatatgttctctcatcagtgcattcaatatgaaggcaaatttatatgaggacataaattaagatcagaaggttgcttatcagcatgaaacagtgtaggctgagtgaggataggacaccttactgacagggttacagagctgtgatcgtcttggctccagtgccaccctgcctgctgtagggctggatggtaaggttacctcacagtgacagggacaccaccaccagtcccagccgctctcagtctctgcttgcagtgcctctaacactgatcatcatcagcccattgggctgattcatcctttctttagacattttcctcatggaccctcagtaagttgtcatcttcctttgagagcaagttttctctttgtggtatctttgcatctcaccactttatttcgttatttttgttttgtggctataagctctacagagaagttgtattgttccatttccaaatttgtgggaaaggggaagaaaagaggagaggcaccatattgtcagcctgatttcccacctcagagacgatattcttgtcctcgttttacaattgagtcaactagatggcatggctttttttcctagctcccattgccatctgacgtggtatttatttagttgtttgtttattgtctatttctcctgttagaatgtaaacttggggacagcaggtctttgccatattcttggcatctggaacggtaagtggcctgaggtaggtgtgggcaggtaggagtatgcgtggattgaagaaggatgaggcaggccctcaatcccagtctctcccacaccccaccttcagtttggtgaggtgacagaagggaggaaaatatgagaagatctgagccaaaatgaaaatcagacaaaaactcagggcatgttctgggggtccttgtgtccctacatcgtcttaaagaaccagcctgggacagtggggactggagctggtgacacacaaggacccaagaatatggaaggcctttctctggcataattgaaataaactttaatgaacaatttgtcctgttttaaatatctttatagataatatctggagctggacaaatcatgtataatctacttcctttatcattcttatttcaattatatccatctacaatgtctcagccaaagggaacaccatttacctggtagcagccacctgaattttaggcattgatatctaagagaaaataagttgctcaatggttgctcctttgtaacgccaaacctaggacttgactatatggttctgatacagtccaacaatgtgctagttgataacagcttgtagatggatatatatgtattctgcatattttgtttggtgaataacccacagcattctaactcaggtgtccagtactgcttatcaaataaggctttaacatagaaatacataaattctagaaattgtcttgcatttattgtattagaaagtgaaattggtttctttaaatctttgtaagggctattaacataatatcttgttccaaatcaaatagagctacttactactaaagacttttgtactttcttcaataattaaagcaagcaagatttgtagacaatgcaattttcatgatgcattgaaaaatgtattcttacagcagctgtgtttatcacacactttcattttcttaatatcttaaaattgcttggcaaaatgaaagggaaggagggtggtcagggatgtttccaacattctattaggatcattttcacacaaacagaaaatctgaagtaattgttcagtgggtcccctgcacccatcacgtacattttacaattaatgttttcctctgtttgcttcatcactggctatccatgtattcatccctctcttcatcttatttttggtgtattttaaattaaattgcagaaatcagtacacttcaccactaaacagttcagcatgcttattattaactcgagttaaatatttaatatatatttcaggtaaaatgtgcgcacagcaacataagcacattttaagctttccattcattgagttttgacaaatgcatacacctgtgtaatgccaatcccaagccaaggtacagacattctttttttttctccaatttaaaactttaattaaaaagtaaactttaatgtcgaaaatgcaaacttggggaaggcagaaagatcacacacaaggctgtcacttcacacttggaaggttgcacagcggccgggcagaggcgctcctcacatcccagacggtggaggggccgggcagaggccctcatcacttcccacacggtgagggggccgggcagaggtgctcctcacttcccagacagggctgcggccagagagaggcactcctcacttcccagatggcagggggcgctgagcagaggtgctcctaacttcccacacgcggtggcagctgcgcagaggcgcttctcacctcccagatgggcggcggccgggcaaaggtgctcctgcttcccagacggggcggcggcattcttaccacccagaatggtgatgctagtgcctctttccagtcgatttccaccctacgtgcacgcagagggaacccatgttctgatttttttctcagcatggattactttagtctttcctagaactgtatacagttctagaatcatatagtatgtactatttgggataagtacatgcaatacatactactttgcatgagactttttcacgcagcacatttttgaaattcatctatttttgtttgcatatgtcagtaatctgtacccattttagtgctgaatcatattccattgtgtgaatatgccacaatttttaaatctatttacttatcgatggtcacctgcgctgtttccagtttgcagctattatgaagaaaattgctgtgcatgttcttatgcaagtctttttgtaggcataagctttctgattacttttgaaactcctggaatatgtagtcttagcacagagtctacacacagtaggtactcaatgaatgtatatattgccctggcacaaaacccacatgacatgttgggttttacagtacaccagacgttttcttcctcatctgttctcagatgagcttcgtaactacctgctgaagaggcagaggcaatccacacaatggaagctgagacattacataatcgctaattgttggagctaaactagaaccctggtttcctaactcctagtcctgtactctctgactgcttgctattgagacgggagagttcccttgacccctttgcaggacttgtgaaaggggtgtggcccacttatttgactgccaccatgctcaaaccccctgcctgagagggagcatgcaggtgagcaggtacaggagctgggggaatgtggcaagaatgaaccccgtactggtactggtcaacggcagcatccagggttgtctgcgacctctggagccctcgagggcatgtgttacaacgctcatagcagttactatctgcagatagctaagtgttaaccagctcagtggcaagtcagggtgacaggcctttacaccctgccctctgggtacctggcttcctgtctggtgtccaggaagaatcaggtcacataggcttgaaggatggttcaaaatatggagattttattaagcagtgggagtggctctcagtggaaagggagctggaaaggggatggtgcgggaagaaggtgctctatctctgaagcttggccgtctctgaggaggctcttctccaaagttgttctctttgaagttaagccgcatctgtttatagtttcggacactcagttgcttctccttttcacgttcagctgcttgtctctctgccagctaaggtctgaggtttatgtgggcacaggagagggggagcgggtaggccaaaaaggtaacatttgggtgggaaaacagggataactcttctcatttagggctgtggtttccaggcttgagggtggggcctttgccaggaaactgccctcttctacccagtacttccctgtctcctgtctgtatcgctatgtcagtgccaaaccgaaggtatgtgtactttacatcctcccttccccccaagcattgctctgtgccacagttacggtctttgagagttttgggtttgtactttggctctatttaagctcctggtcatcagaacttatgtatattttccccttttatatcatcttgttttctcagtgtgtatatattgaggtgaggggaggggcagcagggagggcctgtagagggagttattgaaaagtgacctaagccaatctggtacttttgattggcaatcagagaagtcagccatgaggttcctgagtctctctttctctgccactcccagctgctctgggatcatgaaaaccagcctccaacctgattctgcaacacatgaaaacttttattaacaaggagattcatataccatgcctaaaacactcatacaacctgttctgtaaactcaagttgtcccccatccgtggtttaggcagcccggttgttaccagtggaaggtgtccgagttactggcagcaattccatatggatctgcagcaacttcaattcttgcctcctcagaagaaagaattcaatggaggggcataaagcagaaaaagagactgaagttaagtttcagagcaggagtgaaagtttatttaaaaaggctttagaacagtaaagaaaggaaaattcacttggaagagacccaagtgagcacctgaaggtcaagagccccgtttaacggtgatgctaggactttctaggattcccatgattcctcccttagggtgagctgcctgcatgcacagtgccctccttacctttgggaattgtgcacacacagtgtgtttaggaagttgtatgcatgcccatctgtggctttcttcccttttctggtggtgtgcccctggaagtcatactttgccattttgtctcttaatgcacctgcccaggaagttgcttctccctggagcctgcgtttgattaacactttaatgttaacagatgtgcctcatcaggagattgtctctccctggtgcccttggactggctgctgaattatcatttttagagaggcagtgtgataattgtcagaccatcacctgacattcctagtgggtgggggagaagagccttctcctgccccgctcatgcctgtctaactacctgtaacacagtgagcacctctcttgacaccagtaatctgatagcaggatcaggaagctgcttcttgaggacagagtctttccggaagcagtaggacagtggtgtgaaggaagttctgggcctcagccctcctctgaaagtgtttgctaggctggctaagcccagcacccttttcatggaaattttgaggtttctagccatccctcaaatctctcatagccttcatttgaccattgaaaataatttctaatatccctttatgctaattaatgaactatctgttgcagattcagatgggagagttagaagcttttatgaggccacctctgggaatataaacaccatttgggatctttcaaatgctcactaacaccactgtcttggtacttcctgcttagggtgcttcatatattaactagtaactgttgagggtgtcctaacatgaatctacacacacacacacgcttaaagctcactatggatggcggagtgtttcaacataaaacccaggtcacattggggaggtactagagtccatgtgtccttcccctaacccccaccctctaacggtggcatttccaccagactcttgagttttcagtttgagggaatcctttgaataaatatgattttctgcctccacacttaatgtggttagagctgcagccttgatcctaatctgtctgatctcccatcctcattgatagtaaaccagtgagtaggcaagtcaactgtgagttaatcggggtgggggggatttttaaatgcaagtctgatgtttaaatgtagctctgattatgcctcttggctatcagaagtgagtttcatttggatggagagccattttactgagggcacacagcacagaagctgagctgcagtgtaaagctttcaagtgactcttggagctattaaagtgccactcatttggtaactgttgctgttaattaagtttgtagccccattattaattcttggctctactattattaattatgcttctataaatttatagtaggcagtacctcagggaatttttcaagttgtatattaaaattagagataaataaacacttaagcttccttctcaatataagaagagtttggggtttttatttccggtactaggtaaatttgaaaggtatgtgatggtcattttctctccttactgaaacattttctacatggtttgcagcagaaatttctgtaacatatttaacaatgcggtttagtatttaaatatttaacccattcactgataacttgtagctaattcctacaattaaacttacgcctttggccaggcgcggtggctcacccctgtaatcccatcactttgggaggccgaggcaggtggatcacgaggtcaggagattgagaccatcttggccaacatggtgaaaccgtgtctctaccaaagattcaaaaattagctgggcatggtggcatgcacctgtaatcccagatactcgggagactgaggcaggagaattgcttgaaccagggagtcagaggctgcagtgagctgagatcatgccactgcattccagcctggtgacagagcgagactctgtctcaaaaaaaaaaaaaaaacaaaacttatgccttttatgagagcaagcagacagagaaggaaaagaaaaaaagcctggcattttgtgtataaaaaatcagagctcaagtaatgttggtcaaatatagatgcaaacaagtccatgtgcatattaacaacccctttcaccatgtgctttatttctgaaaatactttaaatccttttctgtcttctgatccagctctccagacaatagttaataaatgggttcataggtaattatgatgcattttggttcttttacctacagcaaattcctttttttctctctctcttattctaagaaggaacaaaaattgcccataattctccaggttatagaaaacgtctattggcattttgatgtagttcctttcagatgcttttccaagcatatatcaaataatttagatcacacaatgttatggtttgattttaccccttaacatttgatgtagcaattctttattattggacatttaagttgtttataatttttgtccttgcaaataatagatatatgatatgttggatagctctttaaataaatatttgagagtacctctaattatctattttaatgcctagaaatataaattttttgcctaaaggcatgaacattgttcaagttcttgatacatactgaaaaattgctttccaggaaatgacgccaatttccagtccactagaaacattccacggtgtctgtcttactgcggccatgccatttaatatagctaatacaattataataatattaacttgctaactttataatttttgaattcggaaacttgaatgagatatgctggaacatcaaatagtgacctattttatctcaacgcttcattttgctttttggagccaaaagagttctttctctctcaaattggattcagtagttgaggggctacacattaactgacagtagccatattaacaagagaaaagacaatatttatttacccatgcatgggagagctgctcagtaatgagtaacccaccgactagccagagataagggtttatataccaacttaacaaaggtgaagggggcaattagggattcagggggaaggcatgaaggtgctcttgggcttttcagtgataatgggaataggaaatatgtcttcatggcagctgaattaggaggaaactgcctttgaggggagttaatggcagctgtatttttgggaggctctgctatagtcagataagggaagttcagataagacttctttctgcatctcctgcagctcaaatgttttcaccttaaaataacctttataaagactctgagggtccaagtgcatccccatactttctatttattttaacatcacaaataaatgtgctcaataatagataaatttttcatcatgaaatgtattgaatattagtaataatggtgttttctgccgtttttgacaggtaaattaccagtaagggatgacacaggaggagaaaaggagaaaatgaagaactgtcataaggataatttttattacagatatgaatatatttgtttggaactaacaactatttttagaagacaaattaggcagaagtggtcactactgtatggacaagggtgaatagtagttgtgattttcaaaaattttttaaacatatctcttgatacagtatttttccaacttcatttcttttctttttttttttttttttttttttttttgagatggagtctcgctctgtcatccaggctggagtgcagtggtgcaatctcggctcactgtaacctctgcctcctgggttcaagcagttctcctgcctcagcttcctaagtagctgggattacaggcgcgcgccaccacacctggctttttgtgtgtgtgtttttaatagagtcagggtttcaccacgtgggtcaggctggtctcaaacttctgacctgacgatccacccgcctcggcctcccaaagtgctgggattataggcgtgagccactgcacccggccttccaacttcatttctttcaagtcacagtcatggaacatgtttacaacttctgagttacactattttggataaatagtcataaatatcagaaattgaaaattagattaattcctccttattttgatattcacctaggaaatagtttttctacagatattattctggcaaatctcagtttcttgaatctcagttccttgaatcttgacttttgtcgccacccttgatttgaacatcccttggcagctttgtggataatacagtgtgagagacataattgaaaagcatgacaagtgagaaaatgggttacatacctcaaaacaaaggctcattatacatgacaatgcaattcatttgggtctctccattgcatatttgctacaggtattgattgccttccaactcttcccacagccttttgctagtcttaaaggcataaatcacttggtgaaaggatatttctatttcagccagataaactctttcctttttgtttagatttaatatgaaggcaaaatgcactgctctcagtgaacagccttgtttcctttcgtttaatggggaagggaacactgaaacatttcctacattctctaggaaaagcaccttttttttttttcttgtctttataaccctgtatctgttgtcactgattcagctattcagtctgggacaaagcgacttttaagttctagagctatgaggaagctataaagggaatacagttcactctgtagagaaataacagcctgggagatcatggaccagaaatgttactctccaaaggtttgctagagctttactttgaattctattcatcaatatttttgttggcctggatcagtgactctaattatgtatagaagatagaaacagcagttatatttagcaagctggaaaagtccctgcagtctaccctcagaacagctaaacatacggagtcaacctgagattctgaatgctctgttcactccctgagagataatgatgactgaagagtgatagcgcagggaacagagtaaagctagaatgggaggcaaggaaagttatcagtcagacctctaggagaagtcccagcccctgccccatgcttttgttttttatttgtctaactttttttttttttttttggagattttccatttcaggcttttgttgcttttctcaaatgtcaaccctacctacctctctctgaacgaacagcccacactttctacttcatcaagaaaattgctaccacagggatgatatcatagcccattactgtatgatgctatctataccttagcctgggcttccaccatttctttgtctcccaaggagaagggacgtgactgcaccggatcttagtgtcatcttttctgcctcccattggggactgtgaagttattccaaggacagttgttccccctaccatagctgctagctccttccctcgtgccaggagccacttagtcacagggtaactgaagagaaaaaagaacgagacctattgctgagcctagagcaagctcccccatacctgcaccccacatgtgtaccaaaagcttgctttctctcccattcccaggtctttgatggggacgaagctaagaccatgtatgccattggccccaggcaataagaggtgcattgtctgcaaaagtcttaaaacaatattaaaatcaactaaaaattggtctttttttttttttgagacaagagtctcactctattgcctaggctggagtgcaatggcacgatctcagctcacagcagcctgcacctcctgggttcgagtgattctcctgcctcagccttctgagtagctgggattacaggcacccaccaccacaccccactaatttttgtatttttactagagatagggtatcaccatgttggccaggctagtcttgtttttattatcaccatgttccagcaattctaaacgatatcagcgttggggaggaaaaacatctcttctttctacctgtcttaagttcattggctggggcccctataacaaaagacagagtaacaagagaaaagcacacacgtttgttgaatgccagttttatgtggcatgggaatcttcacagggaaatgactttgctgagaccagctcagtgggggagaccctaacccagcggtactagaggaattaaagatatacacacagaaatatagaggtgtgaagtgggaaatcaggggtctcacagccttcagagctgagagccccaaacagagatttacccatgtatttatttacagcaatccagtcattagcattatttctatagatgttaaattaactgaaagtatcccttaagggaaaggaagggatgggccaaattaattgcagcaggatcacgcccttaagacacagattgctcatgcttttgtttgtggcttgagaatgcctttaagcagttttcctccctgggcgggccaggtgttccttgccctcattcctgtaaacccacaaccttccagcttgggcgttatccttccagcttgggcgttatggtcattatggacatgttacattgctgcagagattttatttatggccagttttggggccagtttatggccagagtttgggggggcttgctcccaacagacttgaagaagcagttaaactgggagtttttatgctagcttgagtgaagagtggagagtcatggagaaatgtgttaggacagaaaaagtatgagccgaggatagtcaactgggagaaacaacaaggtctgtatgttcacattcctcttgacatccctgtgtctttggagagaaagatgttattttcctccaggcatagggagggtacctttcacatgatctgcctcagggaaggatcagacaatctttgctatacatgctgttttccaaattccttcaacctaaaatattcagtattccaagtcaccatattttggggtagtatgtcttgaaccttatcatcagtgatgtaatattcctccccagaaaatccttttgttggtaagttacaaacaattgctataacgattgttgacccactggcttcctacaggcaacccagctatactcagctgagtgtcaattcataagggttggaatcatttgagtttgctgcctgcacagtttgtgtctctaagccctgtgatactacctagtcctacgtttaaaaagtaggttcaaaataaacaatggtaatacaacaattctaagggtaaagtgacagagcttgccttattgcacttttgtgtgcagatctttctctaaccttgtagcatttattcctttggacgtgtttcttttatgctctccttctcccttaaaataaatacttaaatgtaattaaaaattattaatccattactttgtttccttttttgtactgtgatagttttctaactgacttgaatgtacatacaaaatttaataaaagactatgttttatgtttgccattattttttggcttttattactattattttaagaatattattgaaggcttggcgcagtggctcatgcctgtaatcccagcactttgagaggccgaggtgggcagaccacccgaggtcaggagttcaaggtcggcctggccaacctggcaaaaccccatctctactaaaaatacaaaacttagctgggcatggtggcgtctgtagtcccagctacttgggaggctgagacaagagaatcgcttgaacctgagaggtggagcttgcagtgagctgagatcatgccactgcactccagcctaggtgacagagcaagactccatctcaaaaaaaaaaaaaaaaaattattgaagacaattttgttgtgtagaggaggagggtcttaaatgatcctctctggctgtcagatatgctggggactccctgtgttcctgcacacctgcccaggctctctcctctccttcctccctcattcctgcacctagaatgttttcaaaagttattctaaaagcctaaaataacttccgtgaagacttgctgtgataattccagctctttctttcttctctgaattcttctaacacattgtagttttccatacaatgtagcaagtgatggtatgccagcttagactttttctaatactttttttcccaagatagaatgtaagctccctgaaagttggggttagccttatatttcttcttttgtgtctccccaaagacaacttttggaagtatcccattaaaatgtatactctgtagaaaccagctcaaatccttcaaaaacagctcttctactcctgcaaacttcattatcctctcataactttatgtgatcatttaaaatcaggtttttctaaaacttcggtctgagtgaccaaatgcaattgcttatcttcaaggaaatagtgcttgctttaggcattcactccagaggcacacaaggagagataggtgaaatcaacatgagcagttaatttctggtttcacccgtaaaatactgatttctgtggtttgaatgtgtccctcgaagttcatgtgttgaaaatgtaattccaatgcaatagcattgggaggtgggatcttcaaagagtaatttggtcaagagggctctgtcctcataaatggattaatgccattatcttgggagtgggttagttatcgagagagtgggttgctaatgaaaaggatgagtttgttccattttcctgttgctctcttgtggactgtcttattcttctgcctttcactgtgggataacacaacataaagaccctcaccagatgccagcccctcaaccttggacttcccagcctccagaactataagaaataaatctctgttcttaattatccagtctgtgttattctgttatagcaacacaaaacagactaagacagtgactctacaaccctaaagaggtagtcactgaagaactattaagcattctctcagttgtgtcagtgaaagccatctctatttgtgttccctatcttaagccaacagttctcaaaatatgatccagggactcccaggagtcctagagacctttccaggggttctgtaaggtcaaattatttttataacatgacccagacattatttgcctttttctctctcctaagtgtgtcaaggcattttccagatactatatgacatgtactatcattatagatttagcgtggaagcagatatgagaagccagctgtggtccattaagccagagggtaaagagatttgccaagaatgtaaaaagaatgtcttctcatggagttttttgtttgggaaaatagagtaataattcataaaaatttcctatttatgttaacatatgagtttattgctaattttaaatcaattcataaacacatattttttaatttttcagttttaattttgtatacagcaaataacactctatgtaacccacatatacaaaaggtccttgaggccctcaataagagtgtaaagaccaaaaagtttgagaacttctatcttaggccaaagcagagatttttagaaacatattcttttaattctttctttggttacttacctccaaatcaaagcaatgtgctgcaactgaatccagtggaaaaattaattagctctatgttaattctttggctttgctgtgaaaagcctgatctttgggccattgacatctgttagaaatttaaactcttgagccctgacccagacctactgaatcagattctgcattttagtaagatcactaggtaattttaacctacaggttgagagttatgagcactgctccactttgcctttgtgaatctggctgggatctttttccaactttattgaccatgttaattaactccctcttttttgattctctcctaataaggcttgcagctataactgcagtttatcctgataaaacttatttctgtagggggaaaaaaataatcttctccttcactcttcaagaatttttagctgggactccctgtaacaaaaggtagattaacaagggaaagcaaacaaaagcttaataacatgtatacttcctgtacacatgggagataatgcagaaaaatgagtaaacctctagagtagatctaaaaaagttgtcttagtcttcaggcttaaataccatcctttgctaagacaaaagaaagttatagggaaaggcctggttaagaagaggtggccaggaaaagcatcataaacaaaaccaaggtttgttatgcagatttaagtaatgccttctgcattgataagagtctctagtgatttagacattttcctcttcctggtgcagagagggagacattcctaccaatagggatgtcctgtatagatgtaaatttatgttacaaaagggtaacttttcagtgcttcttctgtatgtgcagtttctcaaaataaccagttcaaaataatcccatgccaaagaggcctatttggatgggcatattctggtttcctacaatcatatgttgggatgacatgtcctgaattccatcacttcctaatgaaatctgataaaggactgacttgtctgacatttattttcatcctacaatgtgaatgcaatgaaggatcaatttgcaattgtattttttatggccttttggatttatgcactagagaggtgctaaagctgatgtgttgattcaagtgaggagtaagaggggtgagaaactgtgagaaaaaaaagtactataaagacacatgcacacgtatgtttattgcggcattattcacaatagcaaagacttggaaccaacccaaatgtccaacaatgatagactggattaagaaaatgtggcacatatacaccatggaatactatacagccataaaaaaggatgagttcatgtcctttgtagggacatggatgaaattggaaaacatcattctcagtaagctgtcgcaagaacaaaaaaccaaacaccgcatattctcactcataggtgggaattgaacagtgagatcacatggacacaggaaggggaatatcacactccggggactgttgcggggtggggggaggggggagggatagcactgggagatatacctaatgctagatgatgagttagtgggtgcagtgcaccagcatgacacatgtatacatatgtaactaacctgcacaatgtgcacatgtaccctaaaacttaaactataataaaaaaaaaaagtaactgtgttttcttctgtttaatgattgttgcactctcctacaaattctctttaaggaaattttcctagaagccttcttccttgaatttgtaagaaagtggcttttcagtgggttgacctcttggcttttacatgtaaatacaccgaaaaaaaaaaaaaaccccaagggatgtaaaaacattgagaagtttctcaaaaaaagaaaaaagaagtccatttagtctggtataactatgaagtaaaataaatcatagtatctgagaaagaaggggaaaatattcaattgtcaaaattagcctgtctcatttatttggccttggagaataatagtcattgatatagaccagtgggtttcaatcttgaataaacagaggatcacctataaactcaagaaaaagcccatgtctgagagattgaattggaatttggtaggtacttatctttaaaattttgacaaggtgattatgaaacacaatgagaattaagaatgtatggtatggtcaaatacgtgagcagatggaacacaaagtccctagtctttaagtgtgtggattcaatcatttattcatttttctttatccagggttagatcctgtaggggcaaagataatttccccctccccctctgaaggttcaagtctgctgaaatgaactgatgagagagattaacagggcaaaggcatacaagtttattaatgtgcataagcatggaagccatacaaaaaaatgaggctcacagaaaggccagatagctgaagcttaaaaagcactctctttgtagaggagccagagatggtggatgcatgaaattgagggttagtagtaaatgctttttaagagagcttaatggacccaaagaggaaacaatagtttataaatgattctctttggaagttgaatttatgggacggtaaggggcagaactgcaaagcaaacgaaggttgtctttttatgcagataaagtttcttgggtaatttcctgaagcggtcctcagaagggtagatgaaaagtttgtctgggtatggtcagaattttgctttcttctcttctccagtggttaatctttcttgttaatttaatgaaattcctagggagggggtttaagactattacaattcttttagaaaaagttttcttaatcagatagggaaattccagagagaggtcctccctgcacttagaagcaaggaaaacagaaagttagcaagtccttggttcagaggcactttctgaggtattccaatttctttcaattcaaaagtggtcagcatgccaaagcactttactttggaatatcatttttctgagccacaacaggcctgtccagagatttgaattaagcaaattaacacaggaacagaacaacagatgccacatcttcttatgagtgagagctaaatgttgaaaatatgtggacataaagatgggaacaatcgacaccagggactactagaggggaggatggaaaggggagcaagtgttgaaaaactacccattgggtactatgctcactacctgggcaataggattgttcattcccccaaaccttagcttcacacaatatacccatgtaacagatctgcacatgaaccccttgaacctaaaataaaagttgaaaagaaaagaaaaatgaataaatcctgtttaacacaagaattttatggccttatacattttctaatgactattagccaagtgggaaacttgttgaaggtgtagagaactaagttcaattcctcatttattccctagatgagctatgccattggagtgaagactctgaactaaattaaaaagaatgtgttagactagtttttgtaccatagataagatggatgcacttgtgctttttaggtacaggaattcagacctgtggaagatccctggagggttaaggaatgcaaatctgcattatctgtaagccaaacatgtaatatgattcactcatgcgtatgcccgccattctttgtcaaatgtatgtgtgggctttattgacagaaaaggttttcaaaaaatcatttagaagcaccactgaacaatgattctttttatcagttagtttagaaattattaatgaccatcaactatgtatcaattacatgtaccctgggatacagtagtgaatctgacagccctaaatcagggagacatacagattaacagatgattaccatctagtgaatttagtgctgatcccattatatctatctgcagtataaatttaggtgtctgtaatcctagaaatactgctttaaagccagcatgtctgctcccatctccctgttagcctgtacaaatctgctcaagtgttaattagtaatcccaggagagaagtgctgtcattcacaattttctcaaaattacctctagaaatagtaaacagtggctcgtaactgatgaatgtgatggttttagccaaaacatattctcaatctatgtctactcaaagtagggcaatagtcatgatggggggaggggtgatagtaaaaatgcattaacatgaaaatgttgaaaacaatgatgcagtccaattatctctttatagaggaggactctataaaatgttaagagagatacaatgacatgttctagattcatggtctattaactcttgatcctaggtttctcaaagggctgaactgactcaaatatactggggactccctctgctcctcacacctgcccaggagggttacttctcaaggtcttgtgccagccattagtgttgtccactcaaactgctcaggaagcgtggtaagcacggtcagttgtgtcagcatttgcacaaagtcagtgacttacggtgcttccttgtggaggagttctctatccaatggtgccaggcttggccatgtgacttgctttggtcaataaaatgtgagcagatgtgatatgactatccacatccgtgcttaggctgtaagagccatcatgtgactcagccatgctcttctctctgccatgagaatggcatattaccataggaaatagtccttcagcctgtggagatagggcaaaacagagccacggcccacctgccactggcatgtaaggtgagtaggaaataaagctttctttgtagtgtacacccctgtgattggaaggttatttgttactgctgcataacttagtgaaagacaacttatatagtaggccagagacctgccaactttttcttaaagaccagatagtaaatattttaggcttgtgggccatttacagtctgtcatagctactcaattctatggcaaaagcagctattgacaatatataaacaaataggtatggctatgtgccaataaaactttatttacaaacacaggtctttggcttgtgggctgtagtttgcccacccctgccataggattttgcttcctcacctccttgaagttggatgtggccagtgaagttgggtgtggcacttgctttgcctagtggaatgcaagctatttaaagaagtggtgtaagtggtggctactctgtcagtctgagtcttgagagataccattagagagctgagcatcggccaacctatgctggacattcagcataactaagaaataaaccttattgtttaaaaccactaagatgtatggggtgtttgttactgcagcatatataactgcgcctatctgtactgatacaggtctatctggcattacgtttcggggcaccacctctgctcactgccatcccagggcacctcacgtggcattctttgttactgacttctttataatgtttgcgttgtagaccacgatgacagaatttacttaacgatgatgttttgattatcatgcaagtgtgggggaggattgttctgttgaaacagcgtgactgcaaatattttaccaatagatcagtgaaattcacgtgcccttgaacattttcaaaggtatgaaatcacctgaaataattttttagttcattttttagtggctaaaatctgttaatagtttgattcacaagcctggcctttgaaaaagtaaaaattggataatgctgcacaagccatgttctccctggtgtgtaagggttaattattggactcttgcttgatgatgacagtgcaggttcattgaagtcatcactttatatcaccagcctgtctgcagcactgttggggccacgcctcttgtgcgatggttggctcagacctgtagcttcctttgccttatcccctttcacattgaagcctcatctgctgcttgacagtgcatgcctgagagttgcttttccacagtccctgttcttctcctaggtctggttaattgcttctctgttaaacagagaacatgttgaacagcagccttaaattattgtccaattttagcctactgggaacccctctgcagctactctgatcaccactgatatttctagaaagttcctattcacaggggactcttttctcccttctttatgctcaagggagaataaatcacagaagcagcaatccctccatgtgtcaaactatcaatcctacatggagctacaaaacaaaaggcagtatccctttgttgccagagaacatccagtccctgtacaagtctgtgcctcaggggctcaggctcattagcaccatagcagtggctcatgctttccatacacttttctctaccaacacctacagttagtctcagagttgttctttatcatgataggttacagagcagtgttttaaccatattaccttgactgaggtatggtgaggccagatgtggatcaagagaaagaaacagggatggattttatggttttgaggctcacagttccctggggagacacagcaggctgtgctgggccactcagcggaagcacagagtgaggcatgaggcagagggagatgggggatggtagggaagcagctttattgtcgtctccagggaaaggaaaaggaaaggcagggtatgcaggtttaggattggctaatttgaaaatgttcttggggctctggggcatagaggctgtccccggttgtctcatacctggccccagggtgatgaggtaggtccacggtggcctagggtgcaagagccacttaagggaagtggtgggagtttaaactacttggttgactcctcaagaaggggaactgactggcctctagctagggcctcaaaacagggtgaagacagtatagaataaaaaatatattacaactaggacagataccaacatactgggggtttgtacctaccacagttattccttacatttatgtttcattttgtctagtaatagtgaagtgaatggagttctagactgaagtctctgtttaggcagactctgaatttgttttctcattggttcccagagatggactgagatacctcagtcctgtggatacctcaggcaggcttaaaatgtggcacaaattctctttaactattcagttgatactttttcgtgagggcttcaaagaggctgattttctattgctaaaaattgcatacctctctatgttcaaagaaaataccatttactttatatatgaaagagcatttgcttatttggaaaacttttatttgcatttcacattttttatcacttcttactaaatagaagtttctcacattctctagggattgaactaagtgataacttagaaagaaagtattgttcaaatacccattttttggcttttatgttagtaaaatgtttcccctttttctagcttttctttgtgatttcagaaacgtgcaacttctttgaacgcatattaaatgtttttaaatttaaataatgaaccacttgcttttgttacagcccagtggttcttcttgcctgctgcacagacagagccaaggcactgagacagtagtgttgcagcgagaaagatttaattattgctaggcagtcaagtgacagaatgagaggcatttctcaaatccactgccccaagagctcagaggctagggtttttaaggataatatggcatgcagggggctagggaataggtgctgctgattggttaaagatgaaatcattgaggtcttcatgcactgagtcagtttctgggtaggagtcacaggaccagttgagtcagttccctggtgtgagtcatgggtccaggtagagtcagtcagtagccagaatgcaaaagtctgaaaaatatctcaaagaccaatcttaggttttacaatagtgatgttatctataggagcaatttgggggcattaccaatcatgtgacctctggctagatggctcctgagcagtaagaaattatagaaaagcaagctaggggacaatggttggttatcatttagttactcctacattttagcagaattcaggcccctcccataattctaaccttgtcgcttttcattagttttacaagggtggttttcagtccctaaacaaggagggggttagttttgggaaagggctattatcatccttgctttaaaattaaactgtaaactaaattcctcccatagttaggttggcctatatccagaagagttagcttgggaggttagaagcagaatggagtgagctattttgctgactagctttctgtcattgtcataatttttagaaaggtggtctcactcttagtaaacagtagtatgctatgctttactcagttgtataatttcatttgaattcaacaaataactacagacagctgtcaacttagtgatgttgagattggggctaggcctgcagtaatcctctgaaatatgtatgtgcaccccaaaaacatgtcattgagatgggtagacacctgcaagaggagtgcttttaaaacgtttttacatgaagatgctttctacttcagtgagacttttgccagtggtgttagaagttgctgtgaaaaccaagataaggagccactgtgtttttgatttgttctagggatttaatatccctcatagttaatcactcaggcaattactgggttaacaatatgtcctgaagaagagtagtttttgagccatgttctttgaatcactaagattcttcaaaactgctttagagtttcccatgaacatttggatcacattaaagcaggctcattatttccatcttcatgtccatgtaaatgaggttgagttcttcacttggttctcagctttagtgttgttagtatatagaaatgcacctgattttttatgttaattttgtatcctgaagcttcattgcagtcgtttatcaggtctaggagtcttttgcaggaatcttttgggtttctctaagtataagagcatgtcactggggaccccaaaagtgaggaaggtgggagagaagtgagggttaaaaaattctctattgggtacaatgttcactatttatgtgatgtgttcactagaagcccaaaccttaccattatgcaatatacccatgtaacaaacctgtacacatactttctgaatctaatataaaataacaaagaaaaaaataacaaaaagtaggctcgttagtaagacaatagctgaggagccctgaggattggtcaccttctagcagagagaggaagggccaagctgatttacaacagtcctgatcaaagaagggtgacctgtccagggcaagtccacaagcctccccctctgtgtcatgaggccacagagcactggagttccatgaagtcaatggaaaagaagagttctactgcttaaacaagtttaaaaaccactgctctagcattgtttataagaaaagaaactaagaataaaaacaatactgaattcaaacagctaattccttaagacctgggaacattgtgtgttcttatgcagttataatttaatccaaatacattggaaccacaccataattcaattctaggtcaagagcagagttttgtatacagcagattcattttggagcactctctggggatttggttacagaaaaatccagaggatttatctgggctgtcttactcataaaactgcacaatggcctagattttagagatgacattacagtgaggtctcctccaggacatgctatggtatacaccactatacaccacttaatctttagagggctcatttgaatcacattatttatgtagtgtgtccacatgttagatttggccagattctcaaactggggtgtcagttccacgtctagcccattaatttgttgccattgtgaagacagtagacttgaatgccttcagaaggagcatgctgtactgcacaagtgcgaggggcctcattcctaaagtgatcacactgtgttttagggaattgtgcccctttacaatgctgtgactttgggtgacactctctagcttctatagtacccaagtctgggttgcgtctgaatttgaaatctctactatgagactgtattgtttgtttttaaagtcgatggagcacttgacttggagccagaagagaaagcttgggtcttcacgcttcttgattaattatcaagccagttaattttctagagcctctgtttattcatttgtcaaatgggacaaataatgtctgtttcacagggcttgttgtgaagattatactctgttgtgttatagaggtttaaagtggacctgtgggtttgtatgaaatacagcaaggtaacataaattaaaagtagatgagggataaaagcggggaaagggtctaaaatggggttaacaagttgtaccttttgtgcagatctatatgcttgctaggaatgagccacaaatttgcttctgtgccctctagcagccaaggagaaaatggaaaccttattttctttaatcatggtgtctacgagattgggaacacagtagggagtcatgaaaaatattccttttcctagtaacttaacagagagagaccaccctcaggggtctgcaaaagaggacattgcatggtacagcctatagtgtctgctacacagagaggttgcaaactggcagtccaccagtgtcaccatttgttgggatttttgttttgttttgtttaggcttgatgtctaaaaagtttgatccaacatttaaaagaatcagattttgcaaaaataacatttttaagttttctttcaaaatcagatgatcagttaatattgtaactatatatcaaaattaattggcactgtgtagcagcttttttttaatgtagcaatgatttcaggtttgccacagtctccaccattccctactgccttacttactacattttatttcctacttggcatttaggcatctgatttagtgactcctattctacagcatccttgtagtaggctcagcagtacgcttcataaggctgagaatccctgagaggattgattgatatgggaaaatgctggtactctgtacaatattgttctacaataaaaatgtagaattagaatattgaagttactgttagaactttgaaatcatgactgagggtttaaaaatgcttaatgagggccgggcgcggtggctcacgcctgtaatcccagcactttgggaggctgaggcgggtggatcacgaggtcaggagatcgacaccatcctggctaacatggtgaaacctcgtctctactaaaaatacaaaaaaaaaattagccaggcgcggtggcaggcgcctgtagtcccagctactcaggaggctgaggccggagaatggcgtgaacccgggaggcggagcttgcagtgagccgagatcgcgccactgcactccagcctgggtgacagagtgagactccgtctcaaaaaaaaaaaaaaaaaaaaagcttaatgaacgagagtctcaaatagctaattaaaacaacctcaacttccaaactaatctcctagcaagtagtttacccagagtatccattccaattgctctttaatcaaataaaaatttcagaatattttatttaaatatttacatagctatatattttcatcagaaaagagtatcacaggaaagacatgttttaagtatgcttttaactgtataaagtttgattgttaggctctatgatctggtgacaatagtcgttactgttagaggtgaatccttgtaaagttgttatttttgtcaaggtccactttggcttctagacttgttgagtttggtaagatgttttgagcgctgagttgctaattttccagaaatgtaatttgcaatgaagatgttggatggggctttcccaattatcagaaggaattctccaaagttgaaaatgagtgataattatctaatattctaaaacatgctgctagacatggatatagagtgtttaataaaagatgtcaaagttgtgttgtggccaccagccaccatcacagctctagccaacattagagatgactggtgatctaggaggagattgtggagggttatctcagtgaagagcctcataaagagtattggggaattttccctcccattgccgtggagagaagagatgagtgctcttaccctttccccaagccaagagagaagagctctgatctagagataggggttatggcaaccatgggagattggcatctcacttcccacttggatgcctgcggagctctctccaggcccatcagaatggagcacagcgatgattttagggatctgtgagcatatatacagatgcttccaacatacagtatttgatagatgcaaagttgctagagcagcctgtgaaagtgaggcaaagaaaaagatgttcagtggttgacaagctcaacttccaccatttggcagagaaagatgtgtacattttcgtggggccaagcaacatcaggaaaggtagagagtttgagcaattgttgctggttccttgtccagaggtggccttttgggttgaggcaacccagactgtgagaaccctgacatgtatgttgaagtagaagatgtgtgttttgggggaggggctcacaaaaggctggtcaaatggttcttccaccatgctagggaacttggaatagagggtccatgtgggcctctgaagaacctacaaatgcaccctgtgaaggtcccaggatgtgactgcctgccttgcacagctgactttggtagccaagagaattgaaaacagcacgacctgatgtaagaagatgttccgtttcctcaccactgatgtcacttccctgtgttaacctgagaagagctacggcacagagtgatggaggagagaatgaaagcagaggaggagggtaaaaggaaaggctacagtcccttccccactacaggtcatacaaaaggaggagggaaaagctttgagttggatatgagattgaagttttgatacgaaattactatacttttagtaagtgagtgagtcttagtttccataaataaggctattataagtgaaagtgatggaaaaatgatggggtcttcctgagctgtccagctgcagggaatggagatccactggaacaagtcaaagataataataatgagaaaaaaaaagattcttaaatccccaccattcaatgaaccagttaccaaacccacacgatacagagacattgagattccaatatgaatctctccacagaaggaggcaccttctcttgccatcttctgtgtattataaccatttttgggggggtttggtgcttcttgttcaaaattgaagtcttgtagccaaaagtcaaaatcatattcttctaaaattcacttgaaaaatatttccttttacagttgaattaaagcaaattacttggttaattaatgtcaaaggtgactctgttctagagataatttctgagtcatgatacctaatatttaaaaattatgttttgatttttatctttagtcatggtgatttcaaatgaggttattaaatcactgtaattcatgatttatataaaatatgaagacattaacctacaacatcttggattgctttttttttttaattgcattagtcactagtaccttctaacagttccagtttttggaaggcagcctctagtttcctattcagcctcatcatagctgttccttttggagagcggtggagaatacaggattgaaggtgaccctcacagcatgacaaattgtcaatctggctccctcagaaaccttatagggagtgtattagtcagctttggctgtcgtaagcaagtaccacagactgggtggcttaaacagcagaagtttattttctcacagttctggaggctggaaagtccaagatcaaggtggaggcctctcttcctggtttgcagaatcccaccttctcactgtgtcctcacgtggcctcttttctgtgcacttaagggagggagagagacagctgtctggcgtctcttcctcttcttctaaagacaccaatgctacctattagggcccatctcttatgaccatagttaacttccctaaagggcctatctctacatatattcacattggggattaaggtttcaacatataaatttgggggcctggggagaacacagttcagtccataacagagaggaagaaagagattcttaaaaagtgttctcttctgcaagttgacatttctgaaaaatatgtttattctccaaatttaagagacttttagaaccaattacctgtgaaattttcttttccaaatgaccgaaactcaactcaaactagctgaagcaaaagtggatattttttggctcacatagcagatggccaagggtcagatatgtcagccacagctggatccagggtcgatgtcatcaggtctttgtcctccccttgagctctgtgtccccccatgttggcccctcctcaggagggtccttttcctgtggtggcattgattacctggggcagctccaggctgatctggcccttagaatttgcagctttaaatggagagaaactgtctcccaagagtcaactctgactgcccccgcctgggttagggatacatattagcagcctggacccagggcctatctgggtggttatgggctggcattcccaacagctgggagaggaccaaatgaaagattccaggcagatcaaactgtaaggcatgtccacagtcttccccttctaagtttctgagctaaaacaacttatttgtcctttgtgacttgtataattgtataattgatagtccagagaaggtccaaattagttcatctttatatgtgtaagagattctatctaaaggtcatcagaacctttttgaaagtcaactgatgtcatgttggcctttgctggtgtttctctgcagactctccggacgacccagccttgtcaccacctggagatttggctccagcctggctaaccacaggctgttgacatgatggctgtggtctctctgcactcctcctccaacctcccccttctctatcctcttatgcatacctattgttgtggtctaaatgtatgtgtcccccccaaattcatatgttaaagtcctagcccccaaagtactagtattagaaagtaggtcttttgggagctgattaggtcatggaggcagggccctcatgattgggattagtgcccttatcaaagaggcttgagagaggtctctcacccctttcaccatgtgaggacacagaagacaccatccatctgtgaaccaagaagtgagccctcaccagacaccaaatctgccagcatcttgatcttggacttcccagtctccagaactgtgagaaacgaatgtctgttgtttatcagccacccagttggtggtattttgttatagcagcccaaatggactaatacacctaatgtcacccatctcatgtgaatgtaggtgctcatctcttgcctgaaattcttggggtcaagtgtgttctggaactcagtttctaatttcagaaaggccatatcgtatacacactgtttactgacacccttagcagagtctgggacagcacccagaaatccatctcattaacatttctgcagagaaacacgtgaacattcatactacgtaggataaagaaaatcaatagtagccttatatcagttcaggtcaggttttgtcaccaaacacattacgagaaaggtttgttctcagggcttttcgtaatttcagaattgtaaacaagggatcccgaatttatattttcttgtatgcattaagtgctacctttgttggactctcagcagctaggactggtctccataaaatttaaaacttaagaaacattttaacttaaagcactttaagcagcactttccaaagtttaaagtatgtaagtaaatctgtgtgagtagataactataaagaacaaactttcagccaatatcttcactttgagtggttactggggggcaaagaattagaaagccactatgtataaaattaaacatttttatttgttcatttctttaaagtacaacttattttccgggagaggaaagtactctcaccaaagaagatttttacagagagaaatcaggtcaacttgaaacttgtttgcaactctctatttgtaacaacctttgtggggttttcataaaaggattttccaagtcttttgtcttcaagaacataaattagaggacactcttaccaggagtacatgcagtttaagtacccaaaaataagtttgtttaccacttagaatcatggagttcaagagaattttcaagtttgcaatcctgggtctctcccagggacattgagagggcagaatcgattctagttttgctaatgcgcctgccaactggtgtcaccatttcccatcacgatatctcagttatcccatctgtcagctctaagagtctttgatgtatttcaacataccatgctttcaggaacctctcggtaccacgttctggtgcttggcagctgtccaggatgaatttgatgtacctctccctgatgcctgccaggagggagttggaggaggggcttaaaggattttctggtaaatccaaatgatcacatatgagctgttatcaatgtgggagaatggaattaggggatagtcttctcattagaattgtgaaaattcaggatggtggaaatactcagtatgaagattttcaggttggctaagtgtatgtgaaatgtcctaatttgaaaaacactttggatttgattgaattagtggtgttaaattagtggggtgtggtgggcatggtgacacggtgctgggcatccttgcatacatgacggatcagaaaaccagcaatccaggcaactctgtggccaatgcggcattttgggtccaagccccttgaccctgtgtctctctccttgcttcatgggaaatcctgccacctggctcagacacaggcctgggggttaaatggagcatgtgctgccaggtactggtcagtgccctcaagggtggagaagacctcttgggaaccacagacaggctgtagggttgtcgtgtttgtctgtttttaagtgacaggctgcttgatctcatcccattagtagtgacgttgctagaggtagagcttgcaaccacccccttcccattaactctaccatcaccacctgccgctaactactgacggctacccaatggccacaaggcacataatattcacggagagccaaagtggcttgcctgtgtcattacagtagctctccttgttaagagtctcttaaccatttccctccttcccacaccccactcttcacacatacatgtacatccctacctgagctagagccctgcttccatccactttcctggccttccccaagctgcctgtgcaaagcctcccttttctgctccctcagcctccggtttcttcctttttctatacctttccccaacaatttcagcctttattaaccttttccttctctaactatcagtcctatcgcttttttgggggggggggcgggaggcaggtgggaggtgtacagctcctcatacttgctgttctgtttatgtatgctctatagcaaactatccccaaatctaacggcttaacacagtaaactgtttccctatcatcactcatgattttgtggatcgggaattccagccggactcagctgggaaattcttttgctcctcgctgtattgaagggggtcgctggatactttcactgggcagatgggtgaactggaggtgattaagatggcttcacatgcctggcgccttggtgggatggctggaaggcatgttcagctgggtgtgtccactggggcttccacacatggtggtctcaaagtagtcagacctctttcaggtagctggcttccacaagagtgagcatttctagagaaaggaagtgtaagtggccaagcctcctaagcctgggcccaggatcctctctgctgtattcggtggttgcacagttatgccgtcctcccagtttttacctagcccccacctctctgtgtgttacaacaaagtctgccaccactattaatcttccacacgtgcctcctccattctcgaatgttcttgaagattatattgctttctccaaacctaaactgtctcataagtttttggcgcttaagacaagtttcaagaaataagaattgaaaagtgttggaggaaagaaagtttccatctctaaccactttctcagaagggcatcagggtttttgcagcaatgtggggatacctcttctgatctcatagcttagggctctgaactaaactgatggccttttctagatttcttcctaggggtgtcaggttggaagtgctgagggactgctctttctccccagggctcagctgtgtcaaggctaagaccaggagtggttcccacagccaggctgggtgagggcaagtttatcctgcggtgcagcacctcagaccagggtctagccaatggtggcctgcaggctgaccccagtccaccacctgtgagcagccaccaccacctgtgtttatactacccatgagctaagcacgattgtcatattttgtttgtttgtttgtttgtttgtgaggcagagtcttgctctgttgcccaggctggaatgcagtggtgcaatctcagctcactgcaacctctgcctcactagttcaaatgatttctggctaatttttgtatttttagtagagatggggtttcaccatgttggccaggctggtctcaaactcctgacctcaagtgatccgcctgcctcagtctcccaaagtgctatgattataggcatgagccactgcacccagccaatttttatatgtttagatgattgggaaatagattttaaaaagaataatatttcatgatacataaaaattataatgacatgcaaatttcagtgtccataaataaagtttctttggaacacagtcatgctcattcgtgtacatggtagctgtggctgctttcacactgtgagagctgggttgagtagttgtgacagcaattattagatgacctgcaaaaccaaaaatacttgctatcttgctctttacagacaagtaacttttttgctgttcttgccaaagaccaaatgcatttttcaaagctggattccaggctcagagttacagcaaagagaacagaaagtatagctcatgattgggtgctgacaggacaagggagagagacgaaaaccattaggagcattagcaacaaatatattttttgccattccaactccatggagcaaatggcttcctaaaagccagcagagaaactaattacctgaactgggagaagaatgaaagactcattgttagaatattcctcagagctgaatcccttctttcagcctactgtattttagtgattcctaataaaagaaaaaaatgtatttttgtcctcacagccaattaatttctgctccaaagcatagaatatgattatttctgtcattattttagtttccagagtcattgatgagacagggaatgacacatacctattaacacactcgcacactcactcacacactcgtgtgggtacatgcatttccctagaagatgtactggaaggatctgactttactttcaggtgccttcatgtcctcgcaattattctacaaatggtttttaagatatttctattgtatttgttgaaattttcctgacattttgacttgtctagacgattattcttgcatccagcacattgtaggaaacactcatttgaaataccccactgtgcttccgggggagctcatctttctggagcatggcgggtccctcatgaggccctctttcgttaaccgaagaacaagctgcagtctgaatgtgagttgttaaaggtatggtattgggagttttctgttctcctgttttcccattctgtaatgttttctttctttctttccttcatttcatttcatttcatttcacttcatagcaacttttgaatgaaaacctccccacagggtttgacaggcaatgaaacttcctcccttgggaggtgtctcagcctgagggaaatggaacagcaccccacagaggattttcctcacttcctccctctctcctttacaaatcaatgttaaagagcctgcatggatgtggttagcaccatctctgccgcatgtgacttttcagtcattttcacccgaaataggatttcattcaccagttactataagctactcgtgccttctaatggactttgcagcagtgattcatccaccctgtgctgggagagagaaagagactttaggtgagaaagaatggttgggagaggggagacaggtaggcagaacagttgtggtaccatcccgccccataagacaataatgatattcagtgttaggcgctttataccaagaaatattccacctgacacattatcctggttgaatcttatgacacatctgcaaatagacattaccaaatacagagggggacttttaggttcagagaggttaagtgacttgcccagtaacacactgctggcaattcgacctgatctctctctttcttccgccttttccatttcagtcagtggcagtgccatctttccacctgcttctgtcaaatgtgttggtgtgatttgatttcttttctgtttctcttgtatcttttaatccagcaataaatccctgctggctctacttgtaagatatacccagaatctattacctccgcccccccaccacccaccttgctccaagcctccatcatctctctcctggagcactgtgatacccttcttcttggtcatcctgcccctgccctgacttccctaaagttgatgcccaacacacaggcagataaaccagatcagacttgtgactgttttcccattctttgggcaatcccattgcattccagataaaagcggaagtccttagagtactgcagtttgcctcctagcccacgttatctctggccttcctttctcactttctccctccattccagccacgttggcttcctgctgtctcttgaatagtcagggcctttgcccatgctactccctctgcttgaagcactcttatcccaggagactgcatgattgagacccttacctccttcatgtctttactgaaatgtttttacagtgaaacctatcttaaatttttttttttttttttttttttttttgagacagagtctctctctggagtgcagtggcacagtctcggctcactgcaacctctgcctcccgggctcaagggattctcctgcctcagcctcccaaatagctgggactacaggcacccaccaccatgcctgattaacttttgcatttttagtagagttggggtttcaccatgctagccaggctggtcttgaactcctgacctctagtgatctgcccaccttggccttcccaaagtgctgggattacaggtgtgagccactgcacccagcctttgtatagctttaatgcatcaaatatgggcttagttcctcatgtaaacaattctcccaggaaattagaggataaaaagttaaaaatagcatatatgtcctgccctcaggaagtttacgttttgaaggggggatacaacaaaaagctagaatttgtagcagcgtacaacacatgccaataaaacttgcaactcaagccctgtgcacagagaaccatttggcagaaattctagagaggcttcctggaggaggtgctagtagaggagaccttgacaaatggggatggatctagatcaaattcccctatgccacgtgctcctctttgcgttcagaatgctcttgtttgcaagatttcagccatgtacaactcttctggcactcagccatggactaaaacgaggttcatgcccacagtattggtctgcagaaaagcatgagactggatgacagtcagaacaaatggaatcctctagggtagggagaagagaaagaaagaggaaataaaacagcataatcccaggaactgccaataggaaaggatgggagaaaggacaactggcaaagactctgatgtggtgtccagcctttcagatgtcacctgaggacgttgctacaattaacatgcagccagacacacacagtgactacacattttggtgtggttggcggcattagttgagtcttaaacaaaagcaatttcagttgcaaatcttgtgccaggctttcagagaaagagaataaattatgctgctgtgacaagctgttccactgtggcaacaatagtttggacttccagtgctgcctgtcaaccaggactgaaaatacatcttcatttgttgctgggcagctgggaagatgagtcattaaagaattttataatacatcaaaggccatgattttctacctttcacgcagttacaccttttcccaagtcctcattctgccacaaaaaacttttgaatgcaccgaaagttaagtagaattccttttaaaatgttctgttctgtgcacatatctctaggggaagtgcagaagacatggggcattcccttttgtcatgcatttcagctccataaagatttattgaccacctactatatgccaagcattatgttagtcagtggggttaaaaagatgagcaaattgtggtcttgaaacccatgccttttgttcagattattacagtgcaagagaagcagcatcagccatgtgtctgagaggccagaggaaggagagagtgaggaaatattgtacctcattaatattgttcctctcgtttcaccactgtattaatctgttctcatgctgccaataaagacatacccaagactgggtaatttataaaggaaagaggtttaatggactctcagttccacatggctggggaggcctcacaatcatggcagaagttgagagaaaagcaaagggacgtcttacatggtggcaggcaagagagcttgtgcaggggaactcccatttataaaaccatcagctctcatgagacttattcgctaccatgagaacagtatggggaaaaccacccccatgattaacttacctcccactgagtccctccacgacacatgggaattatgggagctacaattcaagatgagatttgggtgggcacacagccaaaccatatcaaccactgtagacatgaccaagttcagacttggtcagtagtcaaatgagcctgtgagagaatggtgccacatctttcctgtaagagcacagcattttaacctgcgatggatttgtgagcagtcattccaactctgtattagttttctacagttgctgtaacaaattaccacaagcttaatggcttaaaaccatgtaaatatattatcccacagttctgaagtcagaaatctgaaatagataggctaaaagcaaggggtgacaggctgcattcctttctggaggctctaggggagaatctgtttccttgccttttccaacttctagaggccgctggcattccttggctctttgccccttcccttcttcaaagccagcagcagtagttgagtcctccttaacacagcatcactttttttttttttttttgccttcttcttccacttttaaggactctgtgatggcactggggccactgggataatcgaggataatcttcctattttaagaacagccaattgacaaccttaattctaagcaatcttaattcccttttgccatgtagctgaacatatccaagttctggggattaggatgtggatgtattggggtggggaaattattcttcctaccaccaaccctcatccatctctaaaggcactgatttttttgataaatcagataagtaccagagatgtgtactctgggctcaggagtgaagagggttagctggcctttgccaacagtgacttcatatcaccatactcaatgcaattgaggtgacttaatcaaggggaaaagatggacagcatgttttatggaaatagcacttgcctggtaatcaggagacttggattttagcttctctccttcaaacagactactgagtgtcagtaggcaagttgttgaactgctctgggcctctgtaaaaaatcaaggttgtggttagatgttctcaaatcctctttcatcctctagccttccatggctctcaatttctacagggaatgtactggaaatggagagaggctagcctgtggaaaatgcagtgccattatttcagcatcaaaatcctgaaataagatacagaatgttgtgtaatatacagctcggtgtctgtgcccttttatttctctcttgggcccagccccatcatcctgtccttgatcattgtaatgcagtgttcactaccagtcttttctccccctacattggaaattatgccaaaagagtaatgaatgaattaggtaaatgaattagatgaattagagataaaattatggctctacagttgaaatatcagctttaagagaatcgacttggagaccaggtgcaatggctcacgcctgtaatcccaacacttagggaggccaaggcgggtggatcacctgatgtcaggaatttgagaccagcctggccaacatggcaaaaccccatctctactaaaaatacaaaaaattagcagggcgtggtggcaggtgcctgtaatcccagctacttgggaagctgaggcgggagaatctcttgaacctgggaagctgaggttgcagtgagtggaggttgcagtgagctgaggccgtgccattgcactccagcctcggctacaagggcaaaactccatctcaaaaaaaaaaagaaagaaagaaaattgacttggagatgtacgggttcacatataattgaaagtgagcattccacagtgacttgagaaagttgattccggctttcaaagcttgcattatgggtaagaaacttgagcctaaaaagaacttatatgtatgtgggtcattagacaatctcctccctcaccacctttttttttctttaatcaaagaattatacatatgcaagtaactgaatcacctcttctttcatttttttccctctttaatcacagctgtgtggaaagtttccagctaggcattaaattgggtcaacagctaacacagcataagtgtggacagcaggggcaatcggtggtatatacataggaaataaacgacactgtgctgctggcattgataagctgttgaatagtgcaagggccctattaagatttaaagtaataaaagatgggaggaaatatggttaccagcagctgataaacattcttgccttatgaaggcattagtttcacttaatggcttctagtgcctggagtataagctcttgtaatttttctcccccagagcagactgaaagaatacctaggaattgtcatctttgtagttgctcaagaaagatctttgggtggctgtgagcagatctgaaaatagtaagtatggcaggtacatggagctgcatccgtttgcaaaagctatcaataaagaaaggtatagaaaggatgcccttgaccccggtatgtgcagatagaagtggaatttcctccggaatgtgcatgcaaatgtgcctagctgcaaaagaagaggcattccctgctcaggtgtgtagagtgatttagaaccatttgtttctgctcaatggttctcaaatgaacagtatttcctcactaggaaacagtgctaattccaggctaggacggtccacagagatggtggctgtgcccagatcattcttggaaatctgaggaagggagtcatttcttctcatgccacacccagtaaggggtacattagatactctatttcctccaggcagatctacagtgaccaggaccacgtactaggataggagaggttctggcactattcatcattggctccggaaatagctttcccctctgagctcaaaggtaggctcatcctctgctagagtctattaggtctggtgggattggaactcaggtgcatacccctgggctctccaaccactagtgctgcatccagggcttggggtcctgctttgtgccatcaggtcatcagtgacatgactagggcagctcaacccgcacctctggcatcactgccttcctcccatggccccctagcatgaacccaaagaccacagggccggttccctccttcaggcccaaggctgggcctccaaataatggcctcccaaagatgcccacattcacatgcccagaacctgtgcatatgttaccttatgtggcaaaagagactttgaaaatgtgagtgaattacaatatggagattggcctgggttatctgggtggactcaaagtaatcaataagagggtgacaggagggtcagagtcagagaagaagttgtaatgatagaggcagggagccatgaaccaaacagtgtagacagcctctagagactagaccaagcaaggaagtggattctctcccagggacttcagaaggacctcacccctgccaactcatccgaggacttctgacctccaaaagtataaaataatacatttgtgctgctttaagtcactgagtttgtgataatttgttataacagcagacagaaactaatacagtttatcttattcctttactcatgatcaactactttggggttaacgaacaacagtatatttacttccttcaatgaaacacttacctccacccaccagagtgaaagtttgtcaccctggttccaacaaatgccacaaaccactgtatgatcatctttgggtaggtcagcttgtctgctatggtatttttcttttatattgcagtttacaaagtgctcatttgtcttgtatgatagttatatatggaaggtagcattactatttcacttttctgattttctaaaaaatatctttaatgaacacatattaattttgtgattaaatgacacaataattagaaatgttaaaaggagatggcagttttagtcacttaataaccataatactaacaaattcaggccacatgctatctcagtggatagtccccagaaccaagttaggctagttcatgaggcatttcagatagctgaagggactaagtatacactggaagattgggtacgaagatcaaaagacagctctacaacaaagcttcatgggccattggtttcacagtagggggaactgaaatccaggctacagattcaaaagcttacaacctggcaatttatgtagcatagggaatcaatgtctatagtcttaattacatagaggctaaagcctcaattattctatttctgtaggcaggattcctacataatctatagcatctattggcataaaacattcttagtggccattctgggtacaagcatcccatttctctttctgtccttccacacactaccagtgtctctcgcttatttcctcccaactctaatgttcatatgtgggttatttgagcttctaagttaattccttgcctatatgtaaggaacatattggaaaattataaccaaagtgtagtatatattgcagagtctctacttcccatgagcagctttggagggtacctcacaggagagggttagctggcatctttccattaggaagccagcatcagcacaaggggaaaacttctctccaacgtctagacctctctatcccatgagactttggggactgggactgggtagcagggcagaattgggggaaggaggcacttaagagctttttaatttcaatattctaaccattagtgagggtgtgctgctgggtacatgtctgcccataaataaacatggactgttcattgaaacttgcatttttatgtagaaaagctcatgctaccttatcactttttgcacaaaagttgacacattatgaatgctttaaaaaaaaaattataccttactcccatacactgaacatatctttcctcatctaaaactatccaagcagccaactttttaaaattaatggaaggagagggtctacagcatgtattctcaatgggggcaatgtagccccctaagggagccaaaattggttctgggttgggagtggtgaaaaaagtctttaaaaaaataaattgcagaatatacatgcagcacatagattgatatatatatctgtgatattaaaatttcatatggaggtagttgggaaaaaatgtctaaaaaacctccttagggtgatatttgatatggttttgctgtgtccccacccaactctcatcttgaattgtagctcccataattcccatgtgtggtgggagggacctggtgggagataattgaatcatgggggtggtttcccccatactgttttcgtggtagtgaataagtctcatgagatctgatggttttataagggatttctgctttcacttctcattttccttcttgcctattgccatgtaagatattccttgctcttccaccatgattgtcaggcctccccagccctgtagaactgtgagtcaatcaaaactcttttttctttaataaattacccagtctcagatatgtctttattagcaacatgagaagagactaatacaatattgaaaaaaaaaaagttgagaaacactgatctatagtaaaatttaaatatccaacttctactatttttttggctgtccattcccagtagaatacaagttccatgaaggcagggatatttgtcttttttgtgcactgatttctcctaagtgcctagaatggtgcctgggatgtaggaggtattcaatccatacatattgaattgaatgcatgaatgaacaacttccctcagtgtcccagagtccactttctctcaacactgcaagtggtggcaagctggaaggtttgtgagcagtgctggagctgggctcttccaggtgcattcacaatagtttaaaatagcaggtgcatcagaggaggcctctttgttcctggtactatgctcattgatgtttactatgagccccttgcagactcaagcatccattgtttgccttttaaatatctctactagccgggtgcggtggctcacgcctgtaatcccagcactttgggaggccgaagcgggcggatcatgaggtcaggagatcgagaccatcctggccaacatggtgaaactccctgtctactaaaaatacaaaaaatgagctgggagtggtggcacgtgcctgtaatcccatctcctcaggaggctgaggcagaagaattgcttgaactagggcatcaaaagttgcagtgagccgagatagcaccattgcattccagcctggtgacagagagcgactccatctaaaaaataaaaaaaaaaaattttaaatttaaaaatctctactctccaggccaggtgcagtgagtggctcctgcctataatcctagcactttgggaggccgaggcagtcagattgcttgagttcaggtgtttgagaccagcctggtcgacatggtgaaaccccgtctctaccaaaaatacaaaaattagctagacttggtggtatgcacctgtagtcccagctatttgggaggctgaggcaggagaatctcttgaacccagaaagtggaagttgcagtgagcaaagatcatgccactgcactccagcctggacgacaacgagactatgtctcaaaataataaaataaaataaaataaaaatcctctactgtctacttcccccacccctaatatcctagctatgtggcccaagtacttatttagcccagtccatgaaagtaaaggacagtggacagtgtcctttgataggaggatggggcagaatgggaaaagaaaatggtagggtctggaggtacaagtgggggccagagagaggggctttacagattattcgggtgtttgaaagtcagttggtgttatctttaacatacaaacatgtattatgaatctctgagcatccttcaacgattcctgaattttcaaaacagttgtgtccaaatgacacaccttgtccagaaacaatttggttttgatagaaaaagaggcaaaataaaaacactgatttacaggctcatggtgaggggtttggggaggcagatgagaagagaacctagaaaggatgtcaagagcagacttagctgacctcactttgctttgggcttgctttcctacagacattgacagtgagagttgtttttgctcaccacactgggaatatgtattgcttaggagacacatggcagttaaggcaaacagcacatgccaacaatatgttgcatgatttgatgcctgttttcagggaacttcactaggaagtgtgtgtgtgggtttatatagccacgtacatacatatacatttatatatgttttatatacttagaaataaatacggaatttgttacaggaacgtggccttacacaatcatgggagctggtctgccatcttcattaagccattgtctggtacagatgctggagtttgaagtctgtaggataggaaatcagatgttgtctcagttggcacctgctgcataatacggtaccatagactaggtggcttaaacaacacacatttattctctcatacttccagaggctggaagtccaaaatcagtgtcttgcagggttcggtttctggtgattccccacttcctggctgtgggcagtgccctcttgttgtgtgctcacgtgacctcttctttgtgcacatgtggagagaacaggctctccagtgtcttcacttataaggacactcatcctatccgattgagaccctaccttatcatcgcttaaccttaattacttctgtaaagggcgctatctccaaggacagttatattgggattggggctttaacataagaattttgcagggacatgaattgcagtccatgacagatgtaaactttgagaaacaggaaaaagctggaacctacaagcagaagtgggaacctgtgaggttggactgaaactcagatcagttcttgctgcctctgaccttgatgtatgtatcctggaggagatgctggcatctctcatcatggagctaattgtaggacaggcccagaaatggaagaagctggaagagagtctagtggaaggtggggcagcgtgggcccagctgctgttgcctgccaaagaggtgagcagcagataagtgacgaggtatgtgagctcacacacccaatccactgtggcacttctgccttccagatcctccataagaaggtctctttggcctactctgctcagaaatatataaggcaggagattctgagaaatctagttgagtccagccacgttgacatgctacaaagccaccacagactctaaggagaaattatgtccagggttgggagaagagagccattagctgtacttggatgaacagttagtggcctagaaactgatctagaaagggatctctgttgatgaaaaaggacagtggtgtaaataaaggaagagtgatttggcgatggggtgttggttcagagttaaagacatgagaatgacaaagaaaggacaagggtggcaattgagatagatgcctttattaagtatagggtatagaagtgtagaatagagaagacaaagaaaagcaaaagaactgaatagctagaatgtattaatgcagggcatcaggcatgtggagccagctaaaaagtgagagatcaaacaagattcttagagcaagagaacatcagtaggaactagccacatttatttcacggactcaatgatactgagtttctactactacagggtactgtgtttgatgcacataaaaattattaacatgtattcctgcttatcattattggaggcaggggttgtgaagtcagcatggtccccaccgccacgcccccaccccaggccaaactctaaaggtatttacctgggttttctttcgaaaaaggaagaggtcttattttttttttttatgggagctgagggcagtggataaatttggaaccagacagttgaagtattaccataagcatcagaaaaagtgaataggtttttaaaataatagggaatagagatagaaagcaatcaacaaggcttgttttagaattaaaactctacaaagtaaaagatgtagcctgaatgacccttgaaatcacatgtataatttatagcacctgattccctccaagtcatggtacagaaaatgtatgtctcagctgtgccatgctggccaatctggtctagcctcaggcttgtcacatatgaagtggtgatgacatatttatatcacagaacaattgtgaaaaacaacggctaatgtagttactcaacaaatgtagtgtgcactaaccttatgctaggcactattcccggcactagggacacagaaatgaagagagaaacaatgtcctcattctcgtggaacttgcaaggtagtcagaagagacattttattatttaatctctcactgtctaatatcatagaaatcatacattcacattcatccagagagatagttattattacctttttcacatgctgaaacagaggttacttgtctgagacctcttgctatcaagtgttaaaggtgagactgagtccaggtcttatatgactccatatgcccagcactcttcaaacggccaaatgcctcgtcccacagaaaatagaagcccacagtcctcatatactataaaacttaaatagaatacattatctcatgtggacagatggttatgactttataaactaggaaatcctatgtaggcagatgtttagttgatgaaaagaagtgtaaacatgaccctaatgaatacatgttctgcaagttattggttgctattaatacagagatagttatgctgtattaacggacaaataaggcatatgtagcaagctaaaaagtgagaagtgaaacaagattctttttttttttttttttttttggagacatagtctcgctctgtcatccaggctggggtgcaatggtgcaatctcagctcactgtagcctccgcctcccaggttccagtgattctcctgcctcagcctcctgagtagctgggattacaggtacctgccaccatgcccagctaatttttgtatttttagtagagctggggtttctccatgttggccaggctggtcttgaactgctgacctcaggtgatccgcctacctcggcctcccaaagtgctgggattacaggaatgagccaccatgcctggcctgaaacaattttcttaaggcaagagaaaccactgggaactagccacatgtatttcatgacttcaaatgatactgagtttctactactagaggaatacatgcaatagaggaaataaaagggggtgatgggatcgagtgatggaggagaagatctctttagactggttggtgagggaaggcctctgtgaggagactattgagatatacctgaggaatgggaaggaggcagatctctgaaaatctggaggaagccctttctaggagaaggaacacacaagcaaaggccctaaggcaagaatgagcttggtgtccttggggaacaaaatgaagatcagagtggctggaggttgctgagcaaatgggacctggttaattcatgcatctggaaaggtagaaaggagctagatcctgcaagtccttgcaggccacagtaaggaatctgaattttgttaatatataagacacaaggtattggaagacacaaagtcatcggaagattttaagcgagagtgacaggccattggtattttttaaaaaatcactgtggctgctataaaactatcacttatggagcaactgtaggctttttgctctttttaaagattattgtgcattggatcattcatggatgccagacttgaaatgaacaagatggggaataatggggaacttctggaatatcagtaaaaataaagaagctgctaggatcctggctacagtgtgaacccttgagttgtggcagccgtgagagatggatgtgatggctgtttggtcctgcgagtcacttttctctatcaaatatacttgaccttcatgtgaccctttccatctctttgtgaccaagtaccaagtgataagcgttaattaatttttgggtcactgtgacagatcatcagtgtgctacacttttcaggtaacaggtttccgtgaaccatttgcaatgcccaaattataagaaatcccttaatatctgactctaacagagttgcagtttccaagtctatagcatcccactaacagaggggttggaagacaagatggagccacaaaggtagcagtggcaacccgtccacccctgcttaatgctactcctggtttaagacatgagcccaatttctctttagctggtaggatgacagaaaaagttttaacagcttttttgaggcataattgatattaaaaaggacacatatttcatgtgtacattttgatgagtttggacatatgcaattacctgtgaaactatcatcacaatccagggaataaacatgcctgtcacctccagaagtttccttgtgcccccttgttgtttttgtttgtttgtgtggtagaacacttaacatgatatccaccttcttaacaaattttttaagcgcacaatacagtattgttaattatagggactgtgttgtacaacagatctgtagaactcattcacctttcataactgaaaccttctacttgttcagtaataactccctatctctccctacccccagcccctggcaaccacgattctactctctgcttctatggttttgactattttacaatcctcatataagtgtgaccatgtagtatttgtccttctgtgactggcttatttcacttagcatagtgtcctccaagcttatctatattgtcacgtatttcagaatttccttttttaaggctgaataatattccactgtgtgtatagactatattttctttattctttcatccatcaatgagacacttaggttgtttctatatcttgactattgtgaagaatgctgcaatgaacttgggcgtgcaaatatctcttcaagatcctgatttcagttattttggctatatacccagaagtgggatcactggatcatatgatagtgctatttttaatgtttttaggaatctctgagatggtttggctgtgtccccacccaaacctcatcttgaattgtagctcccctaattcccacaagtagtgggagggacccagtgggagataattgattcatggggatggtttccccatactgttctcatggtagtgaataaatatcatgagatctgatagttttataagaggttttccctttcccttggctctcactctctcttgtctgccaccatgtaagacatgccttttgccttccaccatgattgtgaggcaccccacccccagccatgtggaactgtgtgtccattaaacttctttttctttataaattacccagtctcaggtgtgtctttatcagcagcatgagaatggactaatacagtaaattggcactgcgagggtagggagctattgtaaagatacctgaaaatgtaaaagcaactttgaaaccaagtaacagggagaggctggaagagtttggagggctcagaagaagacaggaaaatgtgggaaagtttggaacttcctagagacttgttgaatggctttgaccaaaatgctgatagtgatatgaaaaatgaagtccagattgaggtgttctcagatggagatgaggaacttgttaggaactggagtaaaagtgactcttgctatgttttagcaaagagactggtggcattttgtccttgccctagagatttgtggaactttgaacttgagggagatgatttagggtatctggcagaagaaattgctaagcagcaaaccattcaagatgtgagtttggtgctgttaaaagcattcagttttgaaagggaaacagagcataaaagttcagaaaatttgcagcctgatgacgcagtagaaaaacccattttctgaggagaaattcaagccggctgcagagatttgcaaaagtaacaaggaaccaaatgttaatcaccaaggcaatggggaaaatgtctccagggcatgtcagataactttgctcccattacaggcccagaggcctaggaggaaaaaatggcccccccacctgctatgtgcagcttagggacttggtgcccggcatcctagccattttagccatggctaaaaggggccaaggtatagctggggccatggcttcagaaggtgcaagccccaagacttggcagcttccacgtgggcacacagaagttaagaattgagttttgggaacttctgcctagatttcagaggatatatggaaactcctggatgtccaggcagaagctttctgtaggggtggggccctcatggagaaccctttgctagggcagtgcagaaggaaaatgtgggattgaagcccccacacagagtccccacaggggcactgcctagggaagttgtcagaagagggccaccatcttccagaccccagaatggtagatccactaacagcttgtatcgtatgcctggaaaagccacaaacactcaaagccagccctgaaagaagctgggaggtaggctgtaccctgcaaagccacaagggtggggctgcccataggaacccacctcttgcatcggcgtgacctgaatgtgagacacagagtcaaaggagatcattttcaagctttaagatttcactgccctgctggattttggacttggatgggacctttagccccctcattttggccaatttctcccatttgggatgggtatatctatccaacgcctgtacccccattgtatctaggaagtaactaacttgcttttgattttacaggctcataggcagaagggacttaccttgtctcagatgagactttggactgtggacttttgagttaatcctgaaatgagttaagactttgggggactatagtgagggcatggttggctttgaaatgtaaggacatgagatttgggaggggccgggggcagaatgatatggtttggctgtgtccccacccaaatctcatcttgaattgtagctcccgtagttcccacatgttgtgggaaggacctggtgggagataattgaatcatgggggcagttcctccatactgttctcatggtagtgaataagtctcatgggatctaatggttttatatgggttttctctttcacttggttctcattctctcgtctgccaccatgtaagatgtcctttttgccttccaccgtcatcatgtggaactgtgagtccattaaacctctttttccttataaattacccagtcttgtgtatgtctttatcagcagcatgaaaatggactaatccaatctccatactgctttccatagcagctacaacattttacattttacatttccactaacagtgtacaagggttccagtttctttacatccttgccagcacttgtctttttgataatagtcatcctaacaggtgtgaggtgatatctcattgtatttttgatgtgcatttctctcatgattggcaatgttgaccaacttttcatatacttgttggccatttttatgtcattttttgagaaatgcctgttcaagtcatttgcccatttttaaatttgtttattttcttgccattgagttgtagtaggagttccttatatctcttaggtattaaacccttgtcagatatgtggtttgtgaatattttatcccatttcataggctgccttttcactctgttgattgtttcctttgctgcacagagctttttaatttgatgtagtcccacttgcctatttttgcttttgttgcctatgtttttggtgtcacatccaagaaatcattgcagagaccaatatcataaagttttgccccatgttttattctaggaattttatagtttcaggtcttacatttaagtctttaacttactttgagttgatttttatatggtataaagtaagcattcaatttcattcttttgcatataagtattcattttttgcagcataatttatcaagggactaacctttctccattgtatattcttggcacgcttgttgaagatcagttgactgtatatgcatgaatttattgctccactgtctcttctgttccattgatctatatgtctgtctttacgccagtaacatactattttgattactctaggttcgttatatattttgaaatcaggaagtgtgatgcatccatttttgttcttctttctcaagattgctttggctttttggggtcttttgtggttccatgagaattttagtattttttttttctatttctgtaaaaaatgcccttgggattttgatggggaaagcatggagcctgtagatcactttgggtagtatagatattttagcaatattgtcttctagtccacaaacacagggtatctttccattttttatgttttctttaatttatttcattgatgttgcctcagtttcagtgaataatcttaaaccttcttggttaagtttatcctaggtattttattctttttgctgctattggaaataggacccctcccctcccctccccttccctcccttctttcactctgttgcccaggctggagtgcagtggcacaatctcggctcactgcaatctccacctctcaggttcaagcaattcttctgcctcagcctcccaagtagctgggattataggcatgtgccaccacacttgcctaatttttgtgtttttagtagagacggggtttcaccatgttggccaggctggtctcaaactcctgacctcaggtgatccacccaccttggcctcccaaagtgctggcctcccaggtgcaaactaccacacctgaccaggattgttttcttaatttccttttcagatagttcagtcttagtacagggaaatgcaactaatttttgtatgttgattttgtttcctgatatttcactgaatttatttattagttctaacagtttttgtgttgagtctttagggtttactgcatataatatcatgtcatctgcaaacagagatattcttacttctttctttcctgtttggatttctttttcttgcctaattgctcggattaggactttcagtagtatgttgaaagtaagtggtgacagtgggcatcattatcttattcttgatcttagaagaaaagcttttatttttcgttagtataatgttaactgcgggattgtcatatgtgaccttttttatttttatttatttttttgagacagagtctcactctgtcacccaggctggagtgcagtggcgtgatctagacttactgcagcctccgcctccccagttcaagtgattctcctgcctcagcctcccaagtagctgggactataggcatgtgccaccatgcctggctaattttttgtatttttagtagagacggagtttcaccatgttggccaggctggtctcaaactcccgacctcaggtgatctgcccgccttggcctcccaaagtgttgggattacaggcatgagccaccacgcccagccaacttttttatattgaggtaaattccttctatacctagtttgttgagagttttatcttggaaggtcagatgctttctctgcatctattgagatgattgtgtgatttttgtccttcattctgttaatgtatattatatcaattgatttgcatatgtcaaactatcatcagatcccagaaataaatcccacttggtcatggtgtatggtacttttaatgtgctatggaattctgttttctagataggtgagactttttacatctatgttcatcagggatattcgcctatagttttcttttcttgtagtgtctttgttttgactttggtgtcaaggtaatactggccttataaaatgagtttggaagtgctttctctccttcagttatttttttaagactttgggaaggattggtgttttaaaaaaatatttggtagaatttgccagtgaatccataatggaaatattgtatataggtaatttagtaagtcaagaattgtccctcaaaaggtactagaaaactcagttcttacttttaagactcttctaattatcctggtggaatggcttctggaatatcaccataatactgaaatttactccataatactactgaatggaagggatccagtgctggaaactttacatttgaccaggtgcagccctcaatactaggacagtttggctagggggctacccccacaggtagcagggaagaaggctgcattggtttgactgggatggaagaagaataagctaagtagtctgtcagagtttgccaggttaaagaggaaagatgatagcacaggctggagggaggtcaaagtcacattctggggaaactagatgtatgttgaccagtaggggcaagcctagtatggaatggtgggtgacagtgaacattgagggccaatgagatttagagaatgaattgaggagtgaggcttaggggaaagaaggccgggcacattagaaggctcagaggtctaagaagcatgaggaagattgtcctccagagagctgtccccttgaaggaggtgcgttggcatgatcttgtcatgaatttctcaccctgtcagaaacatcttatgtagattttttaaagggcaacagttttcctgctcactctgagtacctgaaccttgattctaagacttaggtaaggttcacttggcctggatgtttataaatgccagtaccaaggggagtccttgaaatggcatagaagatggcaaagggctctgcagagccacgaaacccaaatttagaaatgagaattactaacaatgcatatacaacatgtctacaataaactagaaaggatgatatagtttctgataacagtctttgaactttccctacctatgaaatggtattaacccttaatcagcagctcaggaaatagtccacggtagatcctcatctttgtatttcctttactgtctggttacttactgaaaagtggtagctgaggccgtatctcctaacctgcatgctctccctctctattttctttgtctcccatgttctccctacaaagttagcattcattcattcattcttattttctttctttctctctctctctctctctcactctctctccccctccccgttttcctgtggtattgaaagcttattgtcaggatgagccccttattgcttggaacccaatctgtgtccatgaattgcccatttcacagaatcacgaaagccacgctgcttcctgagcaacacagctaagtggcattccccacccctgctcttagcaaaagttcctcaggacattattgttgaattactcaatgcctattatcatagaacctcatgttcacgctgggaggtagttactactacctttttcaaatgctgaaacacaggttacctgcccgatacctctctgctatcaaatgtcaaaggtgaaattcagcccaggtcttctgactctacatccagcattctttatagagctaaatctctcttcccacagaagatagaagcccacagttctcacatacttacaaaacttaaatagagtacattatctcatgtggacaggtggttatgactttataaactaagaaaatctaggcagatgtttagtcaatgtcaagaagtgtaaacatgaccctaattaatggatttgctgaaagttattggtctctccttgtcagaactgttgttttccctgtcacttctcagattggattagaaaaaattaagcatgaagaaaattggcatttaaaatgtgtttattcttcactatcaagacagatagaactttccattcaaaagagaatgaaaagttcattttggcatggtgaatcataaataagaaaaacagaatagagaaatcctaggacgatcaatctctcataaaataaagaaatcgagattttatcgcaaagaattctgcagcacataaaggcccttaggactggactgatctccgagttcaagcgttacacccagtatgctgcataaaccctattcagtgtttgggctcattctcaagaggttgacatccttcccattttcatatcacctccctggtccacctttgctaggtcacaggtttttcaggcactttgcattctgccctccctcctctcaaaagacttcccggcatgttttcgatagcttcacacctagcagatggcagtttttcttctgaccttctgccagccctcttccttcctcagcttccttcctctccacagcttccatttaaggtattttggaagtccctcgaaatgggtccttggtgagtaaacccctttattgagtctcggactttaagaagttcttggcttcatgggacccccttcttctagttgacacttttggggattgatttcaagaatcatctgttgctgataagtcagtgtggcttctattgctgcagaagcaaggaagaaactaggcatatagtggaagaaaatgcgcttaattagaaactggtcctcattagggattcttaaaggaagtgctcaatttgcacctatgttagcagagcctcacacggattaattaaaagctgctactctcaccagcaacacccttcatggctgggttgaattgtttgtagctgtcaactctgtgccaagggcaacaaggtttgaatctgagttctttgaaatgcaggttctttcactcactatgcagaatctagggatccagactctcaagaggcaaagctctggaagaacaggtggagtgagtatccctctggcttctgctcccgccagatgatcaccatgcctctcaactctacactcttttccctgcctgtgctccagttcacactctccacatccctggggccaggctatacctagatccttctgcttgatctctcaggctccgatgtttcaactcgtcattccctaggctattaacttcaagcccttagatggcattcaagctccttggtgacctctctgcgtccgtctccatccccatctgcttccgtgagcttcataggcaagccactctccatagttatatgtccctcaaatacccagcatccccatgccatcatttcaaccagactgtcctttttcttttcccacctaaggaaattctattagttcttcatggctgggttcaaatccacctccttcactctccaggaagactacattattcttttcctaacactcctgaagtgcttgtcctctacagcattgctgcacatattttgttctgttctttattacactagtccatatggctttactccctgctgaatttaaactcttcaagggcttgatctctgtcttattcatctctgtaacctcacagtacctaatcaagttctttgaacaaagccagtgttgaaaagtgtttgttgaattgagaacagcaagccagactttctgatgggctagaaagatatacctagaaagatagagcagagtagcatttctaaagatggaaaggacaagcctggctaaaatcatgctcaaagaaaggttttcttttagggtcctcatcacatcacaatagcaaatttttaaaaaaagaaagggccgagcacgtcagtatagttaccgagcgtacttgtgtactgggcaaagtactgagcgcaatagaaagttactaaaagaaagaacagatgctttttctcctttagagctggtcccttttcaaaataaggcctcaaagtgcatcccattattaaccctgaaatagtgggacacaaacgtccagatagatatgtgcatgccaatacgtgtttaaaaatctggcgtcacacagcacactccagaggaagccaagcctaagagacatgaacacagtaacacggtagggagccgtgtgatccagactgtcctaagcagaagaggccccgggtggagaattctcacactgacagccgcagagcctgccttccccagtgtactggttttcccagggcatcaaacattttatttaataagctacatgtttgagtcacaagcgtagacttgacacccctgtatggtcaactccagctgtcgtttgttctcctcccctctcttctggcacagtggctggaacctgtatctggtgtatcacaacgctccatttcgctgatcacacacagccagaagtgacagtcgcttctctcactgccaaggacagaggagactctggctggacaggagaaattcaggtcgaaccaaggcaagtgaacgatggaattaaaaacggctgagaaatcccatagacttagaattactcatatctgcagactagagggaaatgagttggtcctgatgacaaaacaaccctttcttttctctagtctgttaaacttctattttcccgtcagactgttttaacaatgccctctactgggtattttcaaaactgcagggttctgcaggcctgacctgctcttgttctccttgagtaattctttctgcaagatgaactgaacccaaagttttcttcacataagcaagatgttactgatgtatagtttcttaagagcataaaaagtggaccagtgcatcccctggaaggagggcctcttgccctcttgagagatttctttgtaaaggtgcatgaggaattgaaatctcaccacctcctgaactggcccagagctgtcctggcatggatgacacagggaccttgacatgggctgatggattaagaacaatgttacattttctgaacgcatcacttttccaacagctcttgatctcacatgtgaggctctttctcatccctgaaggctactgacttttccctggatatatttgtattgtgattattctgcatatctaagaatttcatccctttctaaccgctcctctgccaaaacagaaaccaaaaaaagccaaaacatcactctgtgctagttagtttctttgacccctcttaaagaaactctaaacaaaaaatctgcgtccagttatatccaagggggtgttcttactgggtattcccgtcagaacctcccatctgtctattttggttcattctttgccattatcatgtaacaagttcaagataattgtgtttcatctccagttattattcatagtccctctgcatgttgaagattgctgagacagcacagaaaaatagtaaagcaacagatgaggtctgtttgcaaaaaatgtagaacaattcgaggtgcaggatgttcttcaaattgtgatggggtgaggttttgaaaagttcttcggatgggctagtgtttgttttctctctccctctccctctcttcccccctcccctttccgctttcccacttcctctctcctccttccttcctccccatccatttctcttaaatagaaacaaaattccatatattcttagaatccataggatccatatattcttagaatccataggatccagcattgcattttatttaaaagcaaatgccgaccaagtagtcagtagcaccctttcagctccaatagttggtgctatattctgtactcagcagtagactcatttcattattttggagtatggacctgaagaaaatgaatatcagacatgggctaagccaaggccagttaataaatattttaggctttgcaaaccgtatagtctctgtagcaactattcaactctgctcttatagcaccaaagtagccacaaataatagtaaacaaatgggcatggctctgttctagtaaacttacttgtggaaacgggacaggctgaatttggcccacagaccctcgtttgccaatccctgggctaagctattgcaggggtactgctgatggatatgcgggctgtgtcctgtgtgacagtgcctagccaagggggcaagtgggacctgaaatacaacccatgctctgcttctccacgccttccaccacaagaggtcctttttgtaattcagacagaggtaccatttgttcacaggctgtctccaaccagaataagcacatttcctaatggattagggtacttaacatggtttgcataagtgggaggaagagggacctgattttcctgtattaggataagggttacctttgatcccaatggctgttattgaaatgactaaagccacatggttcaaacatggctgccttagcccacatctacagactgggagtaggtggtgggagcaattccaacagagatgtagactgggaaagtgccccaggtaagaggaaccccaaagaaggtgagtttattggttagggggcttgttggatattattaccaaagccatagtccctttatgaagtttgttctgtccaaaaatgtgatttaggccactgtatgagtccattctcacattgctgtaaagaaatacctaatgctgggtaatttataaagaaacgaggtttaattgggctcatgttgctggaggctgtgcaggaagcatggtggcatctgcttggcttctggggaggccttgggaaaacttagaatggtggctgaaggtgaaaggaggagcagcacttcacatggccagggcaggagggagggagagaggggagctatcacacactgttaaagaaccagatctcgtgagaactctatcatgagaacagcaccaaaggggtggtgctaaaccgttcacgaaggatccaccactatgatccaatcacctcttaccaggccctatctccaacatgggggattacaactaaaatgagatttgggtggggacacatatccaaaccatagcagccaccactctccatcttagaatggtagaataataaaattaggaggaaacttggtatgcttttgcatgcattttaacatcagaaccctttgttcaggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaagaaccctttgttcaaataaaatcttatctagaactccagtatacgcaactgtgaaaaagggagagtgctctggtgcagctggagaggaaagacaaggagtgccctcagtaaccccctccccagatccggctggcccagagagagctgctgagactcccccaggacccagtttggagccactgatctcatcactgcataggagggagagagagaggggagatatgaaacaacggaggcaaaatgaaataaaataatcttaggtgacaacattttttaccaggttttgttggtataaaacaccctttccttttcagttcccctacctgaaagtctttggttgcttatatatatttaggatgtttttatatagggtaatatagaattgtaaggcttaatataatattaatatttgacattctattggatttaagcagccagtgggaagagagtaaataaaaataactacacaaaggaaactgctattagcgtttgttaccatgtgaatgaaatagcacatcagctgtgcatttaaagatctggatagaagtttgtttcagttatttgtttgttttgaggtacatttacatacagtgaaatacatagcttttaagtacacagtttgatctgtgttgactatacttacgtaacccacagctctaccaaaatcaacaacatttccatcatgcgggaaagttctcttattccccttcccaataaatctttcccacccagaagcaatcacagatgtgatgtctatcaccacacttggttctattctaggactttgtataaatggaatcataccatatgtactcttttgtgtctactttgtttcacttagcataatatttttgagatttatccatgttgcagcatatggccatacctttttcctttttatgcctgagtagtgttccattgtgtgaatgaatatgccagtttatccattctcctgtttatggacacttggaatgtctaaaagctgccatgaaaagccttgttcaaggctttttgtggacatatattctcatttctctaggataaatgcctaggagtagaattgctgagtgataagagtgatgcatatcttttaagaaaaaaactatcagagttttcacaattatccattttacacatccatgcaatatatgagcattctgattgttccacatccttgccaacacttaatattatcagcctttaaaatttcagctattctatttggtgtgtttctcatgtagttttaatttgcatttctctgtaataatgttgattgccttttctaagtgcttattggctattcacctatcttttgtcaaatgtctattcagatgtttgccctttaaaaaattgtgttgtctttttattgttaaattgtaggagttctttgtaagatacaggtctgggaaatattttctcccaatctgtagtttgcttattttattgagattgtcttttgataatgagttttaaattttgcagttaaatttatggatatttttctcttatggttattgcgttctgtgtttgaaggaatcttgccttcctcaaagtcacaaagatttatcttatattttcttctagaatatttatacttttaagttatacatttatgtctatgattcatcttgagttaatttttatatacaatatgtggtaagattcaaagttcttttctttttccacatggctatctagtcattccagctcaatttcttgaaaagatgtttctttttcaattgaattgctttgatatctttgttgaaattgatttggccatatatatgtagggctacttttgggctttcagttttatttcattgttctgtttctattttatttcactaaaaccacactcttgatttgtatgtttatagttaatcatgaaattagatagagtaagtccttcaactttgttcttctatttcaagaatgtttgggctattctaggtcctttgcatttctgtataaattttagaatcagcttatcgatttctacaaaacgtcttcagaaattttaattgagatctattaagtcattagataaacttgaaaagaaccaacatcttaagaatattgagttttctaatccttaaacatggtatatattattattattattattttttttttatactttaagttttagggtacatgtgcacattgtgcaggttagttacatatgtatacatgtgccatgctggtgcgctgcacccactaactcgtcatctagccttaggtatatctcccaatgctatccctcccccctccccccaccccaccacagtccccagagtgtggtattccccttcatgtgtccaggtgatctcattgttcaattcccacctatgagtgagaatatacggtgtttggttttttgttcttgcgatagtttactgagaatgatgatttccagggacatggatgaaattggaaatcatcattctcggtatatattatttatttagatcttctttaatttctctcaacagtattttgaggttttcagtatatatctcacatacctttcattaaaattattcctaagtactttctgttttgggaagctattttaaatagtattttaacatgttacattgatgaattctttatgtagaaggtttttttttgaagattatagaattttatgtatctaccaggtttgctaatttgttttagtttatttatatctttgattaattatagccttgtaaaatattacttaatattacatactggtcatttcctgttctgtcttgcagatgattttatagctgacatcggtcaagaactacattatggtgggataaaattttaatttactagagtattatagtgagggaagttttttctttcttatggagagtttttattatgaatgctttttaaaatgctttttctgcatctatttagatggccatttggtttttctccttttaatctattaatatgttgaattatattgactaattttaggatgttaaacagcctttcattccagggttaaacttcacttggccgtgatatattattattattatgtatgtgtggatacatttgagtttttaatgttttgctaatgatttttgtgtttgtgttaatgagagatattgtcattaatgttcttttttttttttttttttttttttccccccctctgagacagagtctcgctctgtcgcccaggctggagtgcaatggtgccatctcagctcactgcaagctccgcctcccgggttcaccccattctcctgcctcagcctcccgagtagctgggactacaggcacccaccatgacatccggctaatttttttgtatttttagtagagacggggtttcaccgtgttagccaggatggtctccatctcctgacctcgtggtccacccgcctcggcctcccagagtgctgggattacaggcgtgagccactgtgcctggccctaatgtttttataacttgcttgtttcagtgtctgggcaacactggccttttaaataattggaaatgttctctcctctgtttctcagagaatttgtggaggattttactattttctttctcaaacatttagtagaatttgccagggaacctctccaggttgggagagttctttgtgggaagtttgtatttatgagtgaaatttctttaattgacacagggctattcaatttttctatttcttcttgggtaattttgttcttttcagtctttgaaggaatttgttcatttcctgtaagttgttaaatttattggcataaatttgttcatacaatttccatattaccttttattgtgtctttgtaggtttttatggtagcatctttatagagatataactcacatataacacagtttaccatttgatgtatacaatccagtgtttttaaagagatttagctatacagctaattttagaacatttttatcaccctaacaagaaatcgtggtgccataccagtccttcccaccctatttacccagccttaggctaccactcctctcttttcagtctttgtagatttgcctattccagactttttatataaatgagataatataataagtggtcttttgagactggcttctgtcacttagaataatgtttttaaggtttactatgctgctgttaacattcatgtacaaatgtttgtgtgaacacacatttttatttctcttgggaatatacctaggggaagaatttctggatcataacgtaactctatatttaagcttctgaggaactgatggactgttttccaaaataactgcaccattttagactttcaccagcagtgcaggaggatttcaatttctctgcatccttgctaacacttggtgtcatctatcttttttattacagccatcctagtgggtgtgaagtagaaactcattttgctttggatttgcatttccctgatggctaatgatgttgagcatcttcccatgtgcttgatggccatgtgtatgtatctttcttggggaaatatccattcagccttgttatcctttaatgactgtagaatctatagcaatatcccttctcactttcctgatatcagtaatcttcatttctctcgtttttttcttaatgagtctaaataggagtttataaattttattagctctttaaagtgccgacttttggttttatcatttttctcttttgtttgttaattttatatttcatttctcctttttactacttcattcttttacttaccctgagtttaatttgctcctcagattatttagatcaaggatctaaatttctaccttaagaaactagctttttctagcatatgatctatcctagtcaacataccatgtgaacttgaaaagatcgatgtattgatagtagcttttactttttctctatcttttttttttctgatactattgattgcttagaagaactgctttaacatagatttccaaactctatacccataaaactggaataggttacactatacccaatttatagataaaaaaatgaaacttgaggctcagaaaggtgaaatagattgctggtctgaaacttacctagagatgaaagttaggtagactccactgcttaggttggaagaatatgcagacaggaaaccagtgggaaggggacagtacaatgtacctgcagacctgattattccagtatagcaaaagcattctgtctcagcctgtcacactttgataagatatatttgggggaatatcatgagtttttggcttatttgttaaacacctggatttttatggtctaactttagttgttgactaagcaaagtatttgttgactaatgtgactgagttgtgaaacgtctcgaaatggcatttcaattgtcagtgaagggggtggcatagacatatgattccttcatatccactcaactgagtctggcgtctccttgaatgcaggcatgcggaatgtccatgtgcctggcatcttggcggtggtcagtaaatgtttgtcaaaaggagctgaagtgtataccgtttctttgacttcttctgtgagtcaagcaccaggttcatctgagtgaaaaaatgcaatgtggatgagactgtgatgtgtcctgtacactgaaagagatcttgatcgttactaaatgggtattaaatgaggcagtgtggccatgacagaaatatgcaagaataaaagaagtgttgtagttcgcagaactttagagggggaaaatatgatttatttattacttgtggaatctcttgatttgatacactggtggaacatagcattatagtcaaagcagcagtgatagcttggcttgtgtgaaaacaaggtaggatttgtaataccatctgatattcttctccgagtttcagattcagaaagaacagtatcaacatgtaccgagcaggggaaacaatataggaaagatataaaagaaaatatgcaatccttgaccaatgtaaataaatgggaacttttgatttatttgtcatgtactcagattgatgggtttcgtagtgaagtaaatgtgtgtgcatccctggttcaggagagagtgttttgtgtatcattctagactactccagactgacatttcaaagcaacgtatcatcagtgaagtatgtatttatcgttagctcttgaaggatttttttttttagttgatagagtcatgtcttagtttctcaatgtggagaagctaaaactgtgatcctgtttctcattttctctctcaccacataggaaactatcctggtcagaagctaccccttggttgtatcagtttgctagggctgtcacaacgaagtaccacaaactgagtcacctaaacagaaatttgcaatctcagttctggaggccaaaagttcaagactgggatattggcagtgttggctcctaccaagagctgccaagaagaatctgtgccacacctcttccttagcatatgttgttggctgacaagctttggcattccttggcttgtagaagcatctctcccacctctgccctcatcttcacgtggtgttctacctgttgtatgtctccaagtccactcacactggattagggacccacactactccaggacaaccttaattaattacatttgcagaagccctacttcaaataaggtcacattttgaagcactgggggtggggacttcaatatatgaattttgggggacatgataacatgctgcttataggtggaaaataatttctacatatttattaataaggaacctctaagatgaacagatttggaaatctagtttatcttcagtttgttctaagcatctgtgtgacctggaataaattacttcattatcccaacctcagcttcttcatctgcaaggtggaagaggtgatacttgctctcctatgttatagagtcgtagtcaattataacaatagctgctgccatttattgagtggtaataagagccggcactatcacaagagtggacaccttttacaggctaggaaacagtggcacaaagaagtaaagtaatttgcccatagccaattaagtggcggagccaagattcgaacccaagaagaatggctacagtgccaactctttcaaccagggaaccaggagagcatcactatataaattctgtgtaaagtgcaagacacaatgcaaaagttcgttgtcactaaaaggagaactcagggcaaagtcttgtccttcccacttctaattctttttttcctactccagtgtttatcaaacttttcccccttttagaatacttattggaaacccatacaaaactcatatctcctctgatgtttttgaaatttcagaacctgcatcattattgaagtaaatccaagcaatcagaatttgaaaatctagctttccaaacggcctcagaggcccccaacacacacatacacatacacacacacacacacacacacacggacacataacacacagtgtgttaactcagtccttcctgccttcagtttctgtggtacagccatgatatggcttggctgtccccagccagatctcatcttgaattgtagctcccataattcccacatgtggtgggagggacccagtgggaggtaattgaatcatgggggtggatttttcccatgctgttctcgtgatagtgaataagtctcacaagatccgatggttttagaaagggctgttcccctgtacgtgctctcttccctgccgccatgtaagacatgcctttgctcctcctttgccttctgccatgattgtgagggctccccagctatgtggaacagtgagtccattaaacctctttttatgtctttattagcagcatgagaacagactaatacaagccataaaaggccaagatcatcattcctttacctacattctttttttgttatttgcccttgcttttcatcatgcaccacatcatttatgtaactaaaaataccaacttccaggccaggtgtggtggctcacgcttgtaatcccagcactttgggaggcggatgcgggtgggtcacctgaggtcaggagttcaagaccagcctggccaacatggtgaaaccccatctctactaaaaatacagaaattagccaggagtgatggcatgtgcctataatcccagctactcaggaggctgaggcaggagaattgcttgaacccaggaggtggaggttgcagtgagctgagattgtgccattgcactccagcctgggcaagagtgagactctgtctcaaagcaaaacaaaaacaaacaaacaaatgaaaaaccagcttcccttagattcccccatgagtttctgactccactacctaattcaataaaggcatttttaagaaatataaatcatatttattcatggttatatgtacatgatacaaaacatttcacagcagaaatggactcttttttaccccatcctcaatcaactaatttccttccctataaaaatctattatttgttttgtgttgtgtgtttcagccagagatactctatgcatgatgcaaacatattagcatccatatgctactttcatctaaaaagtagcatactctccacagtattctaaacctcttctttcacctattaagatatcatttctctattgtaagacttaaaatttaatgtagtgcctttgagcccaaaagtcttgagtttccctacttctaccagatattccccccaaccttcccaaagagaaaggctccctacttaaatggttcctctatcatctgggcctgctgggccgtacccattcctcaacctaacaggtttcacctcccggccagcccatgacattagtcacatcctcctgtaggaacctgaggacacctctcccccttgttactacatagccggcctcccacagcccttgtggtttgctctgctgtggactgtagcccctgtatggtgaacagtgtcctcctcccccaggctgcaagtgtatgtgactagtaaaccacgatctgtctcttttaagtggtgtggggtgttgtttgtctgaccttctcatattatttagggcagaggatccacctttaccaactgggtgaataggaggtgattagaactagtccatattaccacatagagcaatcctttgcttttcctaataagtgcacagaactctatagtatgaataggaaccaatttacttatcttgttccctgttggtagacactgggtttttactctttggttccacagcaatgctctagtgaattttctattccacattttgcatctgaagtcatcttgcatctgaaggagtaaattattacaagtaaagtatgggtcaaatgctatgcacattaaattttaataaacattggccaggcgcagtggctcacacctgtaattccagcactttgggaggccaaggcgggagtggatcacctgaggtcaggagttcgagaccagcctgaccaatatggtaaaaccccatctctattaaaaatacaaaaattagctgggcgtggtggcatgtgtctgtggtcccaggctactcgggaggttgagacaggagaactgcttgaacccaggaggtagaggttgccatgagttgagatcgtgaaactgcactccaggctgggcacagagcgagattctgtctcaaaaaaataaaataaaaaaattaataaacattgccaattgcttttcatagaatgtgtaccaatttagacccccacaggcagctggacagtctatttccccacatcctcatcaacccaggacattaccaaactttctgatcttggccaaggggagaggtgaaaaatgtcaagtccttgtggttttagtttacagttttacaagaagtgagggcaagtgtcttttcatatgcttacaagtcatttgtatttctggcctttctcttattgactcgaggaagcttttcctttattgaataaattaccactttttctatgatatgaagttgaaatatcacttatcatttgtctttgtttatagtaggttttgctgcctagatttgtattttatgttatcacatttaccttcttttgtggattctagtgttggggttacatatagatgcatcttctccagtctgtgtaggagaatctcattttattgtgcgttctttgttgtgattcacagatatcacatttttttacaaattgaaggtttatggcaactctccattgagcaagtctatcagtgccattttcccaaaagcatgtgtttactccatatctgtgtgtcatattttggtaattctcaaaatatttcaaactttgtcattatcattttttcttttatggtgatctgtgatcagtgttgtttatgttgctattataattgctttggggcaccatgaaccacacctgtataagatggagaacttaataaatgttgtatgtgtactgactgttccaccaactggccattgcacatctctctccctctcttcaggcttctttattccctgagacacagcaatattgaaattagaccaattcataaccctacaatggcttctaagtgttcaagtgaaaggaagagtcatacatctctcactttaagttaaaagctagaaatgactaagcttggtgaggaaagcatgtcaaaagctgagacaggccaaaagctagacctcttgggcaaaataattagccaagttgtgaatgcaaaggaaaagttattgaagaaaattgaaagtgctactccagtgaaaacaggaatgataagaaagcaaaacagccttatcgctgatatggagaaaattttaaaaggtcaatgcctggcttcaaaagacaggctgactctcttgttaggggatagtgcagctggtgaagccaatgctcatttaccattccaaaaatcatacagcctctaagaatgacgctaaatctactctgcctgtgccctaaaaatggaacaacgaagcccagatctgtttacagaaggatttattgaatattttaagaccactgttgagacctactgctcaaaaacaaagattcctctcaaaatattgatgctcactgacaatgcacctcatcacacaagagccttatgaagatgtacaagaatgtgtaatacaaggcatgttgttttcatgcctgctaacacaatatccattctatagccctggagcaaagagtaattttgatttccaagtcttattatttaagaaatatactttgtgaggctatagctcccatagataaggattcctcttggatctgagcaaagtaaattgaaacactcctggaaaggattaacagttccagatgccattaagaacagttttgatttctgggaggaggccaaaatttcaacattaactgtagtttagaagcaattgattccaaccttcatggatgactttggaggggttcaagacttcagtggaggaagtcactgcaaatgaggtggaaatagcaaaagaactagaattagaagcagagcctgaagatgtgactgaactgctgtgatctcatgataaaatttaaacaaatgaaaagttgttccttatggatgagtaaagaaagtggtttcttgagatggaatatgctcctggtgaaaatgctatgaacattgttgaaatgacaacaaagtatttagaatattacataaagttagttgataaggcagcagcagggtttgagagattgattccaattttgaaagaatttttgtgtgcatgtggaggtaaaatgctaccaaacagcattgcatgctacagagacttatttcatgaaaggaagaatcagttaatgtagcaaacatcattgtggtcttattttaagaaattgtcacagccaccccaaccttcagcaaccattatcctcatcagtcagcagccatcaacatcaaggcaaaacctcccaccagcaaaaagattacaacttgctgaaggctcagatgatccttagcatttttagccataaagtattttaaaataaggtatatacattgttttttagacataatgctattgcacactcaatcaactacagtataaacataattttatatgtgctgggaaaccaaaaaattcatgtgacttgctttattttgatatttgctttattgtggtggtctgaaactgaatgcacagtatttctgaggtatgcctatagttgcattaaaaaaaattctcctgatgttattgtcaagattttaatggcttcacttttacatttaaatatttgattcatctggaatctatgctgatataaggtatgagataaagatctataatttgtttttacagttgattatttgacaataattcttttttccattaacatacaatgtcatatttatcaaatactgagagactgtttctgatctgtgttctgttccatggatctgtctcttcatgcacaaaaatgagaatgttttaattattatatatttaaaatgttttaatattgattattatgtatatttgtcttttccttattcttgtttattttgttttccaaatgaactttaaaatcatcttgcctatgactccatgaaaaaattatattgctgtttttggattcttgaaaattcatatactaaagtaagaagaattgaatctttaaaatgacaaattttccaatcaaagactgtgacatgcatgttatttctttaaaggtcttcatgccctgatagtgttttagagtttagtttatatagctcttccacatgtctcattacatttattcctaggtatttaaatagtagtctttccttcctttgagactttctgactagtggtaatttacaaatattaaggctgctgatttctagatatgagcttcccccagccatctaattaaatgttttattattctaattttccaggtgtacagtgatatcatctttaaatatgatgattttacttcccttgcttcaatttttgtagtccttacgtctttctcttgtttattttgggttggccttcagaacgatgctgagtaaaggataaaggatgtcttcatcttattcttgattttaacaaaaatgcttctgtagttcccctaccgcaaatattgagtatccatgatgttctaggcaccaggatgtagcaaatacaactgtccttcaggactcaactcaaatccaccttcttccaaagccccctgtgatcatctcaaacagaaattgtctttgcctcctccaaacttcatattttccttccctttactgtcctactttttatcttgctttagaattatcagtatacttgtcttaaatagtccactaaaaatcggtatgctcagagaaggcaggatctttgacaaatcatctagtcatcctcagaactctgccttgcccacagcaaatgctcaacacagtcctgcttaattaattataaattagttagtatgaaaatttgttcaaatatatttgagcaaatactaagtaagcatctgctcagataaaaatgcaggattctcatacagagcacttggccatgagtaataaatgtaagtccggctctcaaaatatacatgtattcctatttggcactagccaaaagggggtgcaatatttacctttaaattattatagagagaatgagctagaaaggaaaaagccagttggagccagaaagcttggagtctttgaacctccctcagttctctaaatctagatgaaatgatatgaatcatcaagtcatttcatgccttttacacttcactttaggatctttttctctaaaaagcctctctcaacagggataatagggtgagtggccttagtatcagtgtttggtttctttgcgatgtgtaattggttttagctagtgtggaatgtcctcttgattttaaattcctatttttagctcctctgtatattgtgttatgtgttcactgttgctccccacacccctccttgcaagtctatacagaagcatttcatgtggaaccggagctgttctagggaagcctgtcatcaaggctgccctttgctctgcacctccccagcaccctcagaggtcagagcgaggctggtgtacagggcagtggatgtgagagcttgaatttcttgccaccttgttacaagccaaagtaggaagaaagtgtatccagaccaggaaacatgatttgtaatcgtggttgcaaatctagcaccctaaacctagcacaccatttggcacatactcggctcttaaatgtccatttaatgcatgaatgactaagcagataagtgagtgagtggatacatatgtgtcttattgggagacggctcatgaactgacattcaccatgggcttttctaagtttttcagtgggatcaatgttggtagtttgtatatttgcacttggtttagaaaactttcctttacctaatcctcaggcgatactgtgaactttgggttgcttacttgataaatatagttttattattaattcatgcatttgaaataacacatgcattgaaagcagcagcaaatccttttaagctctgtgctcttttaaataggttctttctctcatgctcaggaaaaaattcagtggagatgatggcaacagactggtccctcaaatctctggccatagcccaaggaggagagaacccacaattgcaggccatatgtattgccctgtatgatcagtattaaactcaaagtatgtctttgtaactagagacatattctgggtagtgtggctgttagtttgtcccaatctttattttaaggcactatccacatctctttctcttttcctttgcccctaacattgatatcaactgagttttcagggtgccagctgcccatgtcagctctttgagagagcagcctctctcctccttctgcctctcaatcctttcctctccgccagctcttctcggcatgttggtcattcattattgatgaccctccagcaccttctccaccccggtgttcccatagccctgtgcactgctgagcagagccaggtgcaggatctagtcggggtccaggactgctgctccaaggccgccaagactctttcccttcctggctgtcagagaggatgcctggcactagagatacagcagcagcggcgtcagccgctggtcttgaggagggtttgtttctctcctctgtcttctaggaagcaaaaggttaaactgttcattttaagagcctccctgggtataaaatactgagctttgtctttctggagtgagccgattcctaggccccttgacctttgctccaacatgtctgctgcccatcccttagagtgtttttctttgctttctatttagtcagaaggaatgaggctagtgtctgccgttagcttaattattggggaaaagcgttggaagaaaagaaactgattctctccatttttctaattgttacttaaccaagtcttgacaagatacaatttggtggctaatatgcatggagtgccctttctgaaagcagaggctctgcttgtggattctgcagtgaaggctggagtcacaccttggaaatgactgtccaccttcacatttgcacacatcacttacacacatggagctccttccaccaccagcctcccctgagccttcataagacacaggctgctgctttaaggaacattaacaatccagacccttccagggacccatgtgactccagcttctcccacaatagtcagaaatcgtaattgagagttcagaattcataggtaccaggataatattgcagaaagataatcaggcacctacttcccagttccctgaaattaaaacaggtattcatcttgtcagaataagaaaacagggtcctgctgtgttccagccacctggcaaccttgttcttagaatacagaaagggagggaagcaatgtgtgcgatcactctagccgaagaatgtagagagaagcgaagaccatttttttagtcctaatttcctacaagggacaatgcacctaaagtttttcaagccttgctcagaatcatctcacaaaaggaaaggccctttgcttcacaaaatattttaatgaaagcaaaacagtgactaagagcctcatgtactgctggttctgcctgtttcaaatcttgaaaggcctttaataacctccattatgtgactatgtgatttttatcacacaatctcagattcttacattttttaaataactcaccagcaagaaccaatgtcagaactaaatgctaataagatttggcctgggagagtaacatagtaagattgttaatgtttaatgcactctcatcaaagtgggataatcctacggctgaaggttaagtgagccttttgtaaaaaaaaaaaataatagggaagaaaacattattgtagcttttccattttactcagtcaaatgaattcaacataaacttgttatagccaagcccaggctagacatttcctggtgatctggtaatttcccttgtattgttcatgtggtttgtctctttcctcttcctctttgtttctaatgatgatgatgaacagcatctctgcaataggccacattctcaaagtgctccattcattgtcacttgaaaagaccactgttgggttttattgccatcattgatatacaaggataatttacatacaaaattgtggtttggttttagagccatggcaaccagagtatcacttctgatgggaaaaggaagaatggccttcagtgatggagtaggcaattgcaaagagttctgctcccagttctcttgctaaatcaaaagattgcaagggtcaagatcgatttcttcattttctttaggcagcaatctgaagaggccccagcagaaaactccagccttaggatttctggtaatcagaaaaagaagcaactgttcttgggtaacatgtggtgcccataaaagggcatcagctcttgggggcagcctgaggttaccaggttcacctttgctcattctgcgcaaggatcgctcccctcagagtttctgcaggggaatgtgtactctggtgttcggtattaaagcttctacatgaatttatagagttgcttacattggctgagaaattgttttttttttttttttttggtactcagccctaattttccctggcaaatattgctctgtaactttgagatgaatgtacccatcaaaaactccagaagaaattctcatgcagttctattattgctcatcattttgccaaggaacgttagtaaagagagctatgaagtggctaaagaagttgtgttttttgtttgtgtgtttgtttttccttttcatcgttttatgtcttagtaggagaagaatccaagatgaaaaggacaggctctggttttagctttgccactaatttcgtgtgtttccttatgcaagtgtccagatcttcttgggaattaatttctttatttgtcaaagggagctaataatacctgccctggccaacctgtaacatagttatgcgtaggagtaaaatcacagatgtgaaagtttgcaaaattctaagatccttaggtagctcatgcgtcgacaggagtaatgaattatacacctaccgcaaaaggtgattgtggggatccagtgtcaaagggcttagaagagagtgtgacacataagtagcatttggggatggtagctggaagaccaagcagcaagggtgttaccatcaaatcccttccataacccctctcccatacaaagcaaaggggtctaaatagccccagtgctcacttcaatgctactcatattctttggctttggagactttgcttttttggagcccctcattcctactttccagacatttgcagaattcagctgtgctttctaagagattctctggcattaacacagaatgaccttgcagtgggaatgaccttggagctgcagcgacttgagtttaaattctagctctgccccttactagctgggtgggattgattccaggtaactgtcagtaccttgtgtctcaacatcttcagttggggatagcgtcctaccatctccctcatagaggagttaacgagttgaaatgacacagatgctacagtcaggagatgctacgtaattttctgggcccagtgcaaaatgaaaattcagggccccttgttcaagcatattaagcacttcaagatggcaacagcagagcatgaaaccaaggtctaggtcttctgagctcagggtcttgtgcaactgcataggtcacatgcccttgaagcccaccctggccactgatcccatagtggcagcttgccacttagtgggcactcagtagagaccgcttgcttttctttcttcctctttctctcttcttctcttgatagccttaaatccctgggagggggggcttgcatttactcttacacttcctgccacagtttctccccttatgatcgttccttctgctggttaaattgccgcttctcttttgcccctgaaatcagggagccaagtgattaagagaagctagcttatctacacgagcctcccatctctatgtctgtatttcccaagttctttcaaagataacccaataaaataaagaactaacagcatcatgatacatacaaaggggctatggtgtatgtgtggcaggctggggagtaaggatggagaaggtattttgaggcaaagaagaaagaacaaaggaaaatgaaggtattagaagataaaagcttgcacttcacagaagatattattttgctgccatgtatctaagcacaattgaggcagattagttgtaaaatcacctcatttacttttcccagcttttttcagccactttcactaaatcaaccaaccaaaccttttctgtgcccttatgtcccttgtctctgaacttcatcaactaaatatttgttatgcattattttattcagcattcacagtatctgtgggtttgggtatgctacttctttcttcattttatagagaaggagatgatagagtaaccgtccatagttactgtgttcattggaaatgttttgtctccaagtagcagaaagcccaacttacagtgtctgtgttcggggttggaagttggggagaggttcctcctaatgagatgcttggaggcagaccaccgcctcaggggttagacagctcactgacatcctggctcctgtctgctgctctcttggcttttccctcataatcacaagatggctgctgtgggtccaggcatcacaacatggtcaggagaagaagaaatgagggaagaaacagtatccagcctattgttgtcttttcttgggaaagttacactttctcaggcatccactggcttacagacttctacttatgtctcattggccagaactgtgggagtttctagctatagaaatggcggagaaggtgagtgtttagcttttcccgcctttttcctggttgggggagacagctctagagtgaagcacacaacagtatatactttatagtgacaaagatagcaaggggcaaagacagaacctgaacccaggtcctctaatcttgagtttagagattttgccattctgccacattgctcttcttttaaaaatactttcagcaacatccagcttgtccacttcctgctgagacaagccaacaggtataactccaagttatggaaatttaaaacaggaaatatgtttatactatgccttcccttaaggttcctgagagagaactttctacaagttatgtaaaacagagataatgtggcttatagaaaatttattcctcacatgataaattctgtgcatgtgaagtttcgtagaactcactgtagcgcatttagaaacacacgaccagaaattgtgtgaaacattgctttgggatggatggtgcccgtctgaccttaagctatccttcccccactctgctgctcttcaaaccacagccagtttattttttggtagaaactatttacgtatgaagatcgtatttggatgcctttagtaatttattaaactcactttcctaaagcaagatcagagtttaaaacatatgtaaatatcagctgagagattagaaacaaaagccaagaaggaatttctccactgcaattaccacatgcagttaccatggcagggaagctgtgcgggataattcagtccaaggtagagaaataacagagtctggaaatgtaaatatgtttctgttagagatacttgaaataacgtttacactggcttcttcctttttagctatgggatattgtgcaaaacttttttgttgtgttttctttaaatgctccgggcagtaaattggaagtatatagcacctgctacatgtttagtcagtagtcgaaacattgaataaatcatgaaatctgtaggtgaactgaataatagctgccctggagagaactgtaattcactgttgacaaaataaatccccctgcatttttctggggaatcttttatttttagcaagagtgtttgatactcctaagttaattagtagttttaacagagtggaatgttattgaacctaccagtgttgtttaagagctaatgtttatgtgccaggcgccagattaggtaattttataagcatagatcattacattctcgcccagccctgtagggttcctagctctgcttttccagatgaagagccaagacccttagaggttgtaactagtccagagccacatgggctaggaagaaaggaagacctttcaccacttatttacacaagtaagttcttcccaggcagtgtggcagactcagcagattggcccacttaactcttgttccacccccactctatcttgtctacttctaccacagaggccagaaaccacaaatccccagcctcctgtggcttggcttggggtagcccaaatacacagttctgtccaaccatgcataggcagaattccctggggaacatttctctctccccaagtaggtaaagcttctttgccctttaccgtttgttgttccttttcttccttcatggaaagaagagtcactttcaagacatgcagcaaccaccctctaacaatcagaaggaaatacatggttaagattgttgaaacaagaagtaaaagaagtcaagttgcttgacgatattctcttttgtctttttattttttttattttttaaattatactttaagttctagggtacatgtgcacaatgtgcaggtttgttacatatgtatacatgtgccatgttggtttgctgcacccattaattcatcatttacattaggtatttctcctaatgctatccctcccccatgcacccaccccacaacaggccccagtgtgtgatgttccccaccctgtgtccaagtgttctcatcattcgtgtcccacctatgagtgagaacatgcggtgtttggttttctgtccttgtgatagtttgctgagaatgatggtttccagcttcatccatgtccctacaaacggcatgaactcatccttttttatggctgcatagtattccatggtgtatatgtgccacattttcttaatccagtctatcattgatggacatttgggttggttccatgagcttgatgatattctcaaatagattccctagccctaggctgcctgccattgcattccttattacacaagaataatcatctcttattgtattccaatcattgattggcattattttttttctgcatagcaaaatacatggccaaatcagtaaacctgaacttctcaaagtggccatctggtagctactagcttataaactgttccctaggtatagagaattgaaagcaggtgaagtgtgtgtgtgtgtgtgtgtgtgtgtgtgtgtgtgtgtgtatttcacatatcactcaggtcaatgttcctttgaaaatggagaatgcaactctattaagataatagtgtaaatttggtaactgatcacttacagcaattacaacaaaagatgcaaaagtcaggcagaactgggttctaatgctggctgtagcactggttggttatgtgaccttgagctcattagttagccttgcacacatttcctcatatatgattgaggataagagtagttttatctcatagagatttgaggggcatttggcacaggatcaggcacaaagtaagcactcagtggtattgctgccaataataataacaataataataataatagaattatttaagacttgcagattgagggaatttgatgaaatatataacaactgaggttaaagtgttctaattttctgtctagattcatcttttatggtccctttttaatctcacaccagtgtccttccagaattaaaaggtcaatgattttacttcctagagaagcttccttaggggcttatgaatggtgaaaatgtgcacgtttgcctcgactctctatttccattgtcgaaggccttcgcaaatttacctagtgattctagccaagtgcttcctgacattcttaggggctcgaaggtcaatacttgatttggattttttgttgttgtttctttttccctccagcctcctgtgttgtgttgatttgtaaaatggccattgtaaatgttaaaatggaaagaaaaccgagtctgttataagctttgatgtagtaaaaacagcatggagcatcttaaattttaagatgtcatcagaaaagaagctcttcccagtttcctcttgaaaatcattgtattagtcagggttctctagagggacagaactaataggacagatatatatagaaaggggaggttattaagtagtattaacttacacgattacaaggtcccacaataggctgtctgcaagctgaggggcaaggaagccagtccaagtcccaaacgattttatttgacaaaagacaaaaacagaagttatttacaatagtttttgctcaaataattcagtgggggcaactgtacttttcctccaggtttatcttataaccaaacccaagcagaggctgccccaccccaacaccccattttacacagctgggaatgccaaccagaattcagcagcgtggctccctcacccctcaccaccctctattgctcagtgtacagtggggagggaaagatcccacctcagcccaagaacttggagctgaagaacttggaatctgatattcaagggcaggaagcatccagcacagtagaaagatgtaaggtgggaggctcagccagtctagccttttcacatttttctccctggtttacatgctggccatgctggcagctgatttgatggtgcccacccagattaaggatgggtctgcctttcccagctcactgacttgaacgttaatctcctttggccacaccctcacagacacacccaagatcaataatttgcaccctccaatccaatcaagttgacactcagtattagccctcacaatcataaaacagaaaaatgagtgaaaagcataaattttgctttcaaaaagctgggagattctatatccatgaaccacaatatatgacgtaaggctggccaaatgcagtggaacgaaagctcaggaagggctaagagacaatcactatgatcaggttatagattttgacaaagcaagcaaaaaacacgtctccaaaactggtacttcagagcaggcataccctaaaggatgacgccaataagcctttgtttggaaaatggcaagggtattgcaagactggaagtagaaaacctccctggaccctacctgctaccatgtagtagcaaatgaaactgaaagggaaatgcacagtcatcctgtgtgtataggaagcagtccattgttgtggcactacggcagcctgttggccgagaagaagcagtggctaaaataactcatcagcacacaaccctttgtaataagacttaacagtaaatcaggtaaatttttaccaactcacaacatcctgactcctatcccacaaaactgtcctctaaatatctgaatcaagaagtttccacattcagaggaaagtaacaataaaaaggaaccagcacaggatattgtaatatgccatacatgacactacaaagatattataatataaaaggagaaaaaactggaaaatagatggtaaatgcagaacactcactataggtgattccaacagacaaatcaaaagataacattaccatgatcttgacgacttaaagaaaccaccaaagagctcaaaacagaaataaagaggtcaggggtaatatggtgacgtgagaagagaagaaacatacactgatgtagctctccagagaactgaagggggaaatttttttttttttttttgagacggagtctcgccctgttgcccaggctggagtgcagtgacgtgatctcggctcactgcaacctccacctcccgggttcacgccattctcctgcctcagcctcccaagtagctgggactacaggggcacccaccaccatgcccggctaatttttttgtattttttagtagagatggggttttactatggtctcgatctcctgacctcatgatctgcctgcctcagcctcccaaagttctgggattacaggcgtgagccaccgcacccggcctgaagggggaaaatcatcacagatatgaagatgattttgaagcagccaaagtaaaatagacactagacactgccgaacatagaatagaggatatgatgggcaggattatcaaagcaaacaaaacggaaacaacagcttaaaagtattagaaagaaaatagtatatttgggtgacgaggaagatcccagagatacatcacaatatatccctgaagaagagaattaaacaaatgaaacataaacaaagatataattctacgtaactttcaataaataaaagatttgaatttatagattgaaggagtctactatgttacagaaaatttgctaaagaacaatcaatactactctgtattatagatgtattgatagatcttggagataagaatgatttggtcacaccagcaggaatatcaagtaacctatacaagaccacagtttaaaaaaaacctcaggctaacctaagccttccttacagcaacattccaagattgcagagagtaatgcccatgaagccctcagtgaaaaagtatgtggccttagagttttatgcacagccaaactgtcattcaaatgtaaaaacaataaataaaacgtgtccaacatttaagaacccagagaagatgattcccatgagttattctttaaaaaactattggctgggcgtggtggctaacacctgtaatcccaacactttgggagactgaggcaggtggatcacgaggtcgggagatcgagaccatcctggctaacatggtgaaaccacatctctaccaaaaaaattaaaaattagctgggcgtggtggcgggcacctgtagtcccagctacttgggaggctgaggcaggagaatggcgtgaacccgagaggcagagcttgcagtgagcagagatcacaccactacactccagcctgggcaatagagcaagactctgtctcaaaaaaataaataaaattaaaaaataaaaaataaaaaactattaaagactttatctaagagatgaatgaagaaaccatggcaaaaggattttcagtgaacactgagtctgttttgcttttagactgggtctaaataagtgcagaaacttttgttatagaaaaaaaaaactaagctctgaatgttcataaatattttaactaatataaggataaggtggaaggtggtatgtagattcattcatcatctcatttaaacatgataaatcaagtatatttaaatatacttagcatacttactaaagtatattagtaaattaatatatttactgaagtatattagtaaattaatatatttactaaatatactaagtatatttaaatatacaaaaataagtgtaggaatgaacatatatgttagtttgaaatatatatgtaatatataaggtacatgtttaatatgtaaacatataatatatattaaaccaatgtttagtgcctattaaccaaattcaagtgatagaaggaagagaaaataaagaacaatttgtattgcttttagtggaaagtaaaatgtcagtgtttcaagaaacagagaagttaaatagctaaataagggttagttacaaaggtgatcactggaaaaattaaccataatacaaacctgcccaaatagcacaaggaatactcacaaaaagaaaatatagaccaaagagtagaagatttttttaaaaaagcaatagaaacagaaatcaaaatactataaagtaagaccaaacctgtttctcatatcaacaaataaaagtgggctaaactcccatattaaaaaaaaagattctgaaatcgagtaataaagtaaaacttaaccatatgctataccccatatatacctaaagcaaagtgtctcgcaaacttgaaaatagaaggatgagcaaaggaatattatcaaatgccaacaaaaaggaaagtagaggccaataatcttagaataaaacaaggttgaatttagaacaaaaagcattaaacaagaaacataaagacaattgtgtgataagatgtatcattcacaaggaagatctaatagtcattaagtgtttctgtatcaacgtagcctgaaaagttaagcaaaaactaccaaaaagataaggaaaaatagaaagactttaattataggaggcttaacagacaaaatagacccaaaagatgacatagatggcctaaataacataagtaagtagtaaagttacatatatcaatctatccctgaaaactaaaaatatgtcatcctttcagatgtccataaaacgtttcccagaactgactatactttagaccacacagaaaacctaaataaactccccaaatcagaaatcacactgatattgtcctctaatcactatgagtcaaaaaggaatccatgtgaatgtatagaatatttaaaattaatgataatgattataaccacattacatatcctatgggctcaactaaagcatttgctcaaaagaaaatttgtatacgtaagtacttaaattaatgaacaaaaaataaaggaaatcagtgcatatgtcttctactcacgaaattaaatataagaaaaataaagttaacctcaggaaaatataaggtagctatgataataaaagcagaaaataggaaaaaagaataaatctttaagttagctctttatgaaaaatcaataaatcattagtaaacaaaccaaaatggttgccaataagttattttctaggaaaatataaaattaccaggcatgaccccagatggagagaaaacaacaatctaaggaaatgaattagtatagaagaaatacagaatgtggagaaaaagcaaacctcttgaaagaaaacaccagtcctggaatatttcacagattacttctaccaaacctataaggaaaaaataggtccaatattatttaaaccaagtgaaagcatccaggttatttttctgaagctagcatgcatcatgcatattctgataaatagagcacacaaaaaagcaaactaaggaccaatattgcttatgaatatcagtgtaaataatcctaattaaaatattagaaaacaaatctaagagctcacaaagacaagaatttgctatgttcaaatgggatttagtcttaaaaaagtaagactatttcaaaattcacaactgtattaatttaattcataaaatattgtcaaaattaagaatcactttatcatctccataaatacttgaacaggtgtttgataaaattctctaatcttgatgaaaaactcataataaaatgctattttattatacagacagagacatacacacatacatataccaatacatacttagtaacatggtcccaaagctactgatacaactgctgaagaaagtgtcattaatgtcggctacaaggaaagataccttaatcaatagcattaattaacattattgctccagagagcctagctagcctaagtaaacaaaagaaaaaaataagcagagtaattttaaccaggagttaaaattatcatatatgcagatgatatgattatgtactgtaaaacacaaagaatcacatggaaaaaatagtataaacaataaggaaatacacttaggtgattgagtacaaaaatactactcatgttaatctttccacaaacagaaactggttagaaaatataactgaagagatcccatttacaataagaataaatttaacaagaaatgtgcccaaattacacaaataaaatttttaaatgctactgagaaacatgaaaaatgacttaaacaaatggaaaggcatactctgtttaacataaagatgtcttatctaaattaagttatacaggtaatgcaatgcaataaaaaaaaaaacaatagaatctacaggggtagattctaaagttcaagaacaaataaggaagcccaacccaaaagtttctgacaaaggaaaattaagaaagggggattagccctatcaaatattaaaatgtattgtagtccgggtacctgaggtcaggagttcgtgacctgcctggccaatatggtaaaaccctgtctctactaaatatacaaatattagctgggtgtggtagtgggcacctgtaatcccagctacttgggaggcttaggcaggagaattgcttgaacctgggaggcggaggttgcagtgagcccagcggcgccactgcactccagcctgggtgacagagtgagactccatctcaaaaaaaaaaaaaaaaaaaaaaaaaaaaaaaaaaaaaaaaactattgtaaaactacagaagttaaaatatatatgtctccatatctttttttatttttaatttttatggccacatagtaggtgtatatatttatggggtacttgagatattttgatacagacatacaatatgtaatcatcacattagggtaaatagagtatccatcacttcaagcactcattacctctttgtgttacaaacattccaactgtactctctcgttattctaaaatgtattacaaattgtcactgactgcagtcaccctgttgtgctatcaaatactagatattattcatttatatctctatatcctaacaaccaggaagctctatgtaagtgtctagaaatagaccaaactacatatgacaaattttttatttacatatcaataaaaaaatcagtctattcaaaaatgttattgaaacaactgaatacctctttagaaaaaaattaacaagcacaaacaccataaacaaaatcagaaaatgatatactgagaaaaatcatttacaaaggactattcttttttttttaatttaagttctagggtacatgtgcacaacgtgcatgtttgttacatatgtatacatgtgccatgttggtgtgctgcacacattaactcgccatttacattaggtatatctcctaatgctatccctcccccatccccctaccccacaacaggcccagtgtgtgatgttccccaccctgtgtccaagtgtactcattgttcaattcccacctatgagtgagaacatgcggtgtttggttttctgtccttgcgatagtttgctgagaatgatggtttccagcttcatccatgtccctacaaaggacatgaactcatccttttttatggctgcatagtattccatggtgtatatgtgccacattttcttaatccagtctatcatggatggacatttgggttggttccaagtctttgctattgtgaatagtgccgcaataaacatacgtgtgcatgtgtctttatagcagcatgatttataatcctttgggtatatatccagtaatgggatggctgggtcaaatggtatttctagttctagatccttgaggaattaccacactgtcttccacaatggctgaactagtttacagccccacaaacagtgtaaaagtgttcctatttctccacatgctctccagcacctgttgttccctgactttttaatggtcgccattttaactggtgtgagatggtatctcattgtggttttgatttgcatttctctgatggccagtgatgatgagcattttttcatgtgtgttggctgcataaatgtcttctttcgagaagtatctgttcatatccttcacccactttttgatgggttgtttgattttttcttgtaaatttgtttaagttctttgtagattctggatattagccctttgtcagatgggtacattgcaaacgttttctcccattctgtatgttgcctgttcactctgatggtagtttcttttactgtgcagaagctctttagtttaattagatcccatttctcaattttggcttttgttgccgttgcttttggtgttttagtcatgaagtccttgcccatgcctatgtcctgaatggtattgcctaggttttcttctagggtttttttggttttaggtcttacatttaagtctttaatccgtcttgaattaatttttgtataaggtgtgaggaagggatccagtttcagctttctacatatggctagccagttttcccagcaccatctattaaatagagaatcctttccccatttcttatttttgtcagttttgacaaaggactattcttcttaacatgttaaaaatctcttgaataaaattaaaaaacaacccagtggaaatagatagggcaaataatataaataggtacttcccaaaaagaaagaaacatgatgtaaaccattgaaaaaatgcacagtctcactcacaataaatgtatattaagactactgagagatgctgatttaaaaaaaaaagcctgccagatttcacattgacaaggatcaaaaagtttaatcacacattgttggcaacactgtagggaaataaggtaccctcatacatctttggtggacccatgaattggtacaatgttgattaggagcaaattgccagtatttatcatgcaacttgcatgtatctcctgactcagaaatttcacttctaggaattcctcctacattacacttgtgcaattgtgtgtacttgcacttgtgtgaatgatgtatgtacatgaatatgctttgtcatattgtttgtgagaaccaaagattacaaaccaccaaatgctggccaatatacattcattaccacaaaggtctggtcaatttagagaaagaaatcctatgtccacgaaggatataatctctaagaaaacaaagtgctgacagcatcatagagtatgttaccattattgtaaaatggcaatagtaataattattatataaatatatgcttgtgtatgaataaaatgccctgaaagtatactgatagagtttggatatttgtccctgcgcaaatcacatgatgaaatgtaattcccagtgttggaggtgtttgggtcatgggggcagaccccttatgtcttggtgctgtccttgcaatagtgagtgagtgctcacaagatctggttgtttaagtgtgtggtaccacacactcctccttgcttctgctcctaccacatgaaatacctgctacccgtttgccttctgcggtgactgtaagcttcctgaggcctccccagaagcagatgccagcactgtgcttcctgtacagcctgaagaaccatgaaccagttaaacctcttttcttataaatcacccagtctcaggtatttttttctttcttttgagatggagtctcgctctgtcccccagactggagtgcagtgacgtgatcttggttcggctcactgcaagctccacctcccgggctcacgccattgtcctgcctcagcctgccgagtcgctgggactacaggcgcccgccaccatgcccggctaattttttgtatttttaatagagatggggtttcactgtgttagccaggatggtctcaatctcctgacctcgtgatctgcccacctcggcctcccaaagtgctgggattacaggtgtgagccgttgcgcccggccaggtatttctttatagcaatgaaagagtggcctaacacgtatacattagaacctgattacagtagatgcctcttgggaggggacttaaatggccagggttggtgataaaaagtattttttaatgtatccccttttttatctgttaatttttttatgtgtatatgtattacctattcaaaaagttaatcaattttaaattaacttagatcccaattcaaactccacatctgctacctccagctttgtgacctagagcaaactgcaggccagctgccttctctgtggagcagggactgtcagaactcccccatcccagggtgtgatcagagctacatgagataatcatgggaaagtacctggaaattacatgtaattgcttagtaaatgccctccgcttctttccccccagaattaaagtaagctgcatctaactattacaacttaataaggtgcattattgtgctttgctgtgtttttaattttcttgtcatacctgaatggtttaaacatctggcttccttaaggcataattaagtaaaagagagagcagcgtacatcaccagtcaggtgtacttctttccctgttgtaaaagtgatgctttttattcagagccaagtctagatattcaccagtccttggcacgactagaaaaagatttgaaggactaaagctgctagagcataattatgtattggctgtggacttgagatgcctgggttctgtccctcctgactgtgacttagcagccgtttgtcactggagatgttttatgacttctgcaggcttccacagtatcacttgtgaaatgggaataactatttaatagctcacagaggtgctgtattaggttctccagagaaacagaataggatttacgttatatataacaataggatatagcctagatatatagatatatatatataaggatttattgtgggaatttgttcacgtgtttgtagaggctgagaagtgccacatatgccatctccaagctagagaagcaggaaagccagtggtaaaattcagcatgagtccacaggcccaagaaccagcagctctgatgtcccagggcaggagaaaagctggatgtcccaggtcaagggaaggagggaatttacccctcctccttctttttgttctatctgaaccctcaatggattggaagatgcttgcccacaccagtgagggtaatctttactcaatctactgattcaaatgctgttctctttcagaaacacactcacagtcatacccagaaataatgttttaccagctatctgggcaccccataacccagtcaagttgacacataaaattaaccatcacagacactgactagaatgcataaagtccatctagaaaagcacccagtacataataagcactcaacaaatatttttggaaaagtatcaaacactctgtgcaaggagcaagaaatggttcctactttcacggtctacacaaattaatagggagatgaaacaatggcccaaatcactagatcaccaagccatttaggagaagaaactgaagtgaagggggtaggcatgactcataaagagtaatttcctttccctctctaaggccccaccagtgaactggtggccacgttgactaactggagacaggataccaaggaggacagacatcattgtgaggtcccattctacgtaccccaaaccaacagagtcctctggaaggcctgagagctgttaggaacaagacgaaatgggtgtgagattgaagaagtcacaaaatgcagacattttaagctattctcccaaaatacattaaaaatcttactgagaaaaatgtgaaatatatacaatactcacttgcatatactatttcttattttattttatttatttattttttgagacagagtttcactgttgttgcccaggctagagtgcaatggcacgatcttggctcactgcaacctctgccaccctagttcaagcgattctcctgcttcatcctcccaaattgctgggattacaggtgcccaccaccacacctggctaattttttatattttttagtagagatggcgtttcaccatgttggtcaggctggtctcaaactcttgacctcaggtgatccacccacctcagcctcccaaagtgctgggattacaggcgtgagccactgtgcccaaccaacactatttgttattttagatgttgggaagttttcatgaaaattctcttgtccattctcatttacatgcacacacatacatatgcacatgcatgaacacatgcttcacggcgcttcttattaatccttattgggtaaaatcttattgagggacaataaaccagataaaatctccaaccactccctggtgccaagtctcttgggcccctcacactccaggtgggcaaggcagcatgccagtggacacagcatcacctgctcagagggagtggttgtggaaagcacagaggcaggcggcctggtggccaaggtccacaccacatcctcccaggtgggcactgtcctgagtaggcttaaactggcattgtctgtccagtaagtccttttctaaggaaagcaggtatcaactaattagcaacatgcaagtgttttcattttaggaaaagagaagaactctggaattatggggcctggtaaaggttcatttaagcgtcaagatcaagttggctaaacccatagtgtggaagcactctttgcgtagggtgagccaggtggagcagctgtgtgacagatcttggaggcagtctaagggcaatgagcacctggagaacaaagagggaggggctgcccacctgaggaggaagggacatgtgcaactgtctcctagatggggccctgagaactgccgggagacatcacagggcagcccctctccccacctctggctacacagtctcctgcccttctctactcagtgaattctgaggtcaaaggctactgtgccaaactttcaagtagagtgaagcctcctccgtggtgaactataaacttggatggcatcatgtccatttttgtgttcttcacagcacccaacagcaggttcacagtcaacgttagtgagggaccgagattgtagaagcaaatatttctccagcatcaggggtgttgcctcactaggatctaccattgggatcccaacccaggatgatggtttgaaaccttccggtccagttctcccccatttgtcagtctttgtccttgacaattaatgctgtaaatgcatgtactaaatgcccactgagtgtgtgtaacacacaagccggtgatatcagagtggcaccggacagggagcaacacttctgcaaaggagcaggtattccaagtccttctcatctttcctgagcatctgtcatttgggtggacctcactgcacccttcagctattagcagtgactgtaaatggagaagaagttctcgagaaccagcagcaccctgaacactcattaactgagaaaaattggagactcaaggaggcccaataccctcttactgaatacccaccttccttgtgccagggaggtcatagggaggttgaaaaatcaagggttttgccatgtgtctgagtttgattcctccaaaagggcattaacttttcatattacctctgcagagtgggatttaaaatctgtgttagtgacacgatatttcatttcagatccacagggcccacatttaaaattaatattgcatgcttgtcagaatgaattccaaaccctctcacagcaggccccttgtgggacctagagaaggagtggccaattcattatcgtaacactgggatgagggttccatcccagcttttgactgacacctgcagagattttttttttctgagacattttaagtttttggtgtgccccatcttcccagacaagctgcacgtttctgtcactctgtgctgtttccaaagcccagtggtctgcagggtacctttgaggggcctcctctgatccagttaatcagttcctcattgacaacatagacagagcatctggcccaggccagagagggctttcggccgagtccctctggaggatcagtctgtagagggatgtgactaaggcagcagattccgccaggattctgttagacacagaggacacaaggtcacctggccaaaagtggaggtcaggaagactcaagatctgggtccacctgtttcattttctcttagcatctgccctggcctgctgtcgtaaatcatcatcaccgagcttaaaaccaccctgtcgttcaaaaaaaaaaaaaaaaaatgagctatttggtttttgaacactttccttacagtgcgtagcagtttgttagagaggtgggcaggcattaggattttgtttataaccttggaataaactaagccaacagactgtattcttgcagggttaatgtcccctgctttacagtatgggaatgcccaacgaagtttttattatagagggtggaatatggtgcagtattcagtggagacaattgccccgggagtgcagcgcagaaagccacagctgcatctccacttggtgtcggccgggagctgcctcacctggggctccagggtccctttgagaccgcagttccatagcccgtgggtactgtccttgtgtcatcatcctctctctctctctctccattccagtcattcactctctccccctctttttctctgactgcctccaggcactttctttagcacagagctctggtgatacctcccactggccttgggcacccttcttcaaggccactcaccctgcatggaggagaggaagggaaggagtggccaattcattttcgtaacaaacacccaattttgtttttctccgtggactatccagatgcatgcttcttttacagttcatgtctgcgatactttgtcccttagagaaaaaagctgtatacaaatgtgaaattattccaattatctaatctctgttgcattcctcagccctgcaaagagttaaatgatgtgtaaaatcacctgttagcccgcattagacagggctgtatttacacacccagaggtggcctgtgaattatttaaccgaagggactcttggctcagcatctggctagacactgttgagcccaagttccttaggaggtgcagcctgtggccccagagcttcctcttggctggggaaaccgtctgacagacacggtgggctgctgccagaaccaggtctccttgagaacaacttgaactaagctcctcccagctccagatggttcacaaactagagaggagttttgcagagtcctgaacgctttgccaaaaaagagcgttggccatcttccaggccaggcggtaggtttgcctgcatgctgtgaatgccaggattattgttggggttttagagagtccatttcataacacccccagttcccatctgaatttggaaccaatgagagaaaaagggaaagcagtgagatggatggagatcaaaacatcacttttgtcaccaactgacctctcagagaacagggggagagtgacactggatgtcccaactaggaaccccagagtagagacacacttccatgaccagtgctggaaacccatctgcctcatgccaggaggcaggatcttgggtccctgtaccctggtgcagggaacggaaaggagccataccttctgcaagcacccagctcctcacaggaagccagggccaattcttccacctctccttgtctcatctcacttttcaggtgagcttcctttctctcctaccaaggagagggtgggggctgtggcaagagatggaggcatctggggaaaagccttcctcggggaaaacagcattccatatatctcccagggagatgggacctgcatatatttggaggaagaagtcatagagattgcaagagctggagaggattttagaagccactggaatcctctcattttactgaaggaaacagaggcacacgggtgcagcgaaaccctcatggttatatagctagtcaggggcagggctgaatttgtgtggcagtctgcagtttaaagccggtccctcatggtatggagaacacagcagtgggcatttcacacgcataatctcaccacagggggccaggctgcctcttggtctatgggactccaccccactgtgggtttcagggcaggttcccactcctacctcatctatcccttcttgggaatgggagatgcttggaggatgcacagtaattgaaatgctattcctggcaaatgatcatttccgggggaaaatgtgaatatcatgatatcaagtcaaataaagctgttaggttgaggctttgtccttgagctttttagactctgaacaggcagttgggaaggcagtcagctcctgcctgagtcactgggcaggacagccagcccagggaaagatgagggaagtgggggacctgcgttggtatctcactgggaggatgctgtggcctccccattcgatggagatccttgtcaggcctgcttttgcaaatgctcagaactccaggcagctctctggccctcttctttctgtcctctccatgcagctcccactgctgtatttactcggttggcactttccgctgtcagaatcacatttctcccagccactcactgtgttgcagaatctgtgtattgtcttttcttcagctggtgttttgggcttaagccctgaaatgctttgttctgggccccactacagcacccatactgtgtgctagagaaaacaggaaagggccctcaccatcacacccatgaccttggggaggccagcacctttgttgtcatacttcccaaaaccctccatcccctccctgccagaggagctagcacaatctagatgcccactggctgaggtttatttccagcactgcaaggtaacaggtacacacatacgcacaccagatttccattcccattaaatctctgcatccccaaatgagctacctgttggcaaaagctttttatctgtcagaagttctcaagtggaagttgtctctctctctttgctgcacgtgtgttaccacaaatgcggattgtgccggcctttctccatctcacccacaacctccccttaaacctccatctccaacacccccgagtcttcaatgcctcaggagaattctgaagccagcatataattgctgtccagaaagaggccccgtgggaacggaaaggattttgtgtgtgctcacccctacatttaatggggccatccttccccataaggctcagtgctgcaaagccaggagcccacccccaaggctcatgccaaaccccaattatctggagggcaactggccctgggagctgggccaagcacagcccctcctagctgcggaaagagccttcctatatgtctcgtttgacgcctacaaaaacctggggaagctggcagggcagggggtggggaggttaagcccatagggtggacaagccacagggctctgctccctcccttccccctcatttcttcacccctcccccatgaaaccatcaatcaccttgatggcaggagggaggggtgcttggctgaattgacttgaaaacactcagaaacccaaattgcacccacagaggcactcagaattcagggagatgagggatgtccgcctgaaacacttttttgcagtaatgtgttccgtgatggaagtcatctaattcattcatgaggggactgagacctcagaggaaagtggtgtccctgaaactagcaagggtcagaactacttgcagagaagccactaggaaggctttccagatgagactctccccctactcccactaatattagagggactcccctccctccagcatctccccacagggtctggctgcctcaggcttcccttggctctcagagatgcccttccactcaactgctacccacatgcttctacctgctgcacacaccctttctgtctgcagcctctgatatggtttggctgtgtccacacccaaatctcatcttgaattgtacctcctataattcccttgtgtcgtgaaagggacccagtgggaggtaattgaatcatgggggggcaggtctttcctgtactgttctcatgatagtgaataagtcttaggaggtcttctgcacaagctctctcttgcctgccaccatgtgactttgctcctcgttcgccttcctccatgattgtgaggcttccccagccatatggaactgtgagtcaattaaacctctttcttttgtaaattatccagtctcaggtaggtctttcttagcagcgtgagaacagactaatacagcccctcccctaggctttccctccttagagttcatgttgcagaccacttttccttccttctccgctactgactgcccccatccctgtttgtccagggttctcctgttttctgggttccctgatgagagttagttccttttagggactaattcgtcctagggaggactagattaatagactaccaagtcccctttccaaactgacttgcattttaagatggaaaagtgactcccagggacagggcattggctcaacaggtgcttctacagcttggccgtgacagcctgtctctacatagaaagggccaggggctgcagtctttgcttggagctgtgtttgtagaacaagcacactgtttttaacgtggtttatggttttgtttaaatcaggagtgtcgaatcttttgtattccctgggccacaatggaagaagaagaattgtcttgggccacacataaaatatactaacactaatgacagctgatgagcttaatgttttaagaatgtttacaaacttgtattgggccacatgtggcctgtgggccactggctggacaagctcggtttaaattgataagatattcgggaagaagatctaatcactctcctgccagcctctaccctgctgctaaaatgctttcacaggatctaggtcactggctttgataatcaccacagcttgtggatgtcctcctaagtctagtgccggaagggaactcggtattcctcagtgtgaactggaagcagatgaaggaactccacctctcactcaggtcatcatgtttctgttaatgcatcctgagatcaaattcacctttttcttttgctgccatattatattacaatttttcagttgacttaattgcaaagtatcttctatttgggctactgagtcacttatctctcaaattgtgtgttgttctaactatatatctatgccataagtataagggtttacatttattccttactttatgtcatcttaaaacaaatgaaagactactctaatcatgccacttctcactcctgattctagaaaacagtgtctttcttgaccctcctagttttaaatctggactatgaatctggcattcattcttatcccctaacattagacagagtattggctttcagaaagctaagctttgaagtactatatgttgtgtggcttactggagatcagacaatatgcaagaagtcaaattagttagtttggctcatggaaagctgtctaatttggaaataattaggtgtcatctcctgagagagagagagagagagagagcgcgcatagggagaggcagtggggaagaggaagagagagaggacagaaagggaagatgagagaaaatagttttcattacatgttaagcagaaagagttggaaaaaaataatttctatgatctgcaaagtcatttcaggagtacattagcttgctagggctgccatagttaagtatcacaaagtgggtgggctaagtaacagacaattattaactacagttctggagaccagaagtctacgatcaagacagggttggttccttctcggggctgccaggaaaggatctgttcccagcctctctctctggcctgtagatgactttgccccctgtgtttcttcacagtatcttccctctgtgtgtgcctgtctgtgtctaaatttcccctttttataaggacatcagtcattttggattaagatccacactaacaacctcattttaactcgattacctctgtaaaggccctatttccaaatgagatcacattctgaggtactgaaagttaggacttcaatgtctcgatttggagtggggcacaattcagtccataacaaggggattcccaaagagttgtcataggaatatcacccatcaggcaaagctcctggaagcagatggagccaccattaggaaagtttcccatgagactgtggtgcttctgatgtggctcagctctggaactgactcccacccccatcacccatttcaacctctaacccccaccacctaaccaacaccccctcccctgtaaaagcctttcttcttaagtcaggggtaaactttccacattattatggtccgtgtttccaatgcagtggtttctcagatctgcatcgctcctctctacctcctggttccctgcaactccttaacccacaagcagaggaaggagaagagaaggaccctattgtttagagcagaggtgctgggttctccctctacttacaaccttgccctctctcatttctcctgatgaccaggtagggtagacagcaacatccccatccaaacatgagcagtgaggtgacctggccggttcgatgagtggtaggcagcacagccacaggccatctccctcctaaatggggctgggcccaggggttttcctaggccctgcctgactatgctgcaggctctgccttacacttgctcatcctcctgttgcagaagagctacagggagacaagctacaaaaaccttttaatctgtatgattaacagaagcaattggcaaatgaccctgctgctctcccaaggggaataaggggtttattttcagatgctggtatttatcccactgaatttcattgtgcagcctacagtccatcaaatgcttcccagagtcacccagggtttcttcttagattaaaatcagaattaaatcagatagatacatgctttatcaaatctcattttcttggggatgaaaaataagtttctctttcagtctgtgatttcaggaacaggaagcaaagaatttggaagtttaaaaacacctttgcctgagcctgcatagcttattttttctccaggcagatatgggcctccccttgacaaggtgctacctgtaggcaggaaagtcctgctgcttgtcctgccatgtaatggaacttgggccataaggtggataaagataaggctgctctgagaagctgtattagttttcacaatgctgataaagacatacccaagactgggtaatttataaagaaaaagaggtttaacagactcacggttccacgtggttggggaggcctcacaatcatggcagaaggcgaaaggcacatcttacatggtggcaggcaagagaaaatgagagccaagagagtgagagccaagcaaaagaggaaacccctttaaaataatcagatctcaggagacttattcactaccatgagaacagtaggggggaaacccatgattcaattatctctccactaggtcctcccgtaacatgtgggaattaagggagatacacttcaagataagatttgggtggggacacagccaaaccatatcagaagcacagaattagtgcagagttggttaatgaaataatcattttctacataggtaggggagttaaatgatcatattttgccttttaagagtatcatataggaactcttacaaacctatacaaactggggcttgttatgtgagaagtgacgttggtgatacctgcttggaaagcataggtctccaatcccagctgctgtcctctgggagctgcacaaaagaaggtctatcacatgcttctgaagggagctgtagaagcttctgtggttattcatttgctacagatagaagaagaaattaaaaccaattgtgaaggaaagggaaatgaacattattgaggagtgagtaactgtgtggcaggcactgccctgagagattttgcctgcatgctcacctaaattttagaaataggactagctttaaaaaaataaaaaataaatttgagaaataaactattatcctttagaattgataaaaagtagttcatggatattagagatattttggtaaatatcactgtaaagcataaagaaaagaataaaaagtacccatttgctatgatcagaatgttgtgtcccaccaaaattcatatgttgaaacccagcccccaatgtgatactgttaaggggtggggcccttggaggtgattaggtcattagtgttctacctccatgaatgagattagatttgaggaagcctgtttggctctgctggcttatcaggacacatggaaagtgccgtttaagaaagcagaacaagccctcaccagacaccaaatctgtcagtgacttgatcttgaacttaccagcctcctgaactgtgagtaataaatttctattgtttataagttaccccggcaaagatattttgctgatagtagtccaaaagaactaaagaactaaaatgccattgtaccttagcccattctgttgaatcctttggtggctggattgaagagctgggcagtggagagaccagccaatttagaaagactagggggtgcctggtcatgctgccttctatgtaaagagtgggaagtggggcaatgcagaggacattttttggtgcaggaacaccatgaggggaaggactccaagtcttcagatgagatgatggtctctgggcagtcagttacagagcaggaacagcactctgatgtcacttggaaaggcactcatgaaagcagcagagcctgagctggtgtgttcggaggcagcattaaaaatcagcaggaaaggcatgagacatgaaaccaaaaaagggatctttgctgctgggtctcaggcaacacaaggaagaggtttgtcctgggaccccctgtgaggttctaggacctcaggtgctgttgggatcaggcaggaatttcctgaagtcagccttgtggttgcacctccttctttgcggccctcctggggactgttcttcttttttagactcatttaaaatcctcaaggggcccctctgctataagaaagcaccaagggaagggccctgcctttccagtttcccagcacctagcatgcagtgagtgctcaaatataatttatatttggaatgagtgatgattctctctgcttcccctttgggactgaccttgatgctcatttctacctgattttgcttataaattgtgaggagagttctctacactacaatttatctcagtatccctccccagctggtggctctcatgtgctcactggagcagtctgggacatcaaacatgaacaatgacatagtgaaagaagaaaatgcctggggaagataatggcactatctggagcagggagcctgccatctaaggaaatggtaaaaagaaggaggctccttagggcaggtttcaaggggccagaggaagccccaaatgcgtagaatcacagccaggtgctcaggaggggcagcagaagcagccctcaggacgaagggtagtggtcatcgtgcaaggcagacaagggccctagggtgcaggcaggctgggaagatctccagagaatgaggtgggccatctgggggcatcactttgacctgtagacaaagtgaagggagaggggagggtctggtgatgacagcctcagatgcagactctttaagccttctcaaggctttccagtttttgcagctgctgaggaaacttcattctcacccttcttgttccatctgaaaatgcacttctctccagagctctgggagactgtgaaaggctctctcattgccctgaaatatttttttaaggaatgagtatgatcttttctattctctacttctgtcccatgcagagcagatgtagaggaccaggagtgattcagagatgagaactgaatcttccctccagaaagttatgttccagagggaaagaagcggaacttcagtaacagagaatatgaaattggtcctaagtagaggtatgtggctctcgtgactggagcagagggagaaagacttgattcaggttcttgcctcgcagccttggaatgggaaaaaggaataaaaaatatagaacatgggtattagttcattctcacactactataaagacatagctgggaatgtgttatttataaagaaaagaggtttaattgacttgcagttccacaggccgtacaggaagcatggctggggaggcctcaggaaacttacagtcatagtggaaggcaaagaggacgaagtcatgtcttacatatctgcagaaggaggaaaagagcacaaagatggaagtgctacacacttttaaacaaccagatttcatgaaaactgactcactttcatgagaacagcaaaggggaggtctgccttcatgattcactcacctcccacgaggcctctgctctaacactggggattacaattcaacatgagatttgggtggggacacagggccaaaccatagtaacatgtataatacatatgtatgcaagtactggaatatcaagtttcctggaggaagtagcttttgagcagggcctagaagcatgccaaggatttggatgtgtttgttgtgggtggatgaagtccatgaccagcaagcagactcaggagagttttgcagataagtgtgtccagaagcaaaacaggctgggaggagtggtggtgctggaaaggtggcagatgccgaatgatggaggaccttgaattccatagtagggaatttggcatttattttgtagctgtgggaagccatagcagtttttcaccaaagagataatttacatcaattattccaagccctcagattcactccagttgctagttcagttgtttggttcaaggaagcgtcagaaaggaaatgaaccagaaaggatgagtgatcctagagtccagggtgtccttggggtcagagggaggacaaggccttatgttccctgccttttccaggaggaagaaattgtagtaatattccaggacactggatggacttgtttttctttggaaacaaggttattgacctctctgccgcagtaagagaaaaatgatatatatgttagaacttgaatatttttgtagaaacttaatattaaaggccttatgttcaaatatgcagcatttcacagtgctggttgaattatttgggctaggttgccacatggtgttccatgtacaattctccttggtaggctgggttaaaaaatgtggctaggtaaaatgtgagatgagaaataaaaaaggatctttgttttttcatgcttgtgatacttaaataggctactgtgacccaattaagaagctcccagaggccaggtgtggtagcttatgcctgtaatcccagcactttgggaggccaaggcaggcagatcacttgagttcaggagtttgagaccagcctggccatcatggcgaaactccatatctcccaaaaatacaaaacttagtcgggcatggtggcacacacatgtaatcccagctacttggaaagctgaggcaggagaactgcttgaacccaggaggttgcagtgagccaagatcaggccactgtactctagcctgggtgacaaagtgagactgagactctgtcttaaaaaaaaaaaaaaactatccaggcgtggtggtggatgcctgtaatcccagctacttgggatgctgaggtgggagaattgcttgtacatgggaggtgaaagttgcagtgagccgaggtcaggccactgcactctagcctgtgcaacagaggctttgtctcaaaaaaaaaaaaaaaaaaaaaaaaagttcccagaaataacctctaagccacccatctaattggtcccagagagatcaaaaaaaatgcagcattgaaaatggcgtggaggcaatgacttagggtttatagacaggcatcttccctgtcgtcatccctgacatcttccccaagtgggctaccacaggtcctaggtgatgactggttaggccatgaagctgttcagagggacagagagctgcagagtttggggaaatccaccccctgcttccccagaaggagaagatgcatactaatctgttttggagacaatgcagaatactgattagccaaatatttgctggtgatggggatcactgtgtgtattcgttttctattgctgctataacaaattaccatacacttaatggtttagaacaacataaatccattcattatcttatagttctgaaggtcaggaatctgaaaagatctcactgggctaaaatcaagttgctagcaggactgtgtttctttctggaggctctaagggataatcttttttcttgccttttccagcttccaggagctgcctgcattccttggcttgtggccccttcctctattttcaaaatcagtaaagtcccatctatctgaccccttttccatcatcacatctgtctctaaccaactatagctgggaaaggtcttctgctttcaaggacccatgtgattcactgagcatacctggataaccagggtcatctcccatcttaagatccttagccttaatcacatctacaaagtcccttttgccatgtgaagtcacatattcacagattccagggattaggacatggatctcttttgggggaacatttttctgccttctatagtgtgtattaaactttgatgcttatggcatggccccgttttcgtatcttcttccactcagctaaagccttaggtgagcccgggccaccctggcagctgccctggccagctgatgtggtgatccatggagccagctctggttcatgccaataatctcatttatccagcagtctcacttggccttgaacaatttaccgttcccaaatatcagcatgtttttctgtaaaggagtgatggttcccaacaagaagaggttgacacactcaaattcaggtaatttgaggagattagaataaaaggattttaggtcttctgcggttgctagaatatttcattggccagtatctattgtcctcatccgcactgttgctggccatctgcggtcagagattcctcagtccagggcctgaccaaaaggacttgctccacttacattgcaaagcaaacaacagattcttaaacaagaaagatgatgccttctaaagcttggctattccagccaagctcaggggaaagacattttccctaaagtatcaacaagccatttgatctcagacttagaaggtcattcttgtctgcttttttctcccattagatgaaagaaaatgaaatgttttccgtaaaagtaatttatgaagcactccatatggcaatattaaaactgtaaaagtaagcctccaggggacaaaacaaataatgctgtgtcatccgtctgccctggtactgtccctgggtaatgtcaggcacagaacgttggggaactggctccccactcaactggtacttggatgcctttggagcttttccttgaacattgttgctaaggttcatgaaatcttcagatttttgttatggaatccattcgcaaagcaaaatgatcttaagtgtaaatactaaatttactgtaaattgcagacatcactacctccaagacccttttaatatattgagtcccactgaatgctggaatccaagataaagttctttaagaatatagcactcatgtcattcatgtattcattcgttcattgatgcagtcattcaagaaatatttactgagtacctattaggattcagtggtgagcaaaccactctaatgggtgatacaaatgcaaattagagcgatcgttgatatggagaaaagatagagggtttaataagagcttataacaggataagcactgggacaccatggacagattttaggtaggggagttaaatggtcatattttcccttttaagagtatcatataggctgcagtgtgggaaacagatcagagaggcttcagggcctgcccaaccatcctttacgagtgttgtttaacgcaaggtctcgtggtagacagtgttacatggttaaccccatttccattctcctcttgccctgcttccatgtggtatagaggctggaaaagttaaacaccttcttccccacctcctgtgcagctcagtgtagtcatgtgaccctgctctggcctgagacttgagcagtgatctgttgaggtcttctgggaaggaatatgcttttcctgataaaaggaatgagtgcagctgttccccctccccctccttcccacctttcacagagaagggatgactagagctgggcagccatcaggcaaccacaagggaaagaccaagatgttggtgttcatagaatagagcctctgcagcaatgtcagcaccacacacatatggactgcttgttatgtggaaaatatcagcccccatctttggagattggatttttttgttgtggttactttccatgaaaagcattctaaacagatacagtgattcaaacataggcttagccgaaaacaaattaataggcattttgatcattgtcatagttagcgggtggaatccccaaattccacttgtgccattgaaattgcagcctttgaatgggatgataaaagagggttggaaagaagaagggagccgtgatggttttcttccacaggcctgtggtggcattcctcagtgtttcacttccaacctccttggaacccatgcttatcttagcttcagcctccaacacagccttaactgtaagcctagttccctgagtcactctgaaatgtattagtccatgaggaaggagaacagattctgtcttctacctgttttcataactgtagaaatgaacacagtgcatggcacttggtaggtgctcagtgaatgtccactaagccagtacgtacacacaaatacatgcaaaagttgaaaatcgcaatgcattgtgtctttaaaaataaaaaagagaaatagcctgatcttttggaacacatatggggcagagcctgctcaatgaagcatgcacattttggattaagaaatatgattatcatttgtcagctctgatttctgcctctgggctgataagatggtgtccgaggagtcattttcactcctttgcagacaccaaaacagaaggggtctttgctgaaaggtagactctgacgtgacagtcattagtagctagaaacaggcaactgattgcaaagtcaagatgaagtgcttcagtaaaaagaaccttcatgcttgaggcatactctttgcttctttgttgaagttgtggtagatttttttaaaaaacaatcacaatatagtttgctatactttaagtttttaacatctccactggggaaaaattgaaggagctaagtaaattagctcattggatcatgaatttatagaaaaaaaattaatattgccctttgtcgtttctgttaggagtgtcacgggtcaaagcagagacaagaggcatggagaaggagcagtgtgagggcctctccgggtcatttctctgtctggcttctgatgctatctgcccaacacagtttctgaaaacatcagaaactccccagttttgcccaacatgcttcccctaccttgcacctcttagtgcagagacatgttctgtgagaatccacctggtaagacagacaacatggagaggaagatctcagagacctggcttcctttcctgcccttcccttgcagacagagttttactttgtgaagtctccagtttcagaatgagaaacctctgttaagcaaccaggcctatcactgtagggatgagaaaagtgaagtccagataggtgaagcaacttgtcccaggtcaacacagcatgtcagagaagctgaggccagccagtctcctgggttctcccccatgttcttcctactgcccctctgcggcttccatttgtaaagagaggattgcttctcctcactcctctcgcacactcttgaggctatttcagtgaattgtgtctatctttttatatttcccatttaaaagaaaacccactctatggcataatggtttccagtgtcctgctgtttggaagaatgttttacctgcctgtcagtgctgagctttgagctccttgaagaaggacattctcgtggctgtggcccatccaggcagaaccagcctagctggccaagtggtttctctgcatcgtttggctgtcagataagggccacctgcttattgattggcacagtgacgcttaagtccaaacatcctccctaatgacacagaacttcatattaaaggatgtcagggaattgattttgctcttctttaggaacaaaagatgtcagaagttagaaggaactgaacagtcaggaaaacgtaagtctctataccttcccatcaccccatccctgacccacaagccatgatcggccagtggaagataaatctaaccaatcccatgggacaaagggagagagccctgcacagcaagacagcagcagtcattgggcagaaataaatcatgagatggttgagaatctgattctctgggtcaatttctctgcatcctcctctgcccttttaggcctgtgctaaactttccctttgatgcaaatggtattaagtgccttgtgtctgaaaaggttgttggcaggctttggttgagaacataaagatgaatctttgttctcttgtctataaaatggggatataataatctacctcctgtgagaattcaataattttataagataaagctcttagagcagtgcctggcccagagtggatactcaactaatgttaactaagaaaatgaaaatgaaaatccaggaatagtctctgcctgcaaaatgttttgaatgtaaggagggagatgagacgctgtgtatatatgcctctgttctgtatttttaatcaactactaaggccatagagaacaaagagttacccctttttaaggtaaaataaattatactcattgtccagcaaggaagaaatgaattgaaaatcctagaggcagaaaagtgcagagtttggagactaccaggtggcactgagactaaaagctttatttgccatgttcagctcaagatttaatgggttgtatagtgtaaggggctaactccaggatctgctggaactcactctgggatccacagcaaacaaagcactaaccttggcatatggcgctgcgagaagtttcctaggatcagccaggctctgggccactcactgggttcatgcctctgaacattaccttccaggagctgcccccattactgaacctaatacgctactcagaagttttgtaaccaaggttttctaaaagtctgagaaatagaagatgaactttagatttgataaacagggctgtacactggagtcaggtagaggtgagtaggaatcctggccttgccacttactagctgtttgaccttggataaattgcttaacctttctaagcctcaatttcaatgtctttattaaataacttttatgaccgggaaatcaattaaataatttatttaaaatacttagggcagtattgatcatgaaatagatgttctgaaaatacttataatgattttgatcagttcctgagagcccacttgtaattttcattgggtctgtactcttgggacttctccagaaaccatgacaaggaattttagagagtattacccgatattgtagtggactgtgctcaagaatcaaatacaacaatgtcaaaaatttgtctgacacaacaaagaaatggactacctgaaatagtatatatagtccctaagagttttaaaatagatggtggatggtaataaattgaatttctgcgttcttagaaagggtgattcagagataccccaattctaagagtcactgacactgaatgtcaagtattttttgtggcttcagaaatttctgataaatgcattttttcagagtgttgttgtatcataactttgctgtagagcaaaccacttcaaacttagtgatctataaaaataaacatttatggccgggcgtggtggctcacgcctgtaatcccagcactttgggaggccaaggtgggcagatcacaaggtcaggagatcgagaccatcctggctaacatggtgaaaccctgtctctactaaaaatacaaaaaattagccaggcgtggtggcaggcgcctgtagtccccagctactcaggaagctgaggcaggagagtggcatgaacctgggaggtagagcttgcagtgagcctagatcacgccactgcactccagcctgggtgaagagtgagactccgtctcaaaaaatatatataaaataaaaaataaataaacttttattgcttgctcatgagtctataggccagcttaggtttggctgatctagcaatgggttcagtaccatttgctccagatgtctctcatcttccttgaaataacaactattctgaggcgtgttcttctcatggtaagagggcaagagaagggagtaactacagccatgcaggtacatagcaagtccctgttcatatcacattcaataacaccccagtagccaggcaaatcatatggccaaacccgaaagggaaaaggtagacactgctcactatgaggccaaggcaagtattcaggtgtatattaataccatgggggagtcaggaactggggggcaataattccttcttccacacctgtgatgttgcagactgttgctggagtgtagtcttctttctgttagttgaggggattgtttttttgatctagctgtaacccctgatgagtgatgtacctcttagtaaattgtgggcaaacataaggaaaaaggacctctttagtaaatgagccttctaagattcagtcgtgtggtgaaataactaaactgagtggaggacaaagaagtcacagaaccaatccttcaaatccagcccgcagcagcagaggtgtaaacagttactatctaatgtccactccggggtctacctgaattgaattgttggtttccttccaattctcaatgattttctggccattttcatagaaaccatcaatgtaactgatacttctggtttcaaataatatgctagatcaaaagcataaattaccttgaaaatgtgaccatttttctagctctccttggctatcaataaataatactcaaattgctctaaattgttggattgagtttaggagacaaaggccagcagtaactgagatgattaacatgaattgggataaaactccctcttcagttttcatctaacagaatgcaggtcttcagagaatgattgtcttttctagcataatactcatctacctcctgaagggctgggagcttagaattctttctcactctcagtacttcttagagaaacccagaagagtccagtgagaatggtttccctgtttggctgattttctgggaggcagaatggctcaggggttagatgccattctgggatctatggctggattcaaacttggctgcacacctgggtagctgtgtgaccctgcgaaagttgcaaaggttggttaacctctgcagttgtccctgatgttgatcacagatcttcagttcccctttcctcctgtcacccagaggactgagtccctggctcctttgtggttgggtggtgctatgtgaccagttctggccaaggattgtgagcaaacatgctctatgtaacttctggattacactatttaatacccagtgagaaactctccagaattctctcttgtccccctggcacattgaccagcaacatgcaaggtgatgtaactccaatgagtagggttcccttgttgacctacactagacatgtagcatgacagagaaataacctttgtgctaagccactgacatttggggggttatttgctgccataacttaatccaccctaccctgattgatgcacctcactatatctttgtttctttatgtgaaaaaatggagataatagtagaatctatttcatcaagtaattatgaggactaaacaggataatgtgtgtataatacttagaatagtacctagcacataataaatttttaatatattttagctatttatgatgatgatgatgatgttatgccgtgctctaactttgcctctaacaagttatctatttctatcaaacaagttattagtcatgtgtcttcaagaaaatcacttatcatcaagttgcaatcatagtatgttagaataagtgagctgtaagactaatttctagccttatgatgtgagcctctattaagaactcactcagagactccatcctggtgtttcaaagatatttctattggttaggaaaataaaacgtgataatactaaacattattttctccccttcagttgctctcccttccccaaacaaaaagatgtatccttattacagaattctttctgtatcctgttctgaagatttctgctcaggaaattactctggctcgtaaattattaactacaaattggttttccggtttaggcacctacaccctcatcagtccatccccattctctgttctgttttcaccagtaggatgtcaacagtccactatgatcttttttcctgatagcatggtcttaccaaaaggagaagttcctgtccttgaccaccttagtccaggctaaaatagctatccacataccaccactcatgaccactgagacctgttttccaacttcttcagatcagagctttccatatctggtttttctctcatgttactctagatgtatccttctctagtcccaaaggtagccctgtctgcaattcccaatagcagcatgttaatctatgttaacatattatattgaaccataagaaattgcctttgtggaaggggtgggggttgaatatagaaatttcatatggttcaacctatatgtaaacccaatttggaaaagaaggagactgtgatcacatacctattaaattacatgttggatcccatcaagaatcctaatgtatttcttcctccataccttgttgaactgggatcttgttccaggacatgacttatgctctgtatataaccttcagacctccctatacccagcacttggtagatagcagatactgatgctgtatttattgaccaactagatgggagctttttgtgatatctattgttgacatccatgtttatacatttgggctgtttaaaaaggtaccatttataattacattatgggagaaaataacacttcttttctttaacctctttcagattgaagacatcattacaaagatgcaagatgacaagacagggggtgtgcccatcagaacagtcaagagctttctctccaaaatccccagtgtcgtcacaggtaacaccctccttgcaaggtgttggtaacagtcagaactaccaaagagttataagtctagattgcggcctgaggggtgtctgaagatctgtgaatagtaaaaatgaaacattcagtgtgtttcttgactcaggtcccatcctagtcttagtttccaggaagaagctacttgttgcccatcattaagaatgaccttaccatgaccagcccttcaagtgcatgtagattgaggctgctgggaataaataaacccattaataaagtggcgcatcagcaactttgcctgtgggatacacacaagcacagaaatattaaagaaattaaacaggtttttaagaaagtgttatattcaaattctacaaaatgcttttattttcagttttttaactcagtgtacttgacctcctgaaagagaggttttaaactatttttcttcattccttatattgtgctttgtgtgctcatctttcttttaaaatattttattgtgaaatatattaaaacacatgggtagttcaaaaataataaaacacagtacatgtacctaccatcctgccttataaagaacattattatcaatatcttagagcccccttgggtacctactgtattgcatccacttccctaaacactatctgcttgtatactaatcaattcattgtttttcttcatagttttactacctaggtatgtatcttttgctatccaaacaagtaaccaaataaattaagataaaattttagatgattctcttaatctgcctatatgcttttcaaaattcgggaaccaaaggacttagttttcactatataccttttagaatggctaaaaataaaaatattgacagtaccaagtggtggtgagcatgtgaagcaactggaactctcacatattggtgatacgaatggaaaattgtgcagctactttgggaactagtttggcagtttcttacacagttaagcaatgcttaccatatgaaccagcaatcccactcctgggtattcacccaagagcaatgaaaacttgtgtttatacaaaaacttgtatgtaagggtttatagcaacttttattgaagtatactgaagaatatagcaactttattcatcatctccaaagactggaaacaacccaaatgtccttcagtgaacgggtaaatggataaacaaactgtagtctctccacaatcagcaacaaaaaccagggaactattgatactggtagcaacttggattaatctctaggtcatttttctgagtgaaagaagcagtctcaaaggttacatgctatgtgatttcaggtatacagcattgtatacatcacaaaaccgtagtgataaagattagatcagtggtttccagcaactggcatttgcagggcgagtgtgactgcaaaagacaacaggagggagttttatgagatgatgatgatgaacagatgaacagttctgtatactgattatggtgatggtaacatgactctatacataggccaaaattcatggaacaggccaggcatgatggctcatgcctgtaatcccagcactttaggaggctgaggtagggggatcacctgaggtcagggggttgagaccaccttggccaacatggcaaaaccccatctttactaaaaaatacaaaaattagccgggcgtagtggtgcgtgcctgtagtcccagctacttgggagactgaggcaggagaatcacttgaacctgggaggtagaggttgcagtgagctgagatcgtgccactgcactccagcctgggtaacagagcgagactctgtctcagcaacaacaacaacaacaacagaattcatggaacagcacacacacacacgcacacacagggtcaatattactgtatattaacctaaaaaataagtagacccagttgaagtaagtatcccagctcattattgagactgtcactctttgaactcaggtactgtcttactcagctcaggctgctagaacaaagcaccctacactgggtggcttataaagaacagaaattcatgtctcacagttctggaggctggaagtctgagatcaggtaccatcataggttctggtaagagcccattccaggttgtagactgctgacttcttcttgtatccttgtttggtggaaagaaagctagatagggggccgggtgccgtgactcatgcctataatcccagcactttgggaggctgaggtgggtggatcacctgaggtcaggagtttgagagcagcctggccaacatggcaaaaccctgtctctactaaaaatacaaaaaaaaaaaaaaaatagctgggtgtggtggcacgtgcttgtagtcccagctacttgggaggctgaggcaggaaaatcacttgaactgtggaggttgcagtgagcagaggtcacgccactgcactccagcatgggcaacagagtgagactccatctcaaaaaaaaaagtaagctaaatagctctctggcctctctgtaaagggtaataattccatttgtgaggggccctccttcataaactcccccaaaggactcctaatgccatcatgttggggattagatttcaatatatgaatttggaggagacacgttcagtccaaaatagagcccagatagatttgggtaatgaaggatacttgtattgttagtgttctctaattttaaaatttatgtaaatgaaattttactatatatattattcatgtataatatacagtataatatagactatgtatgtaattttactatattatttttcacattcctggattttgttcaataatgtttaagatgtttgtatctatttcacaggccacactgatctgttgtttttcttaccattgttgctggtttgggtatcaaatttatgctagcctcataaatgagccatgaagtatctctcttttcttgatatcctgcttttctttgaaaaataattgtccctttaatccaggttttaagtatgtaatttcaattattttttatttttaaaatttcctctggttctttttttttttttagacagagtcttgctcttgtcacccaggctggagtgcagtggcatgatctcagctcactgaaacccccacctcctgggttcaagcgattctcctgtctcagcctcctgagtagctgggattacaggcatccgccaccacacctggctaattttttgtatttttagtagagacagggtttcaccatgttgcccaggctggtctcgaactcttgaccttaggtgatccgcccaccttggcctcccaaagtactctggttctttttacaatatacttggtcattcatttttttaaatttattcatttagatatttattgagtgttcactattttctaagcattgttaaggacttgagattcagaagtaaatgaaacagataaaaagttctaccctcatggaatttatattctagtagaggaggaaataagtaaggaaaacttgcagaattttagattgtgataaaggccaaggagaaaaataaaatacacaaaaggatgggaagtgttggagtgttgcagctttggaataggtgctcaagaaagagctcctcgagaagatgacatttgagtaaagacggaaaggagatgagggattgaatcatatggatattgagggagagagcatgccagacagccagagctcagtgcccaaggcaagagagttcctggaacattgaggatctgtgaggaggagccagggcagctataatagagtcaagaaaataaggagagtggggatgaagccacgtgagaatggtgagcttgatcacttagcctcttatcactgcaggattttgcacatggcctgacatgctctgacttacctttcaatgagatcactctattatattcagaattccctgggggattgaggggttaggtgccagataggaggctattattaaaatggtgcctcagactaggtgatatggtttcactctgtgtccctacccaaatcgcatctcaaattataatccccacatggcaagggagggacctggtggtaggtgattagctcatggggaaggttctcccgtgctgttctcataatagcgagtgagttctcacaagatctgatggtttaaaagtgtggcacttccccctgctctctctctctcctgccgctatgtaagacatgccttttttcccctttaccttctgccaggattgtaagtttcctgaggcctccgcagccatgtaattaactgtgagtcaattaagcttctttcctttataaattacccagtctcagatcattctttataacagtgtgaaaatggactaatacactaagctatcagcactggagatgtgtgaagtagtcagattcggattcaagtctgaaggtagatgatatggtttggccaagtccccacccaaatctcatcttgaattgtataatagttcccataattcccacatatcatggaagggacctggtgggaggtaattgaatcatgggggcagttacctctatgctgttctcatgatggtgagtgagttctaatgagatctgatgatttcataaggggcttttccctgtctttgctctgcacttctccttgctgcttccatgtgaagacaatgtatttgcttcactttctgccatgattgtaagtttcctcagccgtgctgaactgtgagtcaattaaacatatgtcctttataaattacccaatcttgggtatgtctttattagcagcatgagaatggactaataccgtaaattgttactaggtagtggggcactgctgtaaagatacttgaaaatgtggaagcagccaggcgcggtggctcatgcctgtaatcccagcactttgggaggccatggcaggtggatcatttgaggtcgggagttcaagaccagcctggccaacatggtgaagccctgtctctactaaaagtacaaaaattagctcagtggtagtggcacgcacctgtaatcccagctacttgggaggctgaggcaggagaatcacttgagcccaggcagcagaggttgtggtgagctgagatcacaccactgcattccagtctgtgagaccctgtctcagaaaaaaaaaaaaaatagaaaatatggaagtgactttggaacatgggtgacaggcagaggaaggaacagtttgaagggctcagaagaagacaagaatatgggggaaagtttggaacttcctagagacttggagggcttagaagacaggaagatgtgggaaagtttagaacttcctagagacctgttgaatgactttgaccaaaatactgatagtgatatggacaataaagtccaggctgaggtagtctcagatggagatgagaaacttgttaggaactggagcaaagataaccctcgttatgctgtagcaaagtcaggtggcattttggccctgccctagagatttgtgaaactttgaacttgagagagatgatttaggatatctggcagaaaaacatttctaagtgcagagtgttcaagaggtgacatttgacatctctggacacaagagagcataaaagtttggaaaatttgcagcctgacgaaccagtagaaaagaaaaacacattttctggggagaaattcaagctggctgcagaaatttgcataagtaaggaggaaccaaatgttaattgccaagacagtggggaaaatgtctccagggcatgtcacagaccttcaaggcagcacctcccaccacaggcccagagacctaagaggaaaaaatgtttatttttcctcttaggtccagggccccactgctgtgtgcagcctagggacttaatgccctgtgtcccagctgctccagctatagttaaaaggggtcaaggtacagctcgggccatggcttcagagggtgcaagcctccagccttggcagcttccacatggtgtttgtcttctgggtgtgcagaagacaagaactgaggtttgggaacctccatcttgatttcaaaggatatatagaaacacctggatgtccaggcagaggtgtgctgcaggggcagagccctcatggagagcctctgctagaacagtgcagaagggaaatgtggggttggagtccccacacagagtccccactggggcactgcctagaggagctgtaagaagagggccactgtcctccagactccagaatggtaggtccacccccagcttgcactgtgcaactggaaaagctgcagacactaaacaccagctgtgcaagcagccaggaaggaggctgtaccctgcaaagctaccgggtcagagctgcccaagatagtgggagcccacctcttgcatcagcataacatgggtgtgagacatgaagtaaaaggagattatttcataactttaagatttaattagttacctattggatttcagacttgcatggggcctgtagcccctttgttttggtgaatttctcccatttagaacaggtatatttacccagtgcctgtacccacattgcatttaggaagtaactagcttgcttttgattttacaggctcataggtggaagggacttgcttagtctcagatgagattttggacttggacttttgggttaatgctggaatgaattaagattttgggggactgttgggaaggcatcattgtgttttgaaatgtgaggatatgagatttgggaggggctggggtagaatgatatggtttggacatgtccccacccaaatctcatcttgatttgtaattcccatagtccccatgagtcttgggaaggatgcagtgggaggtaattgaatcatgggttggttacctccatgctttcctcatgatagtgagtgagttctcatgagatctgatagttttataacgggcttttcctctacctcactcttcacatctccttgctgctgccatgtgaagaaggatgtgtttgctttcctttctgccatgattgtaagtttactgaggcctttccagccatgctgtactgtctgtcaattaaacctcttttctttatttcccagtttcatgtatgtctttattagcagcatgagaaccgactaatagagtagaacagatattattagcggatagatcagatatggaatgtgagaggaaaaaaaggaattagccatgatccacactttttggcttcagcaactggaaaaatggagttgctattaatttcaatgaggaatactataataggggtgccaggggttggggtggggggcagttgttagctgaagggtaagaaatcaaaacacaaattttaggtcaagttttagcgacctattagacattcagttggagatgacaagtaagtattccagtatgtggatttggattttaagggagtgtctgtgctgggttcataagccatcagcatgtagacagtatttagagccataggaataatgaggtcaccaagggagtgagtgtagatagaacacacagtccaattcctaaaacacagggtactccaatctatagatgtgagggagagaataagaaaacagcaaaagaaatagaacaagtggctggagacaaggaggaaaaatcaagaggatataatttcttggacaccaatttttctagaaagtgttttaaggaagagtagagtgacctactatagctatgctgagaagctaagggctgagaattgatcattgcctttagcaatgctgaattcattgctgaccttggtaagtgcacattctgtgaaacattgggagcaaaaatccttattgggtgtgtccaacctgagatgaggagagtgattcgaggtgctaagacagttaatcttggaaggagtttcccttgtaaaatgaagaaatgcagtcatatctagaggggtacgttaggtcagaacaggtagatttttaatttaataaaaagataatatgtttgtattatagaaatgactcagtgggggtgggggagatgatgtaggagaatgggaaaacttcaaggagttatatcaaagaataggtaagagaggattgaatttaacatgcatattggtgagtagtttcagctagaaacacatacaatttattcatagaaagaagaaaggaggcagccgggcacagtggctcaggcctctaatcccagcactttgggaggctgaggtaggcagatcacaaggtcaggaaatcaagaccatcctggctaacacggtgaaaccccgtctctactaaaaatacaaaaaaattagctgggtgtggtggcgggcacctgtagtcccagctactcgggaggctgaggcaggagaatggcatgaacccaggaggcagagcttgcagtgagccaagatcacgccactgcactccagcctgggtgacagagtgagactctgtctcaaacaaacaaacaaaacaaaacaaaaaaggaagaaaggaggcataatagatgcacagaggtacaaataagtgggcagatgtgatgggaggtggtggaagcttatagatcttctcattgtctctatgttcctagtaatctggaaaccaaaaatggtagagattttgcaagttcaaggagagatcataagttataaattagtcaactaggaaagtagagattgactggactagggaaatagaactttgattgtgactgatatggtttggctctgtgtccccactctgatttcatctcaaattgtaatccccataatccgcacatgtcgagggagatacctggtaagaggtgattggatcgtgggggtggtttcctccatgctattctcatgatagtgagcaagctctcacgaggtctgatggtttttataagtgtttgacagtttcttcttcacagactctcttgcctgctgccatttaagacatgcgtgcttcccttttcgccatgattgtaagtttcctgaggtctccctagccatacggaactgtgattcaatcaaacctctttttttttttttttttttcataaattacccagtcttgggtatatccttatagcagtgtgagaatgtactaatacagtgaccttcttaggatgattaatatttttgaatttaaagacaggtaatttttttccccatccacatttagctctgtggatttgggcatgcctcaggtagaaagtggacttaattgatgttatagcaagtttgaggttataatagatcaagacagaggcacagtaactaaaatgattgcccattacatttaattgagtaaggatgaaaacaagaacatgagatggatgaggaaccatgaagagtagtaattaccacaaattgtaagtcaagtggcaaagaaattttggagttttcagaggcaagagtaagagagctgaaaatatagtagatggtgattagatggtggcatgtttgaaattgagattctggaaagattgtgattattggcagggacaataatataagatataaccataggaacaaggcattgaaatgggataaagtgtaagatttttggaggagaggaggttaaggaactgagaggccatgatactggaagactgagctgtgtgaatattgaaatcactactgggggagtgttagagaaggtggttgtgagttaaaatctttatggaatgagaagcaaaggaccagggatcagcagatgactttcacaataagaggtacaggtggtttaatcagatggtatgggagtcaaagctgagtgtgttttagagaagagggaggggatgaaggtgatctgaaagcagcagttagtagcaggacagtcacttatctacctgtaaaccccatggtatataaagtgtgggagggaaaatagccaccacgtaagagggctgcagggaagcaggaccactggggaagaatgagaagatgaaaggaatattaactgattttatttatgattcatcatgagtccaagagggcaagtggaagggtttcaggaggagatggtgagtttatgacttgagtaataaatgcctgctgttgctatgtgccaggctctagagtagtcacagacgatataaagatgaacaaagacttgacccctgctcttaaaaagctattaatctagtgagagaaacagacacaggtagatcaatgatttatatgagctatgtgccataatagaagaatggacaaaatgctgtttgagtccaggagagagaatcatgaatttttattgggtatgtctagaatatttctctgagaaggtatatcagttatctatttctgtataacaaacccacaaactataattgcttacaactacagtgatttattgtttcttatgattatgattccatgaaccggcaatctgggcagttctgctggtctcagccatgaggccatagtcatctgatggctcaactgaggctggagggtctacagtggcctcactcatttgtttggccttggtgcttactcttaaactcttaactggggtctcagttcttctccatgtcaccttgtatctgccaataggttagattgggcttcttcacagcctcttggtcttagggttccaagcaggacaggataaaaactgcaagacctcttagggcctaggctccagaactcatacaatgtcaagtgtgccacgtcacgttcttcaaggcaaattacaaggcaaagtctggattgaagaggatggagaaaccaactccacctcctggtgtaggagtggcaacatcatgttgacattgggagacacgattcattggagggcattaccataacaatctaccacagacaataattgagaaccggaccttaaacataagtggaaacccaggaaaagtcattccacgtagagaaaatagaattttcatagcctcaaatacatgacaaacatgccaggtttcagtaagtataagcttgtttgtgtggttggagtttaaaacacatttatgtgtgtatgtatttgagaagaggagcatattggcagaacagccacaggaatgaaaaggatacaagaattacacctaataatatattataaaggaaagctgacttgtagactttgttccaaaggtggggctgcttttatctcaaaggtaacccatctaccctgctcagatggactgccgtcagaggttttaaatatgagggaattcacatccatgaagtggatggaagtttaagcaggaagaaatgaggagtgtggagactagttatggagtctagatgagggaatgtatgtgagaaataaggccatattaacgacaaccacagcatcaactgaaaccatggctgtacagccacgcatcattaaatacttataaaaaccccatgagatagaaaccgttattatctctaccaagtaatggaggaaactgctaattcaagagtaacttttccaaggtcacaccactagtaaatagcaggatctgttcctctgggccacccgtgtaaggatggtagcagtagggttcaaaagatcagaggaaacagtagaaggtatgattgacacaacctgctgacttgaaatagagcagagggtaactcatccaaaatggatacaccttaatatcatggattgaatacattcatttaactttttctcttctgaaaccccacaaaaattatagtaaaagatttttattttaaaagcatgatctaaaagttggaggcctctattacagtgatctaccatgggaaataaacatccttaaaaatcttgaaaagatagtccagtacaaagggcagtcagtgcctcactctcaagatgtgcagatgtgtgaaagactcatggagaatagtcttccaacacaggagacaatagccacaaaactcaagaatctgaaaaacaaatggatgagtggtaactgacaatagccctgaaacaatctaaccatcacttgtcagtggacaaggctaaaaaaaaaaaaaaaaaaaaaaaaaaactctatatttatatgatggagttctcaatgggctcagaaactggtaacatcagcagacttttctatctagttagaatacattttgccaacactctcacctacttaactactgcacagaccaatcactagctagtgtctattgtttagcaatatcagatcctgcacttggccagcacagctcaggctggtgttgaggtggttcctaagaccagtcaagccccaggacagaagacaaatctcatgcttacctctagttgctggcactagagtagagaattacatagagaaaaaacccaggtcactgagacccatgggtaccaaacttaaagttgaaacgcattaatacatggccaccctgttactgtggcaagagaagctgtatctacatgggacagtaatcagcccacacttcagcctttccaccagctcagcagcctccatcagactttctagccatttgagaaatagccagtttcccatcacaaaccagcagataccagcagatactccaacattggagcttccatttcaacagcaacagctgggggaataactttttctcttctctattgggaccccagttctttaataaaaattgaaagtaaagatgaaagaataatggacattataaggctggttaatcagcagtgtctttatttcttgcactgctacataacgtactgtccatacctacatgtgactttgctaaataaacagcaagtgatttcaatggaagaaggcaagaagatggagaccaatggcacgatgatgacagtctgctggtgaaagcttctttccaaagatgatattgatgaggaatgcatgagcatgtcccagtgcatccaagactctgtcactctcagaagctctgggaagctgcttgtcaccactttctcagcaacacagtgaaagtcagagaataatgttgataaaaagtagtatcttgctgcaaggcccgtctctacactgtcaagttaccacattgagttgaaaattttgccaacatatccagatcatcccaaaggcgaaaagagaagcaactgttaatgacctacaccaaataaatcaacaaacacatagcaatatgcggatgtgtacctttgtagtggatcaaatgagcctggacaagaaactctaaatggaaagttttagagcataaagagaacattctagaaaaagaatgtacttgccaaaaaagtcaaaactgagataaaggaaaaattgtagacctggggaatgtgaatttggaaaaataatttatgggtactgaggatagagataacaggggaggtatagctataagcagagcagaaaattgatatccagttttccagaattcacaggtgacatagaagggaaccattgtaccaagtgatacacaaagatcagagttgaagagatgtgatttcgtccacgagtccctttaaagctggctttgtggtgtgtttgtttacaaccttcctaaggtgtcgatgtctaccagttggaacagtgacacaagagatggtaggcatttcttgactttccatctcacaaattaaatttgtttggtgaattcctgaaggatccatacagagcctggactgaaagcacctgtttcgatcttatgtgctgaaagcaaaaccttttctcatcaaatgtttctcttctttgtctttctggctttcatatgtgtgatctaacttcattggttacatctttattaataataaatatctaataaaaatgttaataaatttaaataaatacattgaataaaaataacctatattcatctaacctgttttgggtaaaggaggttcctatacccaagataaggacttgaggaagttatgggtttgggagagaagacacaagatcagtcttgattatgctaagcttgaggttttgaagggttatttgggtagcactgtttaggagaaacttggaagtgaggagccaaagtcctggagaacattttatgtaagagatatgtatggatttgggagtcatcagagtctgagtgacccgggactccagggtcatgactgggaactataattttcacatcttcttctataagccatgtattagtctatctgctacccagccttgagataacatgctcacccaccccacatcttctatgattttgagtttgaaattttcccaccaatatgtaagggaaattatcttccctgctcagatcaggacaaactcataggtgaattcacaggtattgctgggatgaagagggagaaggaatgcctgttggttcacctgtgggttcgaaatgttgggattgggaaggttggcccagggagtaaatgcactgagttaggggatagatatgtttgggagaaggccaaacacaagagataaccattagaatataatctctgtcttagaaagtgaaaaattaagagctgtaaggggtgaggtttagcaaataaatatttctgagcaaaaatagagaattggagagagaaggaaatacggaagaaagaagaacccaacatcagatcaaagtccaaggctcattggctttttgcaggggaagtcacatacaaaccatctcatcttccagaagcttaagatttctgagcaaggtgcccacagaaagggtacttcagagccaccctaccaatcccttttcaggactacagaccaacctcctcagaccctctttgaatagtaagtaggtaacaaagatgatcactggagccaagatggtgagtcttcggagtttccaacctcagcgtgccagctctatccacgccccacctgccctgcaggtgatagacatatcctgggcagaatgcctgccagccccaggaaagcagccagattgtgcagctttgcccagctgtcatagacagtcattccaggataattctccatcacctgaatgtcatgaagaattttccagggactttggagatttatttcttccagaccaccctcagaaacacaaattcctagcatgtaagagccataagatgcatctagtctcacttattcttgcagtcaggaagattgagtaccagagacatgatgtaatgtcctcaaaaatcacagttaaggacagaaccaagactggaatctggattcctcactaccattgcaaactgttcccatgatctcatgcacaaaattatagactcttggattgcagcagtttcttaaaggtgtttgatgcgttctccctgaacatgagaatcacttgtgtaacttgttaaaaatagatttccaggacatccccatgggtctggactcgggatcctctattttcagcagcttctcatatttatctcctacagcctgtatgaatttgggaatgtgtaagacccctacagagtgctctctagcctctgttttaacaatctgcaatgatggatgtcatctctccttccatctttggacaactttgaccttgagaaacttttttttttgtaataaacctaccagcctcctcttgcttcactgcattagtcccaattctacctctgtatcacaaagaatagaggaatggatttgattaaaattatgcccacctagctcttccttatgaaattttcttgcacaaataattttcagaaaatatccaaggtatatacatgcatttttattttacttaacacatttttttatgaatacatttctgtcttttcattatccacaaatttatttttaatagctttatgtttacctaaacatttaaaagtattattcttacagtttcttggcaatacagtttggagtctaggctccaaacagcctatgtgacctgggttggtcactgtgtgaccttgagctagtcaccaacctctttgggcctcagttttctcacctgttaattgataggtttggattaaatgatatttgtagtccattctgactctgatcttctgagattcttcacaggatatgtataaaggcctgtctgaagttaattcttttcactttttctcacgatgttctaactgaatctacctctgagttaatttaggccaccagttttgtcttaagatgtgtgtctcagtctgtcttctgctgttgtaacagaatgccacagactgggcaaagaagagagaaatgtatttctcacagttttagggtctgggaagtccaaaagcatggtgccagcatctaatgagggatatcccatggcagtaggcagaaaatggaaggtgcatgtgtgtgaactggggatggggggtgcaaactcagcctttttattgggaacccactccttggatagctaacccactcctaggataactgcattaattcattctgtagttaatgcttctcactttttctcaagatgttctaactgaatctacctcatggaaccctcatgatctagtcattcattaatgatcccatctcttaatattgttactgtggtaattaaatttcaagatgagttttggaggggacatccaaaccattgcactgtggtacttccagattagaaaaccaaagaacaagaaacagcctctgttttaataacgtgcgatgatggatggcatcatcactcattccatctttggacaactttgacctttagaaactttttttataatgaacttccctgcctccctcttgcttcaattcattcatcccaattctatctctttctcacaaatagagaaatagatttcccaaattagtaattccctgagaattgcccaaagttaatcagtattcttagtctttgttactcttcttctgcttctgtatcactggaaggaagaactttaaaaatgcctcaaaatagagataatttgttggatgcatgtagagggctgaataatggccccccaaaatatcagcttctagttctttacatctgtaaacatttgttgataaagggtctttgaaggtatggttacattaagtatcttcatatgggtaggttattctagatcagggtgtctaatcttttgacttccctgggccacactggaagaagaattctcttgggccacacataaaatgcactaacactaacgatagctgatgaactagaaaaaaaaatcacacacacacacaaaaatctcataatgttttaagaaaattgactaatttgtgttaggctacattcaaagccatcctgagccacatgtggcccatgggccatgggttggacaagcttgtcctagattatctgggtgtgccctaaatacaatgacatgtatccttacaaatgagagtctgaggaaaatttagtatagaaagaagaggagaaggccatatggcctcagaggcagagattagaatgatgtggccagaagccaaggatgccagcagccaccagaagattccttagcacctccagagcaagtatggccctgccatcaccttgattgtggcctggtgaaaccaactgtggacttctggcctccagaactgtgagataataaatttctcttgttttaagccacaaagtttgtggtgatttgttgcagcagccatagaaaactaatacagtgccaaaattacactaagcacattatagtttaaagtagatgacacaatgattttttttagaaaaattgtgattcattaactgaaaaaagaaacaagcaaaaatttagttttcttccaaagttttatttgaaaaaatatagattataatattaattttgaaagcaaattatactaacatgaacttatgtagtagaattatttaataagcattcagcttaaattgcttaataaagttataaattgtatttgtccaggtctaatgtagtttaaaatatcttttggatatcataactaatcatattatttccacgttcgtgatggaattaaatcaattagttataaaataaaatttattcttaattagtatgccaaaatttatacatacataaaataatctcttaaaatattcacttcgaaaagtggtatatttatttcagtaatgcttccattgctttgattttttcagatttttttctccagtaagagcttttagaacttgtttaaatatcctcaacagaagcaaagccatgaattcataaccatatatacatttatataatcaaaattgatttggagattctgctttggagaatggtagactagcctactcagaccaactgtctgaatgagaacaattacaaaatctggtaaaaaaaaaaaaaattcacttgatgtcactggagagttaacaagagaataaagagttactgggccaagattcatgctaacataaacatccatagatatgatggtggccttgggtgctgtttttgccctggggacatttggtaatccaagagagcacctgtcagacgatgcctttattaaggcccatggacattatctcctatgccataggggttgtggatttgctagtttaaagaaaacacatgcaaagatgagagcttatttacctgactctggtattgactattaggttttaccatggtcagcagctgtgggctgtgtcaggtttgggtcagggagatgaggaacaaggaggctacatcttaaccgcacggggaggggacgttttaacaaggccaaaggtgatgaggtacatcagggtaaacatgtgttaggcctaaaaatggatgtcaaggcagcaactatattaaacaaatttatgatgggcagtgattactgtttacctctaaggggcagggagtatattgtgattgggacagtacctgcaagagactaccagagtgttgaaaaaaaaattttttaacatcaatcatggtaacatgattaaaataatgtaaactgttcccacagtatttcttcttagcacttttctgtttgtataatatttcacaataaaaatagctttccttttcctttttccttttgttttacaaaaagtaatttgaagtcagttcggtgaataaagtctgtaattaaagagggaaatgccaattgtggtttaaataaggtgtgactctgggtaaatgaagtcagttttcttgttgtccttaaaagctgtttcataagtttatttccaaagagcatttccaaaaacatttgtagcacagccaatactgatggaaggaagggtgtggcttttttagggccaactctgaaaatgacagtgcttaattaaatattgattatgctgtggttgccttaacaaatgtaacttcactgtaacatgttttatttaaatgtatgaatttttcttcttatgggattcactttagtaacaacctcttaaaatcctgtcaacttataactgtgaaagcaaaggcatatctctgatgctcctggcctttgtgtcattaaaatcttactctaaatgtcgcattaattcatcttttcaacatttttccttgtttgatttttttctcctggaagaaaaaatgctaagtggaatgaaggaaggaaaagacaggcagtttattaaaagtcaaaatataccatacaaacccctaattgtactctaaaatttctttttaaacgtttctattaaaaaattctgggccgggcatggtggctcatgcctataatcgcagcacttttggaggccaaggcgggcggatcacctgaggttgggagttcgagaccagcctgactaacatggagaaaccccgtctctactaaagatacaaaattagccagtcatggtggcgcatgcctgtaatcctagctgctcaggaggctgaagcaggagaattgcttgaacctgggaggcagaggttgcagtgagccgagatcgcaccattgcactccagcctgggcaacaagagtgaaactccatctcaaaagaaattaattaaataaaacattctgtttccaataagataaaatttgagaagagaatgaaatccagatttagtgtagctgacccgggatcactgactcttttttagagaaggaactgggaaactgcagtggacatcatgctctggagcaacagtgactatggatttcactgtatcatcggtcgcagcatggaattctatacactaaaatcgctggatgagatgctggtgggaagaccctaacaaaatcgtgtttctgacagaaagtgtatacacattatgagcaaggagaacattagttttcagcttagctccttgtgcagttgaatttgttactctgttctgaagacattggtgccagataaaagctttaaacacaaaacgttgttactgacatgttaatataattatgccacgtattatatatacaaaactttaaaagctaaatttagaagttattgctgtatcatttatataggctttgttctccttaaacacgttgactttaataaggcatgttttgtacaaataaagtctaattctaccatcagttgcagccacaggaaatttgaagtcatttttatataaaatttaaattccaacacttaattcaggttctatgacaccattttctagatccaagaaggaaatcattggctcaggattttctacagcgatctatcctgtatgttcctcagataatatgcccctagaatattattttttataagaattaatggcagaaacatttgagcttatcactgatggcatttgttgactatcaaaattgtctaaaacctcccacatttatccaggtataaaagtaaacttctaggttgggtgtagggtaggttgggagtcaaaagaggacactctatagagtcacagttcataggttttcctaaagaacactttctaaatctaaatttttcctcccactaagccaaatgaggagggctccagggaaatcactggtgatgattaggggtcctacaagaagcagggtgttaaccttctcactgattggattcttgctgagctgttgaacccatagctcatccttgcttctgctgccagagaggaaaatatggaaaagttcatgggccatttgccagagtttgtggatgtatatgaactgagactcttgaggctaagaggctgcatggggcagcccacaccaaaaggcaaatagggcccatattgtagtgtgatgcttaaggagaaatatatggaacactgacctccccacccccaggatccctgtgactcttggagggtcaagggagcatcatcatggagacagaagacagagaaagagaggaaaagaggaagccgagcccacccttttcctgtctaggtcctctagacaaagctgtgaagggaaaaaaaatagaagataaaatgggatttaaattttaaactggactaaattgcaagtgaccagaaagctaaagggtctgctcaagatgtcataagggaaaagtaaaattatttcccattggtacctcatcgagttcatattgttcaagaaactggatataatacctagtgacaaagagactaggacttctgttttgttcttgtcatacagccaaatattgttctggtcacacagccataacaatacccattggggcagaacactgaactggtaagaaagtaagggaaatttttagaggccttaaaatagaaagtgagaattcaggaaagtagactcgttttagattagtcttttctcagaggacatctgtccatcctgggtagtctagggcatgaattttaaaagcctatatgagtatcaagtaaaaaaattgagtagggtggcagtcagttcagagactcctgaagagcaatacgattattagatgagtagggggagaaggctttagagaaggagatgatggaaataatcgttttgtctttggctattaataggtgaaagacaggagaaaaagtctccctagaaaattcctaattccaaattctaagtctattcttgttggcgtgtctcactaaaccccatgtggcccaaaaattcaagcaaaaatttaaattgtctttttttttcccccactcagtaaagatttaatgatgaaaaaatgcaagttttataatacaaatatataaaattatgaaaacaatttttataacaatcatttgatagtctttttttaaaagactacagaaagtttaaaatataattttgtaattatagatataaacaatgaagttttataaaattaatcatttgatatttttaaaaaggctatccaaaggaatttaaaatcagaatgttgttgaaactgaacaccaactgtatctacatttatttctttttttaaaatactttaagttctagggtacatgtgcacaacatgcaggtttgttacatatgtatacatgtgccatgttggtgtgctgcacccattaactcgtcatttatattaggtatttctcctaatgctatccctcccccctccccccaccccacgacaggccgtggtgtgggatgttccccttcctgtgtccatgtgttctcattgttcaattcctacctatgagtgagaacatgtggtgtttggttttctgtccctgcaatagtttgctgagaatgatggtttccagcttcatccatgtccctacaaaggacggcattattcacaatagcaaagagttggagccaaccctaatgtccatcaatgatagactggattaagaaaatgtggcacatatacaccatggaatactatgcagccataaaaaatttaaactttctctatttcagtactgcccccagctaccaggaagaagcaaacacatctcctctctggagaagcacacattaaatacagaacaaaaaaatttccagataaaaacaaaagtcactggaaacataagaaaacaaaacaacataaggataagtcagcaaagagcacaaatggcagaatccaacacataaagattgcagacattgtaattatattcagattatagaataattattagatcatacgaaattgccatttttataggtcaaagctggtaactatctgcagttccatatgcttaacataatgtttttaaagaaataagagagtactggaagtatgttgaagaaaagaggattaaggattctcaaaaaggactagaagctttgataagtagccaaatggaatctctgcaaatgaaaaatataattgaaattagagacttaatagaaacattaaacagcagatttgacacagctaaacaaagagttgataaactagaagataaagcagataaaagtactcagaatgtatcacggaaaggcagaaacaaataatatgaaagagaggttaaaagacttgaagaagagagtgataaattctaacatctaaccaaattttgagaagtaaataacagagaaaatgggaagagcaattcttccccattgtctttattatttccttccaaatttaaagatctaatagttgacagtttttctgagtggattaaaagcatcgggttccaaaagccaaaaaaattccaagcaggataaaatgaaaacaaatctatatctagctacattgatgtcaaatttcagaacactaaacacaaaaagaatcttcaaaatgactagagagggccagctgaggagacttcacctgtgttccaagcctgagaaacagcaccatgggccacccctggcagacacgtccctaggctggctgagcagctgtgcacccatgtcctgggcctgagaaagagccccacagactgctcctggcaagcatgcccccaggccagctgagaaaccatgtgcccctagacagagtaacagccctgtggtcccaaccccagtgagccagaccccaagaaagctgacccactgtgtgcagacatatgcctccaatctgagcaacagctcagcaagcccacctctggaaaagttgcaccgctaccagcacaaactgtctaagcctaggccactgagacattcataaatatcgctagtatggattacagcttaagaaactactggagactatactactgtgtctacccagaagcaaagccaatgcactgcattgagcccacaccccaacacccacataaatgaataaatcttttcctattaaacctactccataaaattggaagaggtgactgtttcatcagatgtgtagaaatcaatgtagggacacaataaacatgaaaaagcaaggaaacagacctccaaaggaacacaataattccctagtaataaaccccaatcataaggaaataaatgaaatgacagaaaaagaattcaaaataataattctaaacaaattcagtgaaatataagaaaatatattcaatgaaatcatgaaaacaataagtcattattttaatgagaaattcaacagagatagatatcatttaaaatgaaccaaattctatggctgaagaactcaatgagtgaaataaaaaatacaattgagaacttcaacaccagactagaccaagcagaatttgttcttacttgaagacaggtattttgaaataatacaggcaaacaaatagatgaaattaaataaataataaaaaggaattaagtcaaaggatttatgggatatcattaagtgaacaaatatttgcattgtggacattctggaagaagagaagggaaaaggtgcagaaaacatatttaatgaaataatacgtgaaaactttccaagtcttgggagaaagatccaggaagctcaaagaaccccaaatagatataatccccacaggtcctctctgaggcacattttagtcaaattgtcaaaagtcaaagacaaacagcaaaagaaaagcttcaagtcacatataaggtaatctccatcagattgatagcagatttctcatcagaaaccatgtaggccaggaaagaatagaatgataaagtcaaagtagtgaaagaaaaaaaataaaacttgccattcaatattatgcccagcaaagccattctttagaaatgaaggagaaataaaaattttcgcagacaagcaaaaattaagaaaattcatcaccactagaccaaccttacaagaaacgcttaagagagtcttacatctagaagcgaaaagacaataaccactgtcatgaaagcatgcagaactataaaacttattgatggagccaatacacaaaggagaaagaaaaagaatcagaccatatcactacagaaaaacacccaactgcaaaaataagagaggaagtaaggaacaaaggatatacaaaacaagtaaaaagaaatcgataggatgataaaagtcctcaccgatcaataataaccttgaatgtaaatagattaaaatctccatttagatgtagactgactgaacagattaaaaatacaagatacaatatacagcccacaagaaactcatctcacctataaagacacaaatagactgaaagtgaagtgatggaaaaagatactccatgcaaacagaaaccaaaagcaagcagagtagctgtacttatatcagacaaaacacacttcaagacaaaagctacaaaaagagacaagggcattatatgatgacgaagagattaattcagcaagagaatataacaattgtaaacatatacacttaacactagggcacctagatatataaagcaaatattattagatctaaagggagagatagactacaatacaataatagttggggactttaacaccccactctcagccttcgacagatcatctacacagaaaatcaacaaagaaacatcagatttaaactgcactatagaccaaataatataaacctaacgacatttacagaatatttcacccaatagctgcagaatatgcattttttttcatcagcacgtggaacattctccaggcttgaccgtatattaggacacaaaacaaatctcaaaaagcttttcaaaatcaaaattatggccaggcatggtgtaatcccagcactataatcccagcactttgggaagacaatgcaggaggattgtttgagcccaagagtttgagaccagcctggacaacatagtgaggctttgtctctacaaaagattaaaaaattaaccacccgtggtgctgcacacctgtggtcccagctactcaggcggctgaggtgggaggctctcttgagcccaagagggttgcagtaaggatgcagtgagccatgatcatgcctctgcactccatcctgggcaatagagtgagactctatctccaaaaaaatattgaaattttatcaagtatttaatctgaccgcaatggaataaaactggatatcagtaacaagagggacatttgaaactatacaaatacacaaaaagtaacctgctcctgagtgaccagtgagtgaaggaaaaaatttaaagtgaaatttaaaaattccttgaaacaaatgtaaatagaaacacaacataccaaaacgtacgggacacagcaaaagctatattacaggcaagtttatagcaataaattcctaggttgaaaaactaaaaagatttcaaatcatcaacttgagatgcatctccagaaaccagaaaactgagaacaaaccaatccaaagttagtaggaaagaaatgataaagatcagagcagaaatgaacaatattgaaactgaaggaaaaaatacaaaagatcaatgaaataaaaagttggttttggaaaagaaaaacaaaattttaaaaacctttagctacacaatgaaaaaaagagaagactcaaataaatcagaaatgaaaaaggaaacatcacaatgaataccacagaaatacaaaggatcgttagagactataatgaacaactccatgccagtaaatttaaaaacctagaggaaataaattcctgaacacatacaacctatcaagattgaaccaagaagaaatagaaaacctgaataggtcaataacaagtaataagattaaatcagtaataaaaagtttcccaaaaaagaaaagcccagaattggatggcttcactgctgaaatctaccaaacccttgaagaaaattaatgctaatttttcttaaactattccaaaaatttgaagtagaggaaatttttcctaactcattctatgagaccagtgtaactaactagataaggatgcaaccaaaaaatgaaaaaggttatacaggttaatatccttaatgaacatagacacaaaaatcctcaacaaaatacaaaccaaatccaacaacacatcaaaaagataatacaccatgatcaagtaggatttatctcatgaatgcaaggatgattcaacatatgcaaatcaataaatataatacatcacatccatagaatgaaacacaaaagttatgtgattgtctccaaagatggagaaaaagcattcaatacaattcaacatcccatcatgataaaaactctcaattaagatggtatagaaggaaagtaccttaacataataaaggccacatatgataaacccacagctaacatggtactgaatggggaaatctttaaagctttttcactaagaactggaaaaagacaaggatgcccactcttaccattcttattcaacatagtaatggaagccctagccagagcaattggcaaaaaaataaataaagggcatccaaattggaaaggaggaaatcaaattgtctctgtttgcaggcacatgaacttatatgtagaaaaacctaaaggctatatcaaaaaactcttagaactgataagtgaattcagtaaagttgcaggttacaaaatcaacatacaaagatcagtagtgtttctgtacttgaacaatgaactaatgaaaaagaaatcaaaaaggcaatcctacttacaatagttacatttaaaaaaaacctaggaataaacttaaccacagaaatgaaagacctttgtaaggaaaactacaaaacactgatgaaagaagttgaagaggatacaaatggaaagacatctcatgctcatggataagaagaattaacattgttaaaatgaccatactacccaaaacaaactatggattcaatgcaatctctaccaaaataatgatattcttcacagaaatagaaagaatcataaaaatgtacatggaaccacaaaagaccatgaatagccaaggcaatcctcagcgaaaagaacatagttagaggtatcacactgctagacttcaaaatatactacaaagctgtagtaaccaaaacagcatggtactgttataagaatagacacagagaccaatagagcagaagagaacccagaaattaatccacatatctatagccaactgatttttgacaaagatgtgaagaacactcactgaggcaaaacaaaacagtatcttaaataaatggtccccaaaaaatcagatatccatatacagaagaatgaaactagacgctcatctctcatcctatactaaagccaactcaaaatggatcaaagacctaaatgcaaaatctgaaaatataaaactagtacaagaaaacataggagaaatgcttcaggacattggcctgggaaaagattttatgaataagaccccactggcacagactacaaaagcaaaaataaacaaatgggattatatcaaactaaaaagcttctgtacagtaaaggaaacaagaatgagaagacatcttacagaatgagagaaaatatattcaaacttttcatctgacaggaggtcaatatccagaatatgcaaggaactcaaatatcttgacagcaaaaaaaaaaaaccgaacaatccaattttaaaatgggcaaataatctaaacaggcatttctcaaaagaagacatacaagtgaccaaaaaatacatgaaacaagtgttcaacatcatgaatcatcagggaaatgccaatcaaaaccacaatgaggtatcattttaccccagtcaggatggctattatcataaagacaaaaataacaaatgctggcaagaatgcagagaaaagggaacttatgcactgttgatggggatgtaaactagtagagccactatggagaacagtatggaggttcctcaaaacactaaaaatagaactactatagcatccagcaattccactactggacatttatgcaaagggaaggaaatcagtatatcaaagggacatctacacccccatgcttattgcagcactattatatagccaagatatggaatcaacctagggtgtccaacaatagatggatgaacaaagaaaatgtggtatgaatatataggtatatgtgacggaatactattaggctaaggaaaagaataaaatcctgtcatttgtggcaacatggatggaactggaggatattatgctaagtgaaataaggcagataccacatgttgtcactcatatgtggaagctaaaaaatattgatctcatagaagtagaaagtagagcagaggatactagaggttgagaagggtagagagggggagagagttgttaaaggatacaaaattacagatagaagtaagttctagtgctctatagcactgtagaataactctaattaacaataatatatagtttcaaatagctagatggagaatattgaatgttttcaacacaaaaaaagataaatgtttgagatgatagactatgctaattactccaatctgatcactatgcattatatgtatcaaaacatcactatgtaccccataaatatgtacaatttttacatcaattttttaaataaaataaaacaactagaaataaaagacagattgcctatcaaaaaacgactgacagctaacttctatgtaaaaatggacgctacaaggcagtagaagaccatctttcatgtgctctgataaaataacaattagaattctacatgtaatgaaactatctttcaacaagagcaaaattatcatgcaaaagaagtgaaaggaatgtatcactaccctatctttaccaaagaaatgtctacaaaatatattttaggaagaagaaaaattatctcaggatgaaagtttgagatatcaaaaggaatgataaatactgtggtaagtggggcttaatctaaacaatcatggactgtataaagaaaaagcaataatatccactatgaggagttaataagaacccaagtgacttctaactactggaaaataagagcatgcaaattgggaaaggatataaacgtcctctattgttcggaaaaatggtaaagctacttagtagttttagactggtaagaacactcactggggcaaaaaaacagtgtcttaaaataaatgttgctgggaaaactggatatccagatgcagaagaatggcttcttaaaaagccattcttctgcatagctttttaagttgaaattaattaaagtcatgtagaatattaaaatttagtcacctgcattaataaaatttaaaacttatgctcatcaaaagatctattaaagtaaaaagaagccacaattggaagaagatatttgcagcacacaccaacaaagcattagaatcatgaatatataaaagacttctaaaaattgagaaaacaacaaacaatgccatagaaaaatgagcaaaaccatgaacaaacatttcatagaagagaaaatatacatgaccaataagcatacaacagttgctcaatgtcattaataatcatgaaaatgcaaattaattaaaactacagtgagatatcattttaattcactaaactggaaaaaattagactctgaccatgccaggtatgcacaagtgtgtggaacaaagggaatgctaatcgaatgctggtggaagtgtgcattcgcaaaccacattggaaaacgttgtggtgatgcctatggaagttgaactcttacatatttatgacttggcatctccactccaaggaatatattatagactagagaaacaattgtgcaagtgattgaagacactcatcttagcagcattgttcgtagcagcaaaattctggaataatccaggcatgacgtttggctctagaatggaaagagaaagcacattatagtcatatggtagaattatacaaatgaattagctataggctttaacaaggatacaattcaaaaacaatattcctgagaataagcacaggatatctcatgatcccaattatgtaaagtttaaaatcaggcaaaagtaagcattgtattatttagtgattcatgcatatttggttaaatggtaaaaatacatacttgaaaaggaggactaacttttgtggggaaagtagacaacaagaaatgtttaggtgtggaggtactcggtatcaatctcaaagtatactcataatgttttcttctttttactgggtggtgggtacctttattattttagaatacatctttatacttttacatatatgcttatgttgcattttgcaattaaaattttttcaagagtttacagttatataaacatatatactatatttacagccatgaaaaaattgtacatatatatatatatatatatatatatatatatatatacacacaaacacactagtatgtgtgtggatgggagagggagaaagattgattttaaaggaatataaaataaaggtgtatcacgaggtgggactaaatgaacacatttacttgcagaagatgaatttgactttactgtgcttttttggattgtgccgactcataaatctaactgggcttttagtagacaggagacgattgaacattattccatcttatgtattttcaaacagactgtattattttgggtgttgtgtgtctcacccacactgtcaagattctgtaaacctgcaacgtgatccattcggctgcgctctagttattatccaattatcatccattctgcttattaacaggcataaacagacagtatttctgcatggagctgataccctccattatgggtcaccggtcccgttcttaagtaggattgtgaaggaaaaaagcagagaacttcatcttcagtactaatttctctcacttaattccttctgttttactctttctcaagaatgggcatttatcctctactggtgaagaaagggcagagttgtaggagccatctacggtaaatgcaggctttcaaagggtggggggggacggtagagattttaaacgtaataataaaactgaacaaaatttgatctgctgtatgttatcactatgcaattctaaacagtgttagcatgaaaatattcctcccctagaaattattttgttgatctaagagtactgaattgctacagttacttttgcattgtaataatatatctgtaagcttcaaatcagcatattatattctacatggacgttaactcagagaaccaagagttgcacagggactgccagcacactcagtgacacacacacgttttgatcgtataataagtgcctaacagggtggaactgggcacagggcatgtctcagacctgtatggtacttttaaaaaaataagttaaaataaacactggggcatggtgatggaaaagatgaaaaaacagaacgtaagttatttcaatgttgtcactcggtgtggccacttggagtttatatttgcattttactgttgcatttgaaaattgttaaagtgaaagtgacaagtgcaagacacactctttttgtttggtaaatatacatttcagtccacacatgagaatagttattgaatgttagaagtatcttttaaaatgaaatgtatgttttttcctatcttttggttttaaaagtgaaagaaaaagaaattttagaaaatttaaccttatgttacttactagtataatttagtggttgcctaaattgtactgtttgcatacgtttcagttttattaaagatcacttattggctgttgtcagtaaagagaggatgttaaaaatgatgtgttctgagtgtcaaatccataggtgtactctgtgatcctcttttccgatcagttccccgagtgtcagtaggaaatctaaacagctaaggaccaagcacaggaggagatataaccaatggacttttaactgaggggacacggtttgcatattttttttatttttattttttattttttgagacagagtctcactctgtcacccaggctggagtgcagtggtgcaatcttgtctcactgcaatctccgcctcccggattcaagtaattctcctgcctcagcctcctgactagctgggattacaggcttccgccaccacacccagctaatttttgtattttttagtagagatggggtttcaccatcttggccaggctggtctcgaactcctgacctcctgatccacccatctcagcctcccaaagtgctgggattacaggcgtgagccatggtgcctggccggtttgcatatttgtaacggtgtctttagcacctgcccgtcatctttcctaaacttggtctgcttgagaacacaccttgcttgccatgtcgtttataggataattttccatgaatggaattatttgaatctcaaagattttgtcaaaaaatatattcaaagcttgggtgtaatagacattacacctgaaattacatcctttgcggttatctcaatgtactttaaaatgtttagacattatgctaaaaatatgttaaaagggggcgtcattttttcaatttctcttagggatcacacaaggaagaaaagtttttcaagactgctgatgtaaaatagtgttatcagacagtgttcacatttggagggattgttggtagccaagtctccttggtgtttcttgtgaaagaattcttgagaaagaaatatcaggcaattggggtatattccttaaacatatagtagggaatggggctggtgaatcagttctgaatgcctgttttcttctttaaaattccagccaatgatatgaagcccaggtatgtgggggccttttgatgacagtgagggtgagactaaggaagctgacctgccctgcccagggacacaaggctggctagcaacagagccaggacattagtcagtgtgtctggctctgaagcccccatgggggacactgtctcccatctcctttctcctgtgtttagccttgactttcaccttcaatgtcatgccagacaaagagttgctatggggcaagtgggaaaggcaaaactttttctgaactgctctttaatttgtcaatatagcccaaatctagttgcaatctggtacacttttagtcatgaacgagggtggaagaaagctaatatcacatgttgacctttcattttgccaccaagaagctctccttgaatattctgaaggagaacacgttcttgctgggggctggataaaccttaaaaatttcatgcccctgaatgagcatttcccctcatcacggacttgtccctggggctttcttaggcatgggcaggatgtggattgaaggaagaaacccagtgtcatgggcagcaaaggttgaatgtcttctgtgtctagtcctaacactgacttggagcccattcctcatcattttatcttactttctcccatctgaaaatatttacaaaatcatgtttgatgtcaaaatactaaatactatttggggggccgggtgtggtggctcacatctgtaatcctagcaatttgggaggctgaggcgggcagactgccagagctcaggagttcgagaccagcctggacaacacggtgaaaccctctctctactaaaatacaaaaaattagccaggcatggttttgcatgcttgtagtcccagttactcaggaggctgaggcaggagaatcacttgaaccctgaaggcggatgttgcagtgagccaagattgtgccactgcactccagcctgagcgacagagcgagactccatctcaaaataataataatagtatttggaggattttcccagagcatttgggaagcatttgtacacaaatgagtctgtgagcaaagggccaaggcaaggggcaggagctcagatgcaggctgtgttgatggggctcaaatccagagccccatgatccctatcccgtgctccactgcaccatcctattatcctattttgcattttatttttacattcctataaataaaaagtgcaatcaaataacttgaaatatggtattgcttttgtgcttaaaaataatctcagaaatacagcaaacatgccattcacttgaaattctaaaaaagggcaaaactatgttgacagaaaacagatcaatgatttcctggggtgctgggggtagcagtgggtaggaagagaattagctgtgaaagggcacttggaaactttttcagatgagagaactgctgtatcctgatggtgagggtggtttacacagctgtatacggttaccaacactcatcaaactgtgtgcttaaaacactgactatgcaatacctttatgcttatgtctttttataatttaaatagggagaaaaaatatgtattttgtaatatacatattaatacacattataagatatatataaatatcaataaataataccttatttggaaatagggtttttgcagatgtatataattaggcccaccctaaatccaatggctggtttccttataaaaaaaagggagagggggctgggcgcggtggctggcgcgcctaatcccagcactttgggaggccaaggtgggcggatcaccaggtcaggagatggagaccatcctggctaacacagcaaaaccccatctctactaaaaatacaaaaaattagccaggtatggtggcgggcgcctgtagtcccagctacctgggaggctgaggcaggagaatggcgtgaacccaggaggcagagcttgcagtgagccgagatcgcaccactggactccagcctgggtgacagagcgagactccatctcaaacaaaaaaaaaaaaggagagggatatttgagatacacagacacagagttatatattgtacattttacaaagaaaaaaatgtacatatatatgtatacctatatacgtatgacatccctttctattctgtcttccacaaatgtgagtataagtcttcacagtgggaagtaggaatgatcagagatggagtattagtttgccagcactgccgtaacaaggtcccacagaccagatggtttaaacaacaggaatttattatctcacagttctggaggctcagaatccaagatcatggtgggggcagggttggtttcttcggagacttctctccttggcttgtagatggccgccttctcactgagtctccacatcctcttccttctgtgtgtgtctgcatccaaacttcctcttcttgtggggacaccagtcatactggattcaggcataccctgatgacctcattttaacttattttcttctttgaggaccctatctctaaatccagtcacattctgaggtacatgggattaggactccacatatgaatttttggggggacacaattccacccataacagatggagaatagtgcttgaggtctttactaatttactcaccttggctctatttgaggttttctgccaggagcaggtattttataatttaaagtatacatatgggaaaacacacacacatacacatatatatatacacatatacacatatatatacacatatgtgtgtgcatatttcaaacaaggcagagatcatctgtgacccaaatatgtgctgatgagatcaatggactgtgctacttattggtcccataacatatcacttgtaacctctatctatgaccttccacgtcagtgcaataactaatacagccatcatacacagctgtgcaagagttaacattttattcttctgtgactgaacttctgtttcgagtcccccttttctcagagttgcatctcagttggtggggctgggggtgtctgtggtctcaggcagggaaggcaggcagctcttctggacctggccagagtacatggtcatttctccaggatggtctcccttagacagcctcattccctacctggccactcacatgtgttattgctgcaccctctgtcctgaccctcaggcttcttaagtttgactctgaagccgcactctctgggtttgaatcccagctctactcactatgggctctgtaccttggccacttcactttactttacttctttgtgctttgattacctcatctataaattagagctattcataatagtatctacttcatgtggctgttgggaggattaaatgagttagtatgtgaaaacatttgaaagcgtgtctgccccatagtaaaagctgtatactgtaagtgattcccattattagtagtagtagtagtattgttactgtgatgtcacatgcctcattggtgttttattttggggagcacataaagtactccatttgcctctcttagctgcaagagagaaattctcctgggttgtctcgggtccatgtgctggacccatatttctgctcctgcatcatgctgggaatacagattgtggagctggggtgcagggaggtgtatgactttgccagcttcctgtatttcccttgagaagtggagcggtgctaattgtccctgtcccggatgttccatcaactgtgtggtcccataccaacccctcaggggtgtctgcccaacccccaccccagctttctttccttctttacttagcatctactcctcaggagactgctttgcccagtatgccctaagataataaatgaccttctgagagtcaaatgccaggactcactcttggtctgtttgtcctcacccggctgctcccttgggggtaggccaggacacacactgggtgagaagcgtggtggaggaaaattatctgagttaatttatcaaaatacattattccccagtgacactagggaaaccttacagaggccccgccagcatcaaagagcaaggttctgtttcccatgttccgttacccgatccccagggcctgaaacagagtccagggaatatttggaaactaatcgtcatgagtggtagcatcctaagcagtaccattgtttacctcctaagatcccccaataattgtggttggctatttgttttctagtcatttagacacacacacaaaaattgtttttcaaatgagaaggggaatccacaacaaaaaactgtggctagcttattttcgagtttgaatgctttgtgtaaattaataaagttgaagtctatcccatgtgtataaaaatcttggagttatgttcattaatgagtctattgaattagttttcataaattcttctgattcaattgcatattcttaaattaacaacaaaagtccaacttgtatcattaaagactcaaaacagatggtgggaacagtaaagtgtaggaaagtgggaaaaatccttaaaaaataaacggttctttaaaataaatgaataccaaataaaacagaaaagtataaagagctatagttctttttttttttttttttttttaactgagacagagtctcgctctgtcacccaggatggagtgcagtggtgcgatctcagctcactgcaacctccgcttcccgggttgaagcgattttcctgtctcagcctcctgagtagctgggattacagatgcatgccaccacgcccagttaatttttgtatttttagtagagacggggttttgccatgttggccaggctggtcttgaactcctgacctcaggtgatctgcccacctcggcctcccaaagtgctgggattacaggcatgagccactgcacccggccgggagccatagttcttggtggaaagcaaagcttttcacatcagctagtgtagtgtctgaaaaagtcctcattatagatgggacaaaaagatttagtgggaagaagaaagagaacattgagacagttatgaaaagttttaattgtaaattttaattctcatgtgaaatgaaaattttgggatactttcacacacacacacacaaatgttatcctcagattaaaatatttatgtgggaaatgtttagaggtaaaatgtttagaggggaaaaaaccacttaccatgattgctgccagaaagggtaaaccttagaatcataatactgcagaatttaatgatcctttgtgagcttctggttcaacactcgttttacaagcaaagaaatggaggctcagagagattggttaggtgagccctgcaaggactcatggctaaatagtggtgaaatcagaagctaaagccaggttttctggcttttattccaggactgagatgtagtgacctgactctcgtaagtttctggcttcttccttttggagccacaggtaagcaccagtctagaaccttccactcagacttcatgctccagggttgtgaccagagcttacaagggtgttgtcctgggctggaagcagagactgtgaaactcaaatatacttaggcaaatgcaagcatatgaataaatcaccgaaatcaggacaaacagcttttcttagataaattgcccttggaaagaaaggtgaaaactaagccataatgcatgaatgtgttaattgtttttctcttctacagacactaatttattctgaagggaatgcttcatttccaaattctccttctactttaaagaaattcaaacttcaagaaaaaaattcaacaccatattgtgattgcttcaatagttaagaatttcggctgtcacgactgaaaaaaatcattagcaaaaactggccgtggaaaagggaagtctgtctagttcatgacaagcatccatcatcgtatgtgagttagtaatttctcacctctcatttgagagaggcaaggtacctgtgtgccattggggtgggctttccccgcagtgacagatccggatagatcaccagcctggctaagctccaagccttaaattcctttacttctcacccctgggccatttccgccacttttcctccatctcctttatccatttaacatctgttacatatatgtatatacacacacactttaagttctagggtacacatgcacaacgtgcaggtttgttacataggtttatatgtgccatgttggtttgctgcacccatcaactcgtcatttacattagttatttctcttaatactatctctcccctaggcctccaccccctgacaggccctggtgtgtgatgttcccctctctgtgtccttctgttctcattgttcaactcccacttatgagtgagaacatgcggtgtttcgttttctgtccttgtgatagtttgctgagaatgttagtttccagcttcatccatgtccctgcaaagggaatgaactcatccttttttatggctgcatagtattccatggtgtatatgtgccacattttctttatccagtctattattgacgtttaacatcttttatttatttttatgttttactttttgagacagggtctctgtcacccagactggagtacagtggtgcaatctcggctcactgtagcctctgtctcctaggttcaagtgattcttgtgcctcagcctctccagaggagactttgacaaatatatatatacacatacatacacaaatatatatatatatatttgtcacaaggatttgaccttatgcaattatgtttgctggttaagcagcctctgtgaggctgttgtctttacatctgaccatgagatgttggagcttgaagtccaagaggcaggtggtcagcagaggaagatggatatgaagtcgggagagcagggatgggctgggacccacaggcacacacagaacccatgaagacccaccggaactcaggtcagttatcgctgcctctctgggtgctatagttgtcctacaggatatgccggctcccatcatcacagacatacacacgcacctggcccaagagtcacagaagctgaaggaaaattcagggaaggtagagcagttgtgacttggctactgccccacccagcaacatgagccacagataaaacaggtgtgagctacagaatggctgccgcttccctgcctcctctgaatctcacatgtaagcatctcttgtggcccactctaacaagaaacattcaggaaaggagatctgggggagggggagcctctccaagctgacactttgcaagccacccagtctacaatgtggagaatggttgcaaagccttccacacttcttcctgccaatcctcaccctggtctccagggtcaagtgtgcactttctggggatgcagcctctccaccccacacacaagttgtaccgggaaaaactgagatttccagcaggcagagattgagaagcagcagctaataacattacaaggccatttggcagcagcgcaaaccttcaccattacaattagagcaagtggaggtaaaagagactctcttaatggccaaatcaaataaaaagtgacaggcttctgaagattatgttgaaccctgtatggcatgttaatgaaacaaagggtcagataccatttcatctgtggcttatctgcttagatagaagggatgtttttctgcctagtcctacctgaggatttccaagccacccctatgcatgaagatctgacacatttttgtccgcacttttctcagagtgttggggaaccaggactgagccagcagcgaaatattctgtgatgtaaggtggaatttagaataaaggtattttggtgatcaagcagctcaatggtccttaaccttgactgtaaccttgactgaatcacatgcaaagctttatagcctttctgatgtccaagctgcccagagatttttagggtgcacccaaggcatcaccagttagtaacgcatcccaggtgattccaaggtacaaccagagtctagaaccagggatctagtctaatccttttttcagataatgaagctaagtcatagagaagttaggtgtgttggccagtagtaaatacaaacagtagaacccaagtctcccaactcttaaacttatcaccttccactatatgccctgccatatctgctattgagaagagtgagaaacacacattaaaactgcatactctactgtgttccaagaatgggatgactttgaaatgcatgctatttgtagaatataggtagtgagactgatgcctggtcattcgcctacagccttaacacctcctggaagtctgattctttcagtttaccttgcccatagtgtgagacagagaaggaaaatagacgagtctcagaatgcattgttcagtggaatgcattttggaatgatcctacaaattacaggaaagctttaatcgccaataattaggtgtcttaaaaatggagttgtcttctggcgtatgctgacattatcagtccaagatagacttgagccaggagcctctgtgacagtatgctttagaaagagtgagagagggagcatgtgtaagctaagaaaacctttgtaaataagcaaagtcttattcaacctacagtctgtcctcagagctatcatttatcaggggaacccacccctgataattcaacatgagtccttttctattttccgtaagcgtcggccggtctgagaaacaaagggaaagagtacaaagagataaatttttaaagctgggtgtccgggggagacatcacatgtcggcaggttctgtgatgccccctaagccacaaaaccagcaggtttttactagtgattttcaaaaggggagggagtgtacaaatatggtgtgggtcacagagatcacatgcttcacaaggtaataaaatatgacaaggcaaatggaggtggggcgagatcacaggcccggggcgaaattaaaattgctaatgaagtttcaggcacgctttgtcattgataacatcttatcaaccgtaaaagacagacattcctagagcggccattttagagacctcccactaagaatgcactctctttctcagggatgttccttgctgagaaaaagacttcagcaatatttctcctatttgctcttgaaagaagagaaagatggctctgttccgcctggctctcaggctaccagacctaatggttatctcccttgttccttgaacattgctgttatcctgttcttttttcaaggtgcccagatttcctattgtttaaacaatttgtgcagttaacgcaatcattacagggtcctgaggtgacatacatcctcagcttacgaagatgacaggattaagagattaaagtaaagacaggcgtaagaaatcacaagaatattgattggggaagtgataagtgtccatgaaatcttcacagtttatgttcagagattgcagtaaagacaggcataagaaattataaaagtattaatttggggaactaattagcgtccatgaaatcttcacaatttatgttctgccatggcttcaaccggtccctccgtttggggtccctgacttcctgcaacaataattatttattttaaaagaaacaaaatcaaattattagacatttcaatctgtggtagtaacatgatattctggcatctactttcattatcacctttattaaaataaatttaaagaaaaatggcagtatgtttctgtgaagaccacgagtactcattttaaaggactcaagagttgcagaaaagtaaaaagaaaagagtaaaatcattttctaaatctcaccttccagaaataacgatgttgagcattaagtggacttcatttcatactctttcaaagattatgtaggcatatatatgtgtgtgtatatacatatatatggatacatccttagagaagttggctggctagatagacacactataaaaatggaatcatactctaatgccatttttaatttaaaaaatacatattcagatccactgtacttatatacagaagtaaatgaaactaaagtaacacgagaggaattctgaccctcatataattttttttactatccaacataattattttttttattatactttaagttttagggtacatgtgcacaacatgcaggtttgttacatatgtatacatgtgccatgttggtgtgctgcacccattaactcgtcatttaacattaggtatatctcctaatgctatccctccccttccccccaccccacaacaggccccggtgtgtgatgttccccgtcctgtgtccatgtgttctcattgttcaattcccacctatgagtgagaacatgtggtgtttggtttttttcccttgcgatagtttgctgagaatgatggtttccagcttcatccatgtccctacaaaggacatgaactcatccttttttatggctgcatagtattccatggtgtatatgtgccacattttcttaatccagtctatcattgttggacatttggcttggttccaagtctttgctattgtgaatagtgccgcaataaacatacgtgagcatgtgtctttatggcagcatgatttataatcctttgggtatatacccagtaatgggatggctgggtcaaatgatatttccagttctagatccctgaggaatcgccacaccaacttccacaatggttgaactagtttacagtcccaccaacagtgtaaaagcattcctatttctccacatcctctccagcacctgttgtttcctgactttttaatgattttcattctaactggtgtgagatggatggtatctcattgtggttttgatttgcatttctctgatggccagtgatgatgagcatttttcccatgtgttttttggctgcataaatgtcttcttttgagaagtgtctgttcatatccttcacccactttttgatggggttgtttgtttttttcctgtaaatttgttggagttcattgtagattctggatattagccctagccctttgtcagatgagtaggttgcaaaaattttcttccattctgtaggttgcctgttcactctgatggtggtttcttttgctgtgcagaagctctttagtctgattagatcccatttgtcaattttggcttttgttgccattgcttttggtgttttagacatgaagtccttgcccacgcctatgtcctgaatggtattgcctaggttttcttgtagggtttttatggttttaggtctaacatgtaagtctttaatccatcttgaattaatttttgtataaggtgtaaggaagggatccagtttcagctttctacatatgtctagccagttttcccaacaccatttattaaatagggaatcctttccccatttcttctttttgtcaggtttgtcaaagatcagatagttgtagatgtgcggcattatttctaagagctctgtccttttccattggtctatatctctgttttggtaccagtaccatgctgttttggttactgtggccttgtagtatagttagaagtcaggtagcatgatgcctccagctttgttcttttggcttaggattgacttggcaatgcgggctctttttttggttccatatgaaccttaaagtagttttttccaattctgtgaagaaagtcattggtagcttgatggggatggcattgaatctataaattaccttgggcataaattaccttggccattttcacgatatcgattcttcctagccttgagcatggaatgttcttccatttgtatcctcttttatttcatttagtagtggtttgtagttctccttggagaggtccttcacatcccttgtaagttggattcctaggtattttattctctttgaagcaattgtgaatgggagttcactcatgatttggctctctgtttgtctgttattggtgtataagaatgcttgtgatttttgcacattgattttgtatcctgagactttgctgaagttgcttatcagcttaaggagattttgggctgagacgatggggttttctagatatacaatcatgtcatctgcaaacagggacaatttgacttcctcttttcctaattgaataccctttatttccttctcctgcctgattgccctggccagaacttccaacactatgttgaataggagtggtgagagagggcatccctgtcttgtgcccgtttccaaagggaatgcttccagtttttgtccattcagtatgatattggctgtgggtttgtcatacatagctcttattattttgagatacatcccatcaatacctaatttattgagagttttttagcatgaagcgttgttgaattttgtcaaaggccttttctacatcttttgagataatcatgtggtttttgtctttggttctgtttatatgctggattacgtttattgattttcgtatgttgaaccagccttgcatcccagggatgaagcccacttgattatggtggataagctttttgatgtgctgctggattcggtttgccagtattttaccgagaatttttgcatcggtgttcatcaaggatattggtctaatattctctttttatgtggtgtctctgccaggctttggtatcaggatgacgctggcctcataaaatgagttagggaggattccctctttttctattgattggaatagtttcagaaggaatggtaccagctcctccttgtacctctggtagaattcggctgtgaatccatctggtcctggactttttttggttggtaagctattaattattgcctcaatttgagagcctgttattggtctattcagagattcaacttcttcctggtttagtcttgggagagtgtatgtgttgaggaatttatccatttcttcttgattttctagtttatttgcatagaggtgtttatagtattctctgatggtagtttgtatttctgtgggatcagtggtgatatcccctttatcattttttattacatctatttgattcttctctcttttcttctttattagtcttgctagtggtctatcaattttgttgatcttttcaaaaaaccagctcctggattcattgattttttgaagagttttttgtgtctctatttccttcagttctgttctgatcttagtcatttcttgccttctgctagcttttgaatgtgtttgctcttgcttctctagttcttttaattgtgatgttagggtgtcaattttagacctttcatgctttctcttgtgggcatttagtgctataaatttccctctacacactgctttgaatgtgtcccagagattctggtatgttgtgtttttgttcttgttggtttcaaaaaacatctttatttctcccttcatttcgttatgtacccagtagccattcagcagcaggttgttcagtttccatgtagttgagcggttttgagtgaatttcttaatcctgagttctagtttgattgcactgtggtgtgagagacagtttgttataatttctattcttttacatttgctgaggagtgctttacttccaactatgtggtcaattttggaataggtgtggtgtggtgctgaaaagaatgtatattctgttgatttggggtggagagttctgtagatgtctattaggtccgcttggtgcagacctgagttcaattcctggatatccttgttaactttctgtctcgttgatctgtctaatgttgacagtggggtgttaaagtctcccaagtctctttgtaggtcactaagggcttgctttatgaatctgggtgctcctgtattgggtgcatatatatttaggatagttagttcttcttgttgtattgatcccctttaccattatgtaatggccttctttgtctcttttgatctttgttgatttaaagtctgttttatctgagactaggattgcaacccctgcctttttttgttttccatttgcttggtagatcttcctccatccctttattttgagcctatgtgtgtctctgcacgtgagatgggtttcctgaatacagcacactgctgggtcttgactctatccaatttgccagtctgtgtcttttaattagagcatttggcccatttacatttaaggttagtattgttatgtgtgaatttgatcctgtccttatgatgttagctggttattttgctcgttagttgatgcagtttcttcctagcatcaatggtctttacaatttggcatgtttttgcagtggctggtaccagttgttcctttccatgtttagtgcttccttcaggagctcttttagggcaggcctggtggtgacaaaatctctcagcatttgcttgtctgtaaagtattttatttctccttcacttatgaagcttagtttgaaatgaatgaaatgaagcatgaagagaagtttagagaaaaaagaataaaaagaaacaaacaaagcctccaagaaatatgggactatgtgtaaagcccaaatctacatctaattgatgtacctgaaagtgactgggagaatggaaccaagttggaaaacactctgcaggatattatccaagagaacttccccaatctagcaaggcaggccaacattcaaattcaggcaatacagagaatgccacaaagatactcctcaagaagagcaactccaagacacatcattgtctgattcaccgaagttgaaatgaaggaaaaaatgttaaggcagccagagagaaaggtcgggttacccacaaagggaagcccatcagactaacagctgatctcttggcagaaactctctaagccagaagagagtgggggccaatattcaacattcttaaagaaaagaattttcaacatactgattttttacagatgccttatcaaaagagattatgaaagctattggaattgtaatacttttattaattaatggttcacttttatatagtatcagtgaacttcgagcaatgaaagaagatgattttaatgcttccttcatttctctatcacccacctcctgatttttatagatcattatcattcattcattcaaccagtgtttatttagagaatactttgtgtaaggcaccttcaaggtgctgagcctagagctataagctatcgatggaacagacaagattctcacacataatggggcttgcattttaatagaaagaaaaaataaatcactattttgacattgcgctgattctgttcagtaaccataagcctcataattgttcagtattgtttctatatttgaattctttctatgcatatacataagtagaagtctggcagactagagagatagccagactcacttttataaaaatgggatgatactataaattcacttccgtcgctgacagcccatcctccacctaccttcttatctctgatcctccctagcagccctatccaggtttccctggttagaaggagaagctcggtcttttccagattcacagggaaaggttcccaagcaggaggagtgaggaggagccaggtggcagggccaggccaggccaagcctttctccactgcttctctgcagaatttccttggctgctggttttggaagtgtgtgacattaggttatgtccatttccttggttggtggctgctgataaaaattttgactggtttcactattttgatgctataattcttcatttttttttaggcattgctaagttagataaatcttatgttcagtcttttctatcttatctttaccccaagtctacctccttaaaatacttttatgagcacaaatccctgatgtaaaatcaagccataatgtgtttcctggagtaggggcggacaaatatgttaactaaattctttttgcgtgcttcatgttggatcaattcttaaggaataattttgactgagcctcttttaagcttttccaggcctggcttgttttcctgaaaagcttcaaagcagagaggagaatctttgtcagttagctgggtgagtggttcacaagcctcactgttgtgacacactccgtcatttgtgagggcatcacagccattttgttaatagaaatacagagccaaaagtcaaacatgattttatatgtgtgagatgttgcccgagggaaagggcaaagaatgagaagagctggactgggcaactctcatgtgaccccaggtccctttcaaagttgagtttctctagcaagtttgggatttccaaatgtttctactgagaaaaaaaaaaaaaggaaacgtgcaattaaattagaaaactacacagctcttactgaagagctgaaattttaaaaagatgcttaaaataaagcaaggaagataaggagaaagaaacataaagcatccaaacctgaaagaataacattcagataggctaacactcagaaaagattggagtcttgccaaacatcctgaggtcagccgccaccacagcaaaaagactgtttgatttggagtgacaagaaagatgatgtgatctcagaggaaacagatggctcactaaagatatttgaggatattttaataaaaagaagattttaaaaggtgtgagtaggatacagggaaagtgacaaaagatggagcaagttggaacctgatgggagtaatctggggggaaggaacccatagcagaagtggtggctctcaatggtggagcccagccaatccgtgggatcgggcaggaagggagctgacccactgtctgctccacgacctcctggtgctgcctccccttggctgaacccagccagaaggcaaagagagacccattggtccattccgtccaagatctctctcagggctcagagcagcgtacagaaaggtagtgtttctggaggaacaaatagaagatatccagcagtaagggcaaggaggcacagaagtacttcctgcttcaaggggttgagtggctatggtagttgatgttgagaaggcagatgaagtaaaagcaacttcgcatatatctttcctatcaaagacaatggtctaactggaaagaaaacaataaacagggttgtgactaaaaactgggcaaatgatctaaacagacatttctcaaaagtaaacatacaaatggccaagaggtatatgaaaaaaatgttcaacatcaccatcatcagggaaatgcaaataaaaaccacagtgagatattatctcaccccagttagaacggctatgatcaaaaagacaaaaaataacaaatgctgacaaggatgcaaaaaaaacccacttatactgtgttggtaggaacgtaagttagtacagccactatggagaatagtatggcggttcctccaaaaaactaaaatagaactaccatacaacccagcaatcctactactaggtttctgtattgttttgttttatattttttgtttttttggttttttttttttttttttttttttgagaaggagtcttgctctgttgcctagtctagagtgcaatggcatgatcttggctcactgcaacctccatctcctgggttcaagtgattctcctgcctcaacctccccagtagctgggattacaggtgtgtgccaccacacccagctaatctttttagttgagatggggtttcgccatgttagccaggctggtcttgaacccctgatctcaagtcatctgcccactttggcctcccaaagtgctaggattacagataagagctaccatgcccagccccattactaggcatttatccaaaggaaaggaaaccagcatatcagaggaatacctgcaccccatgtttatcacagcactattcacaatcgctaagatattgaatcaacctaagtgtccatcgacagatgaatggataaagaaagtgtggtatatttatacaatggaatactattcagccatttaaaaataaaactctgtcattcatggcaacatggatgagcctggaggacattacgttaagtgaagtaacccaggcacagaaagacaaataccatatgatctcattcacatacagaagctgaaaaacagttgatctcatagaagtagagagtacaattgtagttattagaaactgagaagggtaggaggggaggagatggagaggttggttcaaggttacaaaattatagccagatcagaggaatatgttctagtgttctatagcactgttgggtgactacagttaaaaatttttgtatattttcaaatagctagaatagaagattttgaatgttcccaacgtaaagaattgaaaactctttgaggtgatggatgtgttaattaccgtgatttatcattacacattgtatctatcaaaataccactctataccctataaagatgtataattattatgttcaattaaaaataatgtaaggaataaacaatattgaaagcaaaagaaaaaatcccaaagtggtcaaagcaataagccaatacttaactcctttaagcccatctgcaggcctaaatgaatcttacctgagagtgctgaaagaaaattatgtttaatttccagaaagggtcaaaagagtacattattgaacctgtaataaagttactgaaattaaaaggaatgttaaagatctcaggtttcttgatttcaggaagctatttgatggagcctttcaaagtttggttggtaatgaatatgctggagaaacaccggccatacaagaaggtttccctgacctgggatggacagtcatgcacagtgtttactagtgttgctcgcatggcatgaggaggaaagggcacaggacccttctttttgacccactcctattcaagtttctatgaaggtcttgaatgaagataggaggtgtaggtcaaagtcgtggttatgactgtttcaaagtcagaaaggagaatcggttctgtggatcttacaagctcctttaagatgcctcaggctatgaagctgtgggagagctggaaattctggatggatgggataatatttcctgaagcttgagggaaggtgtttgctgaagtttgtccaatgtgctctgtatgaagccagaacccaatgtcccatctgccttgttccagcactgcctcggattccagatcctgagaaccaccctttaccccagggaaacccctgatgccaccttctctgctgccaaccattatgtggtgtgagctgtccccaggttgcaagtctctgccagcagccctgcatgcttcaagactctctgtgtggccccacagggcaagcacaacaaagaggtcaaatgacagaatttcaaaagatttcaactgatgaaccaaattaaaggacatgttaggtattggaattttccaatttacagagctagtttgtcctagcattggccagaatgaaggctgaaagagtggcagggctgccaccatggttactgcagcaggtggaattcgagtgcctgaattgagggaagtgggggtcctcctgcatcccgagatagcgagagcacctcagaagtgctggcttaggtggtggcacccactgtaagagaacgatgacaaatctcagtttctccctaggagagtgcccagcagggtgatgagccaggaagatctgtcaggatgaagagtagtgagaggaagggggaaccctggagaagagaagaacttaaagggattcacaagaagttgaggagggcagagctgaatgagacaaggttgcagggaaacagactttttaagatcagtgtaagggaaaaaaaaatccttgacaatcagaattgtttcaaaacagagtcagcagcttcttgagactgggtcgctgtgctaagaacgtaaagggggagctgggtggcaccagcaaagtggcaggaatgtgtccctgcagggtctttgctgccttccgaatcctctcctttgtgatcctgtaatttgtgagagagcctggagggtagcatggaaaagagagaggagaggacctgacagcagtatttccatcttgtcccctaacaattgcctaggcagtctcctctcagcagggaagcaaactggtcaccaaataataataattatccccctacatttccttaattatttaaacttctgaaaggacatcaaacacagcaaagagtcaatgacttgctttcagaagtgattcagactgtagctccacccataacagtgtcaccttgagcagtcacatatgccttaacatccttctttctaaagcaattccatcttcccaggttgattgttgagcgtttagacatgatgacatatataatctttatatatgtatatttacaagtatatgtttatggataaattttgactgcctgtaacccatgtggccttgtgtcatcacacataagttcactgaagctcccaacaaccagacttttggggaagtacaaacctccacattagcactaggtctccttgcctgcccctctgctggaagaatccctggcaggggccttctttggtgatgggattgaattttctatttcctgaaatgtaatcagctttcagtttcaatggtggtcacccccttgtaccttcttttaaagattggaacgctgtattggtttctcagggctgctgtggtcttcatagaagatgacccgcgtatttccaaggtttcctccaggattgctggggctgtctgcgtccagatgttaaggttactgtagacaataaatgggagagggtgaaggaaggaggatgtttagagaaaattatccagtcacctggaggaaaggctcttagctgcaaaagaggaaataagggccaggcacagtggctcatgcctgtaatcccagcactttgggaggccgaggcaggcagatcatgaggtcaggagatcaagaccatcctggccaacatagtgaaacccatctctactaaaaatacaaaaatcagccgggcgcagtggcacacgcctgtagtcccagctacttgggaggctgaggcaggagaattgcttgaacccgggaggcagaggttgcagtgagatgagatcgtgccactgcactgcagcctggtgacagagtgagactccatctcaaaaaaaaaaataagaaactgctatttagcacaacatcaaataagcagtttgttgcttatgtctgaacacttctgtgaaaacaggcaaaggcagtcgtgtgtaggttctggtgaccaggaactggagctgcacagaggtgtagaggctcccaaagctcgtcaattgtttatgaagggagtaaaggctggaagtcagggggtgggtgtcagtttctgccactagctaccagatttctcctaaagatgggaaagctccctttatagagctggagtgcaattttgtgttttctttgtgtttggcaatgtctgttactgacttgcaatagatatgcaacagtataggtatgttcatcttagtattttggggacaaaactcccaaaccagccaccacacaaatgtatttataggtaccagtaggcacctttggactcggagggaagtcagcctccttaaagccgtattcagtaaggagaatgaagggtaggcatggctgcagcttgggttgtgcccaccatgtggatatccagccatgatctcaatagtcaggttggtccacattgtccagatatctccatgtaacattaactcagactttatgaaaataaccggtgagaataaccaaagccacattgggtaatgaaaactgtatgtacaattttctttagttacattgatgttgttacatactgttcataattaattacattggtttgtaatgtatcatgtcctattgtattgtaggttctaataccaagaccctaggtgttcctctcttaaaagctggtgaccacctttaactcatgtggtaaaagaatgatagttctgggaggatctgcattctctctgtgtccatgcagcattgccccacactgcctgtgctgagctgcatgatcctcatagctacatcatagtctttgcttgtaggcttgtcgtttggagaaccgtcttggagtctttattggttgatgtcaatggaaagctctgcttccctctggatgtcctatggtattgctgttcctaatgtctttctaatgagtgctacgtgtctgtatgtgtgtataaagagatttatgtaaagaattggctcatgtgattacggaggctgagaaaccccaagatctgcatttgccactaagtactcagatatttggtcaaacatgattgtgagtgctgttgagtgctgtattttttaactgccacgtaatcccctcaaggtccgtgttattctagacagtaaaccgggagaggcttctaaagccccctttgtcaggaaatgttactttagaatctgaccttgtgtgaaacacagatgacagaacctctctagtgcaatgacattaaaatcctcccccagtacttgaagtgcaagggaaatagctcattgctattatggctggatcatctcatggcctctcaacagatcaagagcaccattactactgttgctttcttgacttgtgttttacttttattctaacatttgttgcagtctgtgttaaatagggaggtagaccaaactatgagaaggagccctatattggaaactgtatagccaactatgaaacctccaggcttactttgctttctcattacaggcggccttcccctctgctccactggagagagtcagagtaattggctcttgctttatatgaaggatatgctcccaaaaaagttgtatttaaatcaagttttaacaaaccgactcatgcttgtttatccacttataacacttactatttaaaggaaatgataaagagtccttttctgttgttacagcgtagttggcaaagctgtatcttctgaagactgacttgcactcagcagttttagatcaactcgagtctgtttatactaagatccacagacccctggtggttctcagatgacttgcaaattctactagtttttccaattgtgtgttttttgatgataacttaaaaattttttatgataatcttttcattgtttagtataataatgtacagataaaccctagatgatcaccttataactgagtgctgtcatgagatttcagtgcctttgttctcagtcctgtaggtaaccaagacttcatctaaaatcacatcacttgactttaaatgtttgcaagacacatctgactgtcattgggttgataaaatctgtcttgtcctcattttgtgttgtgtgggactctatcatcaggtacaaaagcaaaactcctttgccatgagcgttcacagttgaatgacttttttatagaccaagagtttagtttcttagagtatatattgaatcaatttggcatcatggaaatggcatagtacattagaggcacatactatgttaactgtcacaatctaatgataaagaacagaaaaggacatattacataatcggtgcatttctgttaaagtcatggcaagcttattgaactagttttatagcaatttggcaggataaaaatgatgggaggatggagtcatcatagggtgcctgccctgtagcatggacacctgggacacaccttgctggatgatgtcttctttgggttccatcttaatacatgacaactggaaataattctgtagcagaaagtagagtgtaaaatagaaaatgactcttattctgatgaatcaaagtttttaagccatatatgtcggagtacacttgaattacttctgtaaaaactagcacattatataaaaatcataataaaaacagagattccagtgaggggtccctcttgttcagagtcgaaagattcaagtcaacaaaaatggaacctgtaagttagtctttttgccactgttaaaagaaaaacactggacacaatacttttaacagagtttatgtgagcattagaggattcatgaattgggcagcacccagaaccagaaaaggttcagagagctctacccagcagcatgggtagtgagctttaataggcggaacgtggaagtaagacaaagaaaacatatttgatttgttagagtagaaagtccctagttagaggttagttggaggtttctgatggtaacttctctagtttcattttactgttcacattgggctttggtttgcttacctaggaacttaaagtgctgggaatgcttcggcttaatgacctcccaattaaaatttttttaacatcacttttatttatgatctacaaagtggcaactgcctatttttttttaattttattattattatactttaagttttagggtacatgtgcacaatgtgcaggtttgttacatatgtatacatggccatgttggtgtgctgcacccattaactcatcatttagcattaggtatatctctcagtgctatccctcccctctcccccaaccccacaacagtcctcggtgtgtgatgttccccttcctgtgtccatgtgttctcattgttcagttcccacctgtgagtgagaacatgcagcgtttggttttttgttcttgcaatagtttgctgagaatgatggtttccagcttcatccatgtccctacaaagcacatgaactcatccttttttatggctgcatagtattccatgttgtatatgtgccacattttcttaatccagtctatcattgttggacatttggcttggttccaagtctttgctattgtgaatagtgccgcaataaacatacatgtgcatgtgtctttatagcagcatgatttataatcctttgagtatatacccagtaatgggatggctgggtcaaatggtatttctagttctacatccctgaggaatcgccacaccaacttccacaatggttgaactagtttacagtcccaccaacagtgtaaaagtgttcctatttctccacatcctctccagcacctgttgtttcctgactttttaatgattgccattctaactggtgtgggatggatggtatctcattgtggttttgatttgcatttctctgatggccagtgatgatgagcattttttcatgtgttctttggctgcataaatgtcttcttttgagaagtgtctgttcatatcctttgcccacttgttgatggggttgtttgtttttttcttgtaaatttgttggagttcattgtagattctggatattagccctttgtcagatgaataggttgcaaacattttctcccattctgtaggttgcctgttcactctgatggtggtttcttttgctgtgcagaagctctttagtttaattagatcccatttgtcaattttggcttttgttgccattgcttttggtgttttagacatgaagtccttgcccacgcctatgtcctgaatggtattgcctaggttttcttgtagggtttttatggttttaggtctaacatgtaagtctttaatccatcttgaattaatttttgtataaggtgtaaaggagggatccagtttcagctttctacatatggctagccagttttcccagcaccatttattaaatagggaatcctttccccatttcttctttttgtcaggtttgtcaaagatcagatagttgtagatatgcagcattatttctgagggctctgttctgttccattggtctatatctctgttttggtaccagtaccatgctgttttggttactgtagccttgtagtatagtttgaagtcaggtagcgtgatgcctccagctttgttcttttggcttaggattgacttggtaatgcgggctcttttttggttccatatgaactttaaagtagtttttttccaattctgtgaagaaagtcattggtagcttgatggggttggcattgaatctataaatcaccttgggcggtatggccattttcacgatattgattcttcctacccatgagcatggaatgttcttgcatttgtttgtatcctcttttatttcattgagtagtggtttgtagttctccttgaagaggtcattcatatcccttgtcagttggattcctaggtattttattctctttgaagcaattgtgaatgggagttcactcatgatttggctgtttgtctgttattggtgtataagaatgcttgtgatttttgcacattgagtttgtatcctgagactttgctgaagttgcttatcagcttaaggagatttggagctgagatgatggggttttctagatatacaatcatgtcatctgcaaacagggacaatttgacttcctcttttcctaaatgaataccctttatttccttctcctgcctgattgccctggccagaacttccaacactatgttgaataggagtggtgagagagggcatccctgtcttgtgccagttttcaaaggtaatgcttccagtttttgtccattcagtatgatattggctgtgggtttgtcatagatagctcttattattttgagatacatcccatcaatacctaatttattgaaagtttttagcatgaagcgttgttgaattttgtcaaaggccttttctgcatctattgagattatcatgcggtttttgtctttggttctgtttatatgctggattacgtttattgattttcgtatgttgaaccagccttgcctcccagggatgaagcccacctgatcatggtggataagctttttgatgtgttgctggattcggtttgccagtattttaccgagaatttttgcatcagtgttcatcaaggatattggtctaaaattctctttttatgtggtgtctctgccaggctttggtatcaggatgacgctggcctcataaaatgagttaggaaggattccgtctttttctattgactggaatggtttcagaaggaatggtaccagctcctccttgtacctctggtagaattcggctgtgaatccatctggtcctggactttttttggttggtaagctattaattattgcctcaatttgagagcctgttattggtctattcagagattcaacttcttcctggtttagtcttgggagggtgtatgtgtccaggaatttatccatttcttctagattttctatttatttgcatagaggcgtttatagtattctctgatggtagtttgtatttctgtgggatcagtggtgatatcccctttgtcattttttattgcgtctatttgattcttctctcttttcttctttattagtcttggtagcagtctatccattttgttgatcttttcaaaaaaccagctcctggattcatttatttttttgaagggttttttgtgtctctatctccttcagttctcctctgatcttagttatttcttgccttctgctagcttttgaatgtgtttgctcttgcttctctagttcttttaattgtgatgttagggtgtcaattttagacctttcgtgctttctcttgtgggcatttagtgctataaatttccctctacacactgctttgaatgtgtcccagagattctggtatgttgtgtctttgttctctttggtttcaaagaacatctttatgtctgccttcattttgttatgtacccagtagtcattcaggagcaggttgttcagtttccatgtagttgagcagttttgagtgagtttcttaatcctgagttctagtttgattgcactgtggtgtgagagacagtttgttataatttctattcttttacatttgctgaggagtgctttacttccaactatgtggtcaattttgaaataggtgtggtgtggtgctgaaaagaatgtatattctgttgatttggggtggagagttctgtagatgtctattaggtccgcttggtgcagacctgagttcaattcctggatatccttgttaactttctgtctcgttgatctgtctaatgttgacagtggggtgttaaagtctcccattattattgtgtgggagtctaagtctctttgtaggtcactaagggcttgctttatgaatctgggtgctcctgtattaggtgcatatatatttaggatagttagttcttcttgttgaattgatccctttagcattatgtaatagccttctttgtctcttttgatctttgttggtttaaagtctgttttatcagagactaggattgcaacccctgcctttttttgttttccatttgcttggtagatcttcctccatccctttattttgagcctatgtgtgtctctgcacgtgagatgggtttcctgaatacagcacactgctgggtcttgactctatccaatttgccagtctgtgtcttttaattggagcatttagcccatttacatttaaggttaatattgttatgtgtgaatttgatcctgttattatgatgttagctggttgttttgctcattggttgatgcagtttcttcctagccttgatggtctttacaatttggcatgtttttgcagtggctggtactgcggttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctggattgaaaattcttttctttaagaatgttgaatattggtccccactctcttctggcttgtagagtttctgctgagagatcagctgttagtctgatgggctttcctttgtgggtaacccgacctttctctctggctgctcttaacattttttccttcatttcaactttggtgaatctgacaattatgtgtcttggagttgctcttctcaaggagtatctttgtggcgttctctgtatttcctgaatttgaatgttggcctgccttgctagattggggaagttctcctggataatatcctgcagagtgttttccaacttggttccattctccctgtcactttcaggtacaccaatcagacgtagatttgggcttttcacatactcccgtatttcttggagactttgtttgtttttattcttttttctctaaacttctcttctcgcttcatttcattcatttcgtctttcattgatgatatcctttcttccagttgatcacatcgactactgaggcttgtgcattcgtcacatagttctcgtgccgtggttttcagctccatcaggtcctttaaggacttctctgcattggttattctagttagtcattcttttaatttcttttcaaggtttttaacttctttgccattggttcgaacttcctcctttagctggtagtttgatcttctgaagcctccttctctcaactcgtcaaagtcattctccgtccagctgtgttccgttgctggtgaggagctgcattcctttggaggaggagaggtgctctgatttttagagtttccattttttctgctctttttttcccccatctttgtggttttatctacctttggtctttgatgatggtgatgtttttggtgtggatgtcctttctgtttgttagtttttcttctatcagtcaggaccctcagctgcaggtctgttggagtttgctggaggtccactccagagcctgtttacctgcgtatcagcagtggtggctgcagaacagcagatattggtgaaccgcaagtgctgctgcctgatcgttcctctggaagttttgtctcaggggagtacctggttgtgtgaggtgtcagtctgcccctactgggggggtgcctcccagttaggctactcgggggtcagggacccacttgaggaggcagtctgcccagactgcgtgctgagagaaccactgctctcttcaaagctgtcagacagggacatttaagtctgcagaggttactgctgccttttgtttgtctgtgccctgcccgcagaggtggaggctgcagaggcaggcaggcctccttgagctgtggtgggttccacccagtttgagcttcctggccactttgtttacctcctaaagcctgggcaatggcgggtgcccctcctccagcctcactgccgccttgcagtttgatctcagactgctgtgctagcaatgagcgaagctccgtgggcataggactctccaagccaggtgcaggatataatctcctggtgtgccatttgttaagcccgttggaaaagggcagtattagggtggaagtgacccaattttctgggttccgtctgtcacccctttctttgactaggaagggaatttcctgaccccttgcgcttcctggatgaggcgatgcctcgccctgctttggctcacgcacggtgcgctgcacccactgtcctgcacccactgtccagcactacccagtgagatgaacccggtacctcagttggaaatgcacaaatcacccatcttctgcgctggtcatgctgggagctgtagactggagctgttcctattcggccatcttggctccacccccccggcaactgcctattgttttacctgatatgcacaacattggccattagtgttaccaaagcaacatccatcacaagaattaatgcttcttgatttgaattttactcctctctgtctctgtttatgtgcattcatttgattgtacacttgtataagaactaaaagcataaaaagtttattcctacatctggcacagctcacgtctgtaatcccagcacttcgggaggccaaggcgggcagatcatgaggtcaggagttcaagaccagcctgaccaacgtggtgaaaccccaactctactaaaaatacaaaaattagccaggtggggtgttgcgtgcctgtaatcccagcttctcaggaggctgaggcaagagaattgcttgaacccgggaggcggaggttgcagtgagccaagatcgcactgcaccccagcctgggtgacagaatgagactctgtctcaaaaaaaaaaaaaaaaaagtttattcctagttttacatttgtagcattgaaattaaaagaatctaaataaataacagagcactgtgagaatttgttgtttaacagagctctatatgcattacacaatttcaaggaacattgatctgaatgttcctatccctcatggaccttgagccctgacaaaagttaataaagatgggtctccttttcttcttgtcccctgctttcagctctgaatgagaaaagttttgcaaatatgtcggtactttgtattaagcctaaaacttataaagtatcagatttgtaagttgactgtattaactttaatttctcaaagtgttctcagttaattaggttaacctaaaactaaaactataaagtgattcctcccctaccaagaaaaaaaaaattaagctgaaatcctctgtttagagtttcaggcctttgggctggactccacaacccttctcaggaagtagcagtagacacctgaccttaggctgtagtgctaatataacctgtgtcagtagctgccccattgcaaacaaggaaatgatcctctgaagtcaaactcaggaaggaacaagaacctgtctctctgagctctctaaagagtgtggttaagagtatgagcattgacaacagactgcctaggttcagataccacctctgatgccagttatgtgattttgggccagtttcttaatctctcaatgtctcaacaacatgagtctaataatagcatatatacccctataaccatggcatgaggattagacaggttgattggtgtgtataaaacacttggaacagggcctggcacagggtatgccttagtagatgttagcactgcatcacgactgctactatgattaccgtccctgtcactgttgctgctgccaccacaggcaggtcagtggaacgtcacccttcagggatttatcagcgccactccctaagcatgccacctgcatgaagggcagacatgaaattgtgccgccagcgttctggtttcttcagcgctccctgccagctgagctgtgtgaaaagcactcagctatgaaaaaatgagaaagattgattgaaatgttggtgaggtcattgtcaaatattctctgtcaactgaatgactgcaaatagggagatgactgcccccccaccaagtcagcctaggagggttcagtccttcatttattcattcacacatcactccttcactgtgccagccagccatgacaattaagtgcatttgggaggaggtggcagctgagctggaaagggggtttggcattatgctgggaaggtgtaaaaagccaggctgaagatttgggccgtctttttttttcccccagatagtggggagctggatttggagacaagaaacctttgtagaccctctggcactctctattgacagatcactgctaggaggcagtgtgactcggagaaccgcatgggctccgccaccagctctgggttccgcactcattagccagatgaccttgggctcattatttagcaagcctgcacttctgtttcctcacctacaaaatatgcataaaatagcagtacatacctcacggagttgttctggggcttaaatgagttcatctgtgcaaacatttagacgaagtgcttgacataatcagagctatgtaggtgctgttaattcttctttgccccactggtccccaggttccatatctgtaacaagaagcaactggaccacataatttcacatccttttatacccaagtttttgatcaagagagctcaggctgtactttaagcttaatgtgacagtgatttatagcatagcttgggggcgatctgaacacttgggggcagaaaaacaagttaggctttccctgtttccatcattctcccacctttcctccatctgcctgtccccacctggacatacatgccaaaagccacggcccattttactagatctaggtagtatgggaaaagaccatgaagcggacacatcatctgtactgccagtgtctctcttcaaaataaactttttttttttttgagcctgaatctcactctgttgcccaggttggagtacaatggcatgatctcaactcactgcaacctccacctcccgggttcaagcaattctcctgcctcagcttcccaagtagctgggataacaggcacctgccactacagccggctaatttttgtatttttagtagagatggggtttcaccatgctagccagactggtctcaaactcctgacctcaagcaatccacttaccttggcctcccaaagtgctaggattacaggcatgagccaccgcgcccggcccgcttcaaaataaacttctttaccaggaaataggattaagaggaggtagaaggaaattagagtaggatcagaaagatagaaaaaggagttttctctgaaacaataggacagccagatacaggctgagcaggcccaatgatggatagagaggcacatccactgctgagctctaacctagagagagaatgtctcaaaactccttgcatggaaggtgcctggaaatgtatttattctcctgttgtttattctcacctctcttcattcctttttctttcttctgtccttgaatcgcagcagataaaaagacaaatctgctgagaggatgcatgtcacaagtggtcagatgaattacagccatagcaccatatagataagaggcaaggctggcgcctgggcaggtctgagagggtccaggaggacacacaccatatcaaattgtgcaatttagcaaatggctggtggcagactgaaatgatagttaatctgttttccatgcactaaaggcttttgccaaactaagatttgctgtgaagacccaaagctggagcccacccagggagcgggctgccttggatgcgtttcccagccttctacagtggatgccagtaaaactaactagagacatgaatgggcaccaggataaacacaaggggatattttgttcttaccattagagaaggatactgctaactggcaagaagtcccatggttgttatcttttgattagtagtagtaaaaatactatttaaagctagtagcattttttgagagcttgctttacactgggtactttttcaagtgtcttacaagtattcgctcattttatctgcacggcagctgtatgaagagaatactgtcattatcttcactgcataggtgagcaatggaggcacagagaagttcagcaacttgtccaagctctcatagctgggaagtggcagagccaggctttgaactcaggcagtctgactcagagtccaagactgccggcctgaattgtaggagagagacagtgcgggtataccaggaaccaaatcctatcggctgaacatcagtgtttaagtcgagcccagatgctctgcacaaaatacaatgtgtctgtgcacatgtgactgttaatcagccatttccttggttcctgctttgtgctggccactgagctggaccctgtgggatggataaatcaatgtcagtcatgcccctggagacctggctgttgcaaaaaggctcctgaaatcatcataacccaaaagagaaaagggcaggtgctgaagagaagtataggtaaagagcagcaaaatcataaaggaggggagactctttgcctctgtggtatcagggaatgcttctcagagcgggtggcgtttgccctgagacttgaagtaggaatttaaaaacatagaaatgcagtggaacgggaagaaggacattctaggtggagagaagtagagcaaaatggtccaatctgcccccctaagggtgtgagacagagaagtggatgggaaggccaggaaggctgtcgccatgtgggccgaacatggggagggaggtgtttgtcagaatcagaatggactcagagggaagctgagctaaaagcttcaatttacagatgaaagaagaaagaatttggatatgtgactcactcagtgtaccaagttcgtggcagaagtaagtctcaaaccccaggcttgcctccaattttctttgcactgatctcctggcataaacatgtggctaacaagggtctcacaatgccaggagggtgttacgtttttataacctgttctatttgagggtctccaaaattacatatttgaagttaatattagccagatgctaactgtctgcaggcaagaataagcacccactttacattgggagaagctagagatttgggaatcaggatttgctgcagatactttgaggaatctaggcctctaatccacagtctcctaaattctggaacttctggcttaattacactttttaataaccagtcatcattgctgcataatttgtgaggtctggtatagtatgattcctgttcccttcagctaaccctgcccccacccccatcctttaataaacgtaaaacttttctttcctgtgaattcatttttttcccttttatcttttggacctttgcaattaacatattaatatttaattcatattacctgaaggtccaagaacacttttaaactcatgaaaaaccttcactagtaatttagctgctaccaaggtatccctgagccctcattatttgcctctggaaaatgccgtaaacgacatctaacaggcttcagctctgtacctctacaaataagaaattaagcagtattcagaacgccattgattattaatttaaaagaaatcaaaaatcaatatcacattcctgtaacctggcagtttttcttaactgaaggcagttgcctgcagaagccttgtggctttccagagcaacggcgccccttcgtggtgataatgtgaactgcaccccaggcgtgattgaaaataaggcagaaaggaatgccggcctcgagcaaggacaccggttcatgcccaaatcacttctgctttcagccaacagactgtttctgccaaaagatggacgcagctagattttttttttttttgtaccgataatctgtcttaaaacttggagaggatctcttttcccctgtgaagtcaggaaaatgacagcaagcagcatggattggttcgaataattttcaccagaaatgtggggtgaggggaagggatgggactggagtcagagcagtgatctggcgggatggggtgatgagccatacggagatgaggtgtggcgccacgggctgggagtcagggattatagagtgagggtggggtaggatcttcctggtcatcaaaactatgagaaatgtaattatttacattttaaactaagccaaagactgtattgaaatgtcttacacccagaacagagaagtggtatcaccaaagttcagaattcccagctctaacgtgatgcctttggggactgcctccccaccccaggctgacctaacacacccctttgagaaaagaggatttagtttctcctgactgtgaattgaatatgtgggatgtgcccctccaggagcttctaaaatcacctctgctttgaccttgaggggccgtggtagaggggagacagcaccggcttagaaaccccacggctcggctctagtcccagcatcagtggagcaccaaggggagaaagtattcatcactgaggtattttatgatatgtatattgttcctgggcagttgcaccccttatcgcctgcaccctgtgtacagctccccattcctcctcccttggaggccactgtgctatgtaacttgctgtgggctgcaagaaagactgggctcccgtttcctcttctgaaaggcaggaatcatgctcccggctgacctcacagaatcattccacagattaaatggcgatatggcttgtctgtgttcacactcaaatccacatgttgtgggagggacctggtgggtggtaattgaatcatgcgggcaggtctttcccatgctgttcttgtgatacagaacaaacctcatgagatatgatggtatcataatggggggaggttcccctgcacaagctctccctttgcctgctgccatctatgtaagacatgacttgcacctccttgccttctgccatgattgtgaggcctccccagccacgtggaactgtaagtccattaaacctctttcttttgtaaattgcccagtcttaggtatgtctttatcagcagcatgaaaatggactaatacaaatgggatgtaaaaataaaattcttatatacttagaacggcaatatgagctttacatctgagttatgctataatatcaatcaacatatataataatataaagtagtatatttattataagttataataacagagtgagatagcttagtaatttcttgttagtatctgcaatcttggggaaaacaaatctagagaaataagtccaaactggagctgcagagtcaagtgggcgagagaaagaagtctcgctttttttgttttccaggaaagctcaggtccagttcagcaggccagcccaagagactgggagagccctatgtactcaggagagcagcctcacccctcgtccttgtccaagattggggagtgggtgcccacagcttgtatgtgtccccatgagagtgggtgtcattatgaggagcatcaaagggccaagcacagtggtgacagatgtgggggaatttgccattctgagggcagaggaggtcaaacacaagtggactcgcttattaagcccagaaagagaactgggagaggaaggccaagtgaggatggaggcggagatccagggcccatctgcaagtcaaggagcaccgaggatgctcagcagcagagccaggagagggcatggagcggactcgcttgcagagcctgtagaaagaaccaactctgccgacactttgatttttaacttctggccttcagaactgggagagaataaatttccattgttttaacccacaaaggaagaaaaagactatcaagagtagaagggcctgacaggtggccacacggcaggtgagtcagagagttgagtcacgtgggaggtagtttagaaaaggatttgtgaagagggccatcccctagcagcgtgttgaatatagtgaggaatatgagatggaaaagaatctttttagagaacatgggtgccagacatagccacagacaaagtcgtgaaatagacagaaatttgtcccatttatggagactgtggttttccacccatatgtccccccaccccatgtcatgtttacctggccctcaggctcacgctgatggccctgggctgcttttttcccctcaaaagctgatgtctggtctctaattataagatacaagatgagatggaaataattgttaacaatgtattcattcaacaatggattgtgtaaaaaaaaatgtggtacacatacaccatggaatactacacagccatgaaaaggataaagtcgtattcttcacagcaacaggaatggagctggaggccattatcctaagcaaattaaagcagaggcacaaaactcaatactatgtgttctcacttataagtgggagctaaacattgggtcctcatggacacgaagataatagtaactgacactgaagactactagagggggtagggtgggagggggacgaggggtgaaaaacaaccagcaggtcctttgctcagtacttgagtgacgggatcatttgtctatcaaacctcagcgacatgcaatttatacatataacaaacctgcacatgtacccccgagcctaaaataaaagtcaaaacaaaatattcattcccaaatcatttactacatacaaatcgttaagtcaggatccctgctgtgacactagggattatagaagtgttgaaagcttcattctcatccagtcattcattcagtgcctggctggggttgtgataagcaaaagcaaacccatccctctccacatgtagcttccagtctcgtggtggcatttcctcagaggatgaagccatccaggtagcatagcaggcatgaggtggttccagtaaatggaggtgggacagtctccttgggctgccaccctgcttggggctattcctggtagggcctggagctctgcctagagaagcccacatgccctctcctggagtcacaagggcaggccaagtattctgtcctattccagtctttgctagaatgtgtcaagtgctgtgggcttgagtccttggcaatttttgcatgggacttagtttgggggtaagttttctggaaacttgaaatgtttcacttaaaaagaaaaatgcaggattcaaagaagtaaagagtaacaaataaatagaggcttttttagttcaggggtcagcaaactgagggcattgcagctgttctggaattaatgcgtgtccgggcaagggtcagtaattctgagatgccgttctgttgctttcaggccttttttggtgaaaactcttaaaggaggtataattcttcccttgctgggagtctttgtttcagaggggttgtaaaaaaagattcccagaggataaatcatatctgtattaacttcctaatgaaatgaaaaattatatcattgctgattattcctccttggctgatatggaaaaaaatactattaatactttttagtgtgattttaatcctttgcattcacggatatttgcattagtattttctggacatcatcttgtttatatggattttattcattgtaagatgccatcagatccaggcatctgagttctgggggggcaatgctataatccctgcccagaaccaaaactttccctgtgcagatggtctttcaatagagtggaatgtgtttggggtttctgcatatttcagtttacaaacccttcagtgatggttgtcttcatcctgagtttggctccatgcttcagaagatgcaacagtgctgagaacggtgcctgacatgcaggaaacattcagtaagtgtttgctgaatgaatgaataaattaattcaacaacagctaatgaaagcacatcccttaaaaagtctcggcaatattgcgagcataataccaaaggcagaaaccataaaagaaagaattgatggattggaaggggaaaatctttttttttgagacagagtctcactgtgtcacccaggctagagtgtagtggtacaatcttgactcactgcaacctccacctcccgagttcaggcaattctcatgcctcagcctcccaagtagctgggactacagatacacattgccacacccagctaatttttgtaattttagtagagacggggtttcaccatgttgcccaggctggtctcaaattcctgacctcaaatgacccacccacctcagcctcccaaagtgctgggattataggcgtgagccaccgcagccggccagaaggggaaaatcttataacatgaatttcagataaactgttacatccttaatacttaacgaattcctgttaatcagtatacaaatattagtacccaaatagaataaataccgatggccaataaatgtattagaaacatttgaatctcacttataaaaacatagttattttcctaaatggggtatcattttttcccaatcagattggcaaaaataaacaagaatacaaatccagcctagcacatgtacgtactttcaaagggaggataatttggttcaacatgttttgaaagctggttgtatggtatgttttgaaaccttgaaaatgacccagaaattttccttctagagatttatcttaaggaaattataggaggcataaaaagtttcacctgcttattgctttgtggcttatcattgcaaaaagaaaatggaaaactacttcttcagctaaaggaagtgatacgctatcgtactagaatattaaaaatgaagaaggtagggaaaagagaaagagaatctaagcggtaaaattgtttgacctttattttcttctttttgcttagctatattttctaaagtttttgttaaaataaactcttttaacaaaaaaattctaaaaactcatagctgcttagatgataatataattataatatttatgttaatttttgttgcgaacgtatgtttatgttgaacttaccaagtgatctaagctatattactaagttcttttcataagcctctgagttcatgtatattaagcccttaacataattcttagagttaagcagagcaggtggcgttattcttccatgaccgcactgagactcagaaaagttacatgacttattcaatatcacataattaataaagagtaagactggccacaaagtccaggatgccacacacatagctgagtgcttcttcctctatcatagaaacaaaaatctggatgaccattaggccgttgttggcctgcaaaggtgtagagcaaactattttatggtattgagagcacttatcttggcattactccatctgattgtttgtgtcaagtaggaaagatacatttattattcccattttgtagatggagaagctgaggctcagagaggttgagtgacattcccaaggttgtacacagtaagtggtaaagttaggatttaaacagttttagtccgaatcccttgctctgtctacttcagtttggcataataaattcttaacttccttaacagtttgtcccatcatattcctaaagttttatgatttgatgaagtctctcttaagctccttttccacatgggtggcatgggttagcaagattttgagggctgatcttgtgtgacagattgtatttccaaagatgtctggaataatatcttgtgtcccacatactgttgtggaactatcacctctccatcccaaaaggtggaacagaagcaacactatgaaactgccaaggctaaatcataaacattcaatgcacttctgccttgctctcttgggatgtttgtgcttagaatccagctgccctgctgtgaggaagcccaagcaactctgtggaaaggaccacatggaaaggaacagaagtgcccagctcacatccctggctgagctcctggccatcagcctaatttgctggccatgtgagtcatcttgaaagtactgtaggttcaaggtttactttctgaggtttcagttatccatggtcaaccgtggcccaaaaataggtgaatatagcacaataagatattgtaagagagagactatataacttttatttacataacttttcttacagtatattgctatgatttttctcttattagttgttgttaatctcttatgactaagttataaataaaactttatcataggtatgtatgtatagaaaaaacatagtatatgtaggattcagtactatccgctgttgtaggtatccactgggagtcttggaacatatcccttgtggataaacagagactactgtagatcctcctgctcctaattagcctaccctaactgatgttgcattgagcaaagtgaggtgagccgaccaacctctgcccaaattgcagatttctgtgtaagataagtgattattctgttgggggtagtttgttatactcattttccctcctaaccccaaattaggtggcagggatggaggagtcttgcttatcatctctctatttttgttaactcctcctcgttcagggtagactttggcacctggatcacaaccttattctccaccccaaacctgccattatccttggtgacaccattatccatgaaggggacccatttgatatgttagcttctcagttccctgtcttctaccccaaagtccttcaaattcaaagtatcttactctttttgttttaaaattgcttggagtagtagagaggactctagtggaatatacaagccaaaataatcaggaatttttacatgagagaaaggaggaatgtcgtgaagggcatcaaaaagcaagaaagatgctcattttcccttccaaccccaatttaggtggcagaggtgggagcaggtgaaaagaacaaagggcattggaaaagaccacctggaagtcagtgaagaccaagcggtaaagggatccttagcttaggcaaaggctagatggggacttatctcaccaatggagccagagaacagatgttccagatgtgtgtgtggaagtgggaagaggactgattaaggaaagaagaagctcaaagcaatatagagatgagacagagaaataacaggattccagaggcacttggattttactcaccaaggatgagggggaattagttggtctcaacatttctaacggcaaagttacaggtcacctaatacatatttatgtattagttggatcagaggatggatggatggatgagtgggtgggtggatggtagatggcagtggatgaacagatgaatgaatggacagatgtgaggatttctctgtgggagattcagttcgcccaggagtgatggtgtttctgagagagccctagcagcatttgttatctcctaggctctctctgaatgttcgaagcagtgagtggcaaagaggaggctcagccctctctggattgatctgttactggggtgtacaggcattcagtgcagagttctcttcatcaatggtcaaataacttctgttacccacttgtgatggctcctgtagcctctggttcgactccatgtaacaactgaagagcagccttgctgcaacagataggaagcaggtcttatctctgatttgagaatagaaggcccggtgggtacaacctgtagcactttcaatcctgtagaaatatagatagtgatgctgttggtaaaaaggaatccaccctttccaaactttttcctaagtcagtggttgtcaactggatgaggtcttgctcaagcacaagtgtctggacccctcctctagaaggagtgattctgcaaggctgagcaagcctgagaatgtgcatttctcacctgtaatcctagcactttgggaggccaaggcgggtggattgtctgagctcaggagttcaagaccagcctaggcaacatggtgaaaccctgtctctactaaaatacaaaaaaagtttccaggtgtagtggcacacacttatagtcccagctactcaggaggctgaggcacaagaattgcttgaacccaggaggcagaggttgtagtgagccaagatcatgccactgcactcaagcctgggtggcagagcaagactctgtctcagataaaaaaagggatgtgcatttctaataaattcccaagtgatattgatactgctctaggaccacactttgggaatcacttccatcctgcatggctaggtttaaattaggcattcttaacttcatatgtggcagggtgagtggatgttgagggccccaggtatattcttgaaaaacaaaaagaagtcagtgatcagttaattcattctagtctcctgctgagactgttgtctggcttatgaaggccaggatttttgccacctgaggcatttggagaagcctatgaaggagagtagaggagaggttggggacaacagaatgaagccagccagaaaaagagactgggcatagggggaatgggaatttgaggagaaacatatcattcatcagaacttaaatctgcatttttagagaagatattataatgtgcttacgtggcctccagatgtgcacaggtgccataggatagaagtagcccagggaagccttgtcatagatgggctacataaataggaaggcttgcagcagtgttaaaagacagctgatatgattaggctttgtgtccccacccaaatctcatcttggcttataatccctgtaatcccgttgtgacaagggagagaccaggaggtaactgaatcatgggagcggtttcctccatgctgttctcatgatagtgagttctcatgagatctgatggttttacaaagggctcttccccactttgctctgcacttctccttcctgccgccttgtgaagaaggtaccttgcttctctttcaccttctgccacgattgtaagtttcctgaggcctccgcagccatgctgaactgtgagtcaattaaacctttttcctttataaattaaccagtctctggcagttctttacagcagtatgaaaatggactaatacaacaccctccatgcaacctggagaaaatgcaaagtacatatagctctcaaacttcaggaaggggatccatatatgcagacagccattctttaaaataacctttccattctcccatccacttcgctcacacgtgatagatagtctgtattatctcttctctaacatctccacccaaaactaaacaaaacattaaaaccctccagtcattatttaacttgcctctttcttcacctcacttccagtttctccccgattcacattcacaaaagcccaagaatgttatggctgatcaaggactctcctttgagggtgggaagaaactgcaggggtcaggccagaattctcttctgcagacagaggagggggaaagacaggaaataagcatgcacaacgttcacctttgttggctgcacaacagcttgggatgtgcacccagccctaggtctccagctgagatgtcctcagttgtactcagcaaaattgccaccttttctgagttatgaaagccttctctcctagagccccagtatgttcctggcacctgcaggcttttgggttttggttttggggtttttttctgtgtggtgttgttgttgtgtttcttcaccagggcatgagtagacagatcctatgcaggcactttctttgtgatcttcaggatcatttgttttatcttgcctcccaaatgctgatcacccatgggcatgcttcttgagggttgcaaccatggctttaaaacccagaacagctggtgtctgtggtctgcagggcccagaaaatattatttaatccaggaaacattcctttgttctgctctgcttcattcagacctctcctgggtcttttccttcccctgctggctatcgatttccatccaactgaaggggtgaagttcagaagcccaggagacagcctgaataatgggtatgcaagtgttgcatcacacatgcagcaaacatttattaagcatgtatactatacagggctgcaaaagtccatatgtactaggatcttacagtacacttggaaacaacaaggaatctgggtatgaggattctttaggtggaccagatgcctgctctgtgtagcagcagaactcttcaatatggactgtaaccacctgctccaaaatcaccctggggaattgtgaataaaatgcagacttcaaggctcatcctatacttgatgagatagggccctgaaatctgctatcttaacaagcacccagttggtttggctcttcatttttctttttgagacagagtctcattccattgtccaggctggaatgcagtggtgcgatcttggctcactgcaacctctgcctcctatattcaagtgattctcatgcctcagcctcccaagtagctgggattacatgcatgcaccaccacactttattttgttttatttattttattttattttattttattttattttattttagtagacacgggatttcaccatgtttcccaggctggtctcatctcttggcctcaagtgaagtgcccacctcagggacatatattgtatggtactgtagagtgctttatacttatctttctcctaaccagatgttagctcttagaatctcatcctcctactttccaaggtccctgcacccatcaccaggcccccaagggatatggacagggagagccctctggccaaattctcgctggatctcccagtggccgttcagcttggaccgccttttctcctcttattccagtgatagtccaggatatctttttgccttttttcccttaagacttccctggtcttggtatttgggattttctcattttgaatctgggggtgaagaggggaatttaggggatattggtcacttgtcttctgtgtccaaatgtgagtgtcttgctttggattaggaaacccctaactaatgaatgttgttaggggctaagaccactccaacagtagaagctagaaatcttagatactaccttgcccatctctgggtgcagccaggacactgaatgtgattcaggctctgctgattagatgtgtccctgttagacattgacatagaccccaggagccagggttataagggacaggagtcctttgtcctctggcaagggtaatttcctcctcagaaccagtcctgggctatgttgatgggcgtggcccagttgccttgtaccaagtcagttttctagtcctgactagaaattgttagttctggcagctaacaattctacatgatccaaaaaagtgagggatatcatttaaggagggagggagacagcctctgccttggtgtctcaccttccaggagtaaagacgtgtcccaagtaatgggtagctccatgcacaagagaagagacagtggagaagataagacatgcaagaggaaggatcatggaagagagacccagaacatttgcttaaccagatctatttataagttttagtccttaatcagaaagcaatgtatctttcttagaacagtaacctcataatgcattcctgaggagcccagttagtccttgctcctgtccatcccacctccttcaggcggtagaacagaagaagggtcttcatctcaccccagctaaagcatctctgcttccagaaagtgtggatgagtgggagccataaacctgggaaataagccacatgctacccttttggttgttgtttattttaacaaaattctatgaccccaggaccatgtttctaagagtagccacttgaagcagaaggaaatatttagtcaaattctacaatcacagccaaatacagtctaatggcagccagcagacactgtggaaagagagtgtcacacaccattctaatgtggggagtaaggatgatgaagaatcagtcataggtccgtgttgtagctccgtctggggagtggaactcatagggtataagtgattatttcctattcatttccttagccctgaaccgtccaatgaccacacgcaacttgactggcaagaggtgtttagaatgttgagacacggtcagaaatgattggtggtttcatgtgatgcaaagaatttcccatactccgcctgttttctggatcacctgtccccagaaattgcctgaaaacaaatcacaggttgaaactagaaataacttccctctcctaggcagcttggagactggccaccctgtttcttggtttggtaagaatgttccagacacaaggaggggagcaacacacactggggcctgtcgggggttggggtatggggagggagagcattaggaaaaataactaatgcatgctgggcttaatacctaggtgatgggttgataggtgcagcaaaccaccatggcacacatttacctaagtaacgaaactgcacatcctgcacatgttaccccagaacttaaaatgaaaataaaaattaaaaaaaaaagaataatccagaaagtcaagaaaagcctaactaaaaaagtctttttaggcaagagagcatcgtaagtaggatgtagaggaagctcccctgcttaaaacctgttaatggtcttctgtagctttcaaattctagctcctcttgcctccacgactcaactccccagccctccttccgagtgtacaagatgactcaccctgagtccagagccaaactctcggtttgcatcccagctctttgccacttactacagaccatgtgaccttgggcaagtcacctaacctctctctgcctcactttcttaatctgaaaagggggggatgatgaccacccgtttcatcaggttgctgtgcatacaaatgggcgaatatgtgtaaactgctgagaacagtgcctagcaaatagtaagccctatgtaaatgtttgctgatgttgtgttccatgattccgtggctttgaagatgctgctctctcatcctgcaatgccaccttaccttacctagcaaattccaacgtgtccgttaacattcagctcaaggctgggcacagtgactgacatctgtcatccccaaactttgggaaactgaggcaggaggatctcttgagcccaggagtttgagatcagcctgggcaaggtagcaagctctcatctccacaaaaaaattaaaaaattatccagaggtggtggcatgcacctatagtctcagctactccaaacactgaggcaggaggatcgcttgacaccaggaatttgaggctacggtgagctctgctctcacctctgcactacagcctgggtgacagagcgagaccctgtctctaaaaagttttcatttttaattttttaaaaaatgtttttaatgtatctcaagccctacctccttcagcaaagtgttctgagcacccaggtctgatgtagggccttgtccatgcttcctgaaaatatatcttctgtagcattcaatgcactggaatgcctatgttagctgaaagttactgatcacaattccggtggcctggaggattggtgagcccagctgtgaagtttagaggcttgctatcttgcccaggctgatctcaacaagtaaacattagtttattcatctgtcttctccctggtttcaagcccctggagtgtagggccacatcttacttggcattgtatccagcagtcaacatagtcctagaatatagaaggccctcatgttgaatgaatagtaaaaccctcctgaaatccattaaattcatatgtttatttactcactcattctcttcctttgttcaaaaaacatctcttgagcctctgtgatgtaaaccaagtgctttttaaccagcagcttctctctgatgatctatctgcaatctctgtgtcagtcctcacatttaactaggacaaaaagagaacatagattcttagtagctttgctcatgacctgactttaacaagaaaaattttagagaccaaaagtctgactgatagctgagtgagttctttctttcaaactcaaagccctgtttgagcctctaaacttcacagctgggcttgcaaatcctccaggccaccgcatttgtgatcagtatctttcagctaacataggcattccagaagatgttctgccctaaacgtaattggaatcctttttgaatcagttgccacagtacttctgaagttttttatgctaacttcttgggtatatttcctcaagatggattcaagatgtggccagttctcttgtgagaagaatacatttctgttgtcctaagtgtagagaccctctagttcatgtaatagccctgcaaagcaatctgctattaccagtcccagcatccatttctccttccttccttagtaataaaaccctgctttggctgagcaccttgttgcccagaattaaacactgttttaccagcttccctgatgggtgtggtcaggttactaagatctggccaaagatgtgtgtatgagttttctatgctgctgcaaattactacaaacttagtggcttaaaacaacacacatttatcttataggtctggaggccagaaatctgagatggatcttagagactaaaatccaggtattggcaacagaggtgtattcctcctggaagttattgctttttctagcttctcgaggtcgcctgcatttcttgtctcgtggccctttcctctgtcttcaaagccagcagctctctggcatgtttgtgcttctcattctcattctctctctctctcccaccccgcccccgcccctgctgtgttatcacatctcctctctctgatccttctacctctctttcataagaacccttttgattagatagaacccacatggataatctctccatcttgaggtccttaatcacatctgtaaagtcccttttgccatgtaaggtatcatattcacagttctggggatcaggacatggacatcggggggacattattctattgtcatgtataagtagagtaagtaagtagagtatggcattttcagaaatgtgctcaaagggaggtgtctcaactgggaaggaccctctttgacccttctgcctttcctttctaaagctgagatatgatggctgatgctttagcagccattgtgaaccatgaggtggccttgcggatggaagtcaagcactaggatggtagaagagaaacattaagatataaattcctgatgatgccatggagccaccttttaccaaatacacttctatcttgtttaagctactgccatcttatttgtttttttttttctggaacatacagctggacctaatctcaatcccttaaaactatacatgactctcttcttaataaactgcaaggctggttctctcagcctactaccctgcctaaggaacagataggtagtaagcatggatatgaccattgctcagaaaatgtgttccaaaaacagacagtatgtttatcatttattgatcagttcagcctctggctctgcctatacactgagccatacaacctcaatattaatctgggctgttaacattcttccagagctttgatcatggtctacatcttactccccggagaatcaggtgggcagaaatgggctactgacctatcaatttctagtcctgattagctcaaaatgtggtcatttcctcttaacataaatgtatttaacaacctgaaatagcaaatagcaaggtaactttccactgacctgtcttactattaatatcagaagtcagaggtggacctaaaaagtaaccaaacaatcaaaaccaatgtctgtaaggaaaaccagcatcgttattagtgacaccaagattcaaatcattgatttagcaacactccttagtgtattcatcagatgtttattggaaatctatggtgtggcctctgcagtgagtcagagtgcagagttgaagagatgagggtccctcaccttaagaaccctcactgcattaatggagagacagaccaagaaatgcctttgtggtttcaagaagtgcctttgttctgtttcatttttttattgtcaacaatcatggccaggcatggtggctcatgcctgtaatcccagcactttgggaggccaaggtggggggaatcacctgaggtcaggagttccagaccagcttggccatcatggtgaaaccccgtctttactaaaaatacaaaaaaaaaaaaaaaaaaaaaaaattagccaggcatggtggcgggtgcctgtaatcccatctactcgggaggctgagacaggagaatcgcttgaacccaggaggcgggggttgcagtgagccgagatcatgccactgcactccagcctggactacagagtgagactccatctcaaaaaaaaaaaaaaaaaaaaaaggaaaaaaaaaatcacaacctagattctgtaagcacctacagcagctatcctttgctggggtttcctcattcagctctctcctcattcattatctgggtcctattgtattccctttattagttttagcaatgtttaaaattatttgctgcttgaaatctaatccattttgcaagtaaccagcacctgggggcaggggtagtgatgagaaaacagggctaaaaggaataaattcacaatgagttttatatttacaccatccttttcccattcacagggttttcccatttgggaacattcttagcgtgttctctgaacagaagaccgtttctcttggtctgaagttgatcaatgtgagaggaagatggcacattagaaagatgcctggctctgatgacattccaccccgcagtcttccagcacactgggatctggggcttgaagtcacttgtctggctgtgtgactgtatccacttggaagcagcgtcccctgctcctaagttgcacaagatacttcagggagtctgctgtgatttagtgatagacaagtcagaaaacaagtttaaacttgttattaatcagaagagaacacagacatttttagctgtctatctgacttggtcatagggcagagccatcagatgccatcagtggtggtcggtgtagatttttttgtgaatcaagacaggagcaggaaaaaggggggtggaaataacagacaggttccaggagggcctggtggagggttcagctgttggagctcatttttcttgctttttcccgagagaggggaatggactgccattgtcacaggttaagtcacagaagagtgaagctcaggtgacaggagacattccaaattgagaacagacatgccaggggtccctgttgccacctgctcacaagccaaggccttggttccgagcccctcttctctctctgcattttctccttgggtgacctcatccagcctcgctgcctgaagtgcattcctacacaccagtgactctcaaatactatctccagccagctctctccccacaaatccagattcaacagccactccatgtccctactcagatggctcctacagacctcaggcgaaacatggctagcacgcaagcccaggtgtcctccccatcctgttttctcatctcagttgatgtaagctccaccgtgcacccaactagttaagctagaaacctggagtcactcgagactcctctttttctcatgggcaagccccatccatcagagaggaccaggagccttgcctccaaacccatttgcttctcttgatttcaccatatcacctgtgcccaaccagccttccatttctctaacccagtggacacagttccaaactggtctccttgcttctactcctctccctttacaatccattctgcactcagcagctaacatcttttaaaaacataaactggaccccttaccacttgaagccttccaggactttctatttcttttaaaacctgacacagcccctgccttcctggtctcctctccactgtgttctgtgtggccaacctccaggcgtacgagcctgcctcttgccctctggacagatcaagcttgcttcctgccttggagatctggccttggctgttcctctgatggggaggctcttcctccaaagagtcacacgaccatctccttcttgttcctgagttctttattctcaatgaatgaagtttattgcactcccctccccaatctcagtagtccccagtgatcctctctcccaactcccattctagcttcattattgcgctgtttttccttggtttcatgcagtttccttgttcattgactcctccattacagagtaagcttagagaggtcagggaccacatctgtttctgtctcattccccacttcagcacagagaacgatatggggcacagtaggagctcgataaatgctttagtgaatgcataaacaaagtaagaaaccatgaggtgacccaaacctcggtttcttcagttataaaatgggcacatgggtgcaaaggctcaggtgtattgtaagggtgaaacgagaggtgatgcgtgtgaggcctttgtgagctctagatctctttgtagatgcaaagtatcagtgtagattgcagtaaccaggacatcagaagaaaaccctgctctttggaagcaaagtgtgccaaataacaaagcttagctctacaaggctatcgctaagcctatgcaataaatactttctctcctccacatctgagctggacattctccacttgtccctccagagccactctccacccttcttacctgcctctgtgcctcacgggctgtcactacagctgcctcagtaagctcccttgccctctgggtacaaggcttcaactgatgggtgacaccaacaggagatcagaggggaggagagggagaccaggtaacttattccctggcagaccttcatcagagagtagctgtgttctgctgaaggctgtggcttctgtctgtccaccttctcctagaaagaccacatcctgtgggttcctgtaactgttcctccttgctaccccattcgacctgaggttggaaacttcctctagttgttgctctagccgcaggctgctccacaatccctaacccacccaaacctttgtctaaagcaccttccttacaccctccccagctgtggcatttcggggccctgttagcatccacgtgatgctgctttctacaaatgtgtctatttgtggtgacagcacttgcgctttgctttcttccctttcttatcctacctgatatcccagccttctgcccctcagctacaagaccactccataaccatagaggaccaaaatcacctaggagcttgagagagaaaatgtatttgacatcttgaaaataatgcagtttgctcaggggatttatttctccctcccctgggctctgcgctcagaccctctttgcttctgtccgactactgcaagcaggcagttaagattatttctagcaaatggacttagagaagctgagcatatgagtgatgttgaaatttgacctacacttcttttttttttttttttttgagatggagtctcgctctgttgcccaggttggagtgcagtggcatgatctcggctcactgcagtctgcctcccgggttcaagcgattctcctgcctcagcctcccatgtagctgggattacaggtacatgccaccatgcccggctaatttttgtatttttagtatagacggggtttcaccatgttggccaggctggtctcaaactcctgacctcaggtgatctgcctgcctcggcctcccaaagtgctgggattataaacgtgaaccaccgcgcctggtgagctatgcttattacttagatttctagcagataacatatagttatttcctaaaactctgttcttaacctgagctgtttttgtcatttttcagggttttagggggtgggaacatattacaggagctattaggtgcatgagtgtgagttgcgggcatatgtgagggttgtgtgtcttgtgtctatgcacatgcgcaggtgtgtaagtgggtgtgaatatgtgtgagcgttgcatgcatgcatgagttgtatgtgtgttgcatctgtgcgtgtgtgcaggtgggtatgagttagtgtgagtgttgcctgcatgcgagttgggtgtctgttgcatctatgcatgtgtgcaggtatgtatgactgtgtgagtgtgtgcaggtacagcttctgtattaataagagacgggcaatcactgtgcactgatattgaggggtagggattagagggcaccttgtctatttgggaggtgaaggagggctggaatgagaggctgaaggggtacagaagaggaaggcagacccctgcaggcctcagggacctagcctccctcccttcagtgtcccttcctctccctgcaggaaccagaaaaagtgtggaggtctgaattgcagtctctaaaatctctcctcagtctcacatgactggcttcagttttctcaccagtcctgcaaagccaggccttgaccccttatctaaatatccaaagaaaaaaatggaattagggatcttagaaggaaagagtggggcaggaaatgcaccaccagggcagtgcagcttggtcactgccagctcccctcatgggcagagggctggcctcttgcagccgaccaggcactgagcgccatcccagggccctcgccagccctcagcagggccaggacacacaagcctttgacttcctcctgtcactgctgctgccattcctgttttgtggtcatcactccttccctgtcctcagactgcccagcactcaaggatgtcctgtggtggcatcagaccagaggcccctgaagaggagtgagttgggtgttttttgccgcgcccaaagcagctggctgtcccctgaaagatggcaagtggggaatgatgatggtgcaccatcgttctgcacaccaagcccttctggataggaggcccccagcagtggagggatgggggctgccaactggcattgcccagaggcccagctcctggtcacatagactgacctagcagtgcaccagctacccgaggcagcctgcaggaaaggtgcactcatagcgatgctggaatgccatgaggcccagccatggggttgagaactggaatggagggaaatgtttgcatcctgatgctgggaaacaggagatcagtcctcaccaacgctgagatgatttccctctggttcttaagctcggttctctttctgcttgatgcttgaatctctggtgtctggcagagagtctggtgtctggcatagtgctttgtatgtaggtcatgccagagcatgctggtgactttgcccttctaggactcttttccatttcatagggacttgctgtgaaaccccgtttgacctggatataaatgttagatgtcatggagtcctgttagcatggtgagctgcaggctgttctgcatgagtcctccttgagcctgcatctaatacccactgctcaatcaatctcttttcactgtttcccattgatcccaagtgtgtcctctgtgagccttttcttgacactgggtcacccagaattactcccctgtctgtgtccccatagcaccccacaaatagttcaatcatagcccttgtaacattctggtgcaccagtttaaggacagagccctgtcttattcatcattgctggtggatgaataaaaatgttcaagtcgtaataacggcaatgacaacaatgataaactcaccacttactgaccattggctgtgtgccacaggacataggactgaacatcttacaggtgttatcctcatgtccactctctcagactgcacttctatcgtattctacagaaactgaaggatggaaggtcacagagctggtgggaggggagcctggattcatacccaagccgtgtgcctcctggccactcctatgggtgaaggaaagcaaagggcttagctgtagctgggatggagaaagaggaatctcaggcttctcgtcatattttgcctcaagaactggaaattgatctgggagtagatcccacactgagggagaaggccccagaccaagaaaggatgggctcatctatttgattgaaaacagagaagcttggaagacccaaggtagggcaattcctgaaccgtccagggctggaaaacctgtagcaaaggcctggggagatggggcagaaaggctaaattataacttaggaatctccaccaggagatcagctccaagacagcttccagtttcggcagatggaagggatacttgatggaaaaggagggagggtaagtgtcagagactgctaaatgtctttacctacatttcctcatttcaaactctcacagaacagagtctgaggtagactctagggctggccccattttgcagatgggtaaactgaggttcagagcactatacccgtaagatctttgctcaagaacttgtatgtcccagaccatgcttgaaacctggtttactcacacaccctgctgtgcagacctcctccgttccaaagtggtggcagacttcagtgtgctttgcagactttcaatctcagcacatgctgtggaagtgctagcagtgttgctgtgctaaccctgtggttaggctgatcacagtcctggtgagtaactatggcctgcagccctggcatctgaaagatgaccccttgcctctcctgctgtcctcaagaaagccttagccccctagattattttcaatataaaatgttcatacactacttttcagattcaaatttgcacaaatgaagtgaccgttagacaccactggaaggtaataaaacccccaagcctgccagccatcaggtccctcccagccatcccagaaatatgctcagctgccctcgaaacatctgtcatgctctctggtgggtgctactgggcacctgacattagatcacttctctcccaaagctgcagctctgcttattcgattcttatttctgcctttggattgagtggaaggcagtcatcagtgacagccaccctcggggaacagaaacgatgtccacagtggcaacgatcctccatcttcctgcactgaggcctaatcaatgtagcccatacccagcctccatttaataagctgattgttgagctaaatcccgcacactctccccttgccctggacgcttttgattgacaaaactaatctctcctccacccccacgtctgctgctgcccacatcctcttgcaaatcatgtactcggctgctgacaattagatataagacttgggattcggatgtgggagggttatgaggttatgaatcaattgtgggggctcaggtgagataacaaaccaggggaacccatttcagacacctcgccacagccctcagagcctcctggttgatttatgagttggtaataacctcgctgggtctcctggcccctattatttttcataatgcacaggaaagctttaaatatcagagaatggggaagtgcacagtctgagtgggagggaggtgaggggggatggggcttgggggagaacagtggccaagggcttccccgcagctgattgtctctcctgccccatctccccaggccttcgctgcaggtcttctagtcctggacgtttcaggaattgctttatcttggctttttcaagcttctctgtttcattcaaatagatgagcccatcctttctcggtctggggtcttctccctcagcgtgggatctactcccagatcagtttccagttcttgaggcaaaatatcaggagaaacctgagattcctccttctccatcccagctacagctaagtccttcgctttccttctgtgggtcaccacggggtgccgttgtcatatacccatggaggccagcaagctgatctggccaacctgggagaagaccccaggttgatgacccctggtttaggagtgcatatggcaggatgcttgagggatcactgggcccaaaatcgtatttgctgtgtctggatgtaatgcctcccacctgttcaagaccacgtcagaatgactcagagacctgcctgttaagaagggaaaattatccgctggacaaaagccagtcaaaaagcaggctcaccctgcagtctggaagccagttgagcagcgaggacaggccaaaaaggtgggagggggccagtgagtgtctctcagcctggaggtaaagagctgaagactttacctttccttctgcctgctgtcctcttcccagtgacagccagtttttaataaggaaaaggaggaggctttgaattgctacctaatatttgtttaagtagtaatttgttgagatttctctgttttgttttgttttgttttgttttttgagacggagtctcatgctgtcgcccaggctggagtgtagtggtgcagtcggcttactacaacctccgcctcccaggttcaagcacttctcctgccttagtcatccaagtagctgggactacaggcacctgccaccatgcccagctaatttttgtatttttagtaaagacagggtttcaccatgttggccaggctggtctcgaactcctgacctcaggcaatccacctgccttggcctcccaaagtgctgggattacaggcaaaaagatgtgattttttttttttttttaacagtatcagtgggtgaaagaccctgaacctttcctctaaggcagtgtttgtaaactgcctatatgatgtctggtactagattgtgatgatgttttcaagggccacaaaacaattgaggaaaaatttaaaacatactgaatatacatgtgtgggtgtttatgtattatgatgtgtatttgaatacaactatcaacgaataagcattcattagaccccaactctgtaccagatgtttgtttactccatgccagggacagaactaacagggtccctgctctcttggagctacagtttagtgggcattatgggttgaattatgttctctcaaaaattcatatattgaagttctaaacactagaactccaaaatgtgaccttatttggaaatagagtcattgcagatgtaattagttaaggtgagataattagggtgggccctaatctggtatgactggtagtcttattaaagggaaatttgggccagtcatcgtggttcacacctgtaatcccagcactttgggaggccaaggcaggaggatcacttcagcccagaagttagagaccagcctgagtaacataaggagaccctgtctctacaaaaaatttaaaaattagccagcatggtggtacatgcctgtggtcccagccacttgggaagatcgggagaggcctgggacagattctccctcacagccctcaggaagaaccaacccgttcgacacctggatcttagctgtctggcctccagaaccatagacaataaattgctgttgtctaagccacccagtttgtgataccttgtcatggaagtcatagcaaactaatatagaagaggaaacagacatcgatcaaataattacattgtggctaattccaaactgagataaatgcttcaaggagaaagaaccttgttctcttgacgttgaaagccaaaggaccttgagccagtctggagggcaatgaaggccttcccgagggagttagggctgaaggatgtgtcagagtcagctagagctgtgttccccagcctttttggcaccagggaccagtttcatggaagacagtttttccacggaccagggttgtgggggatggtttcaggatgattcaagtgcattacatttattgtgtactttatttctattattacattataacatataaggaaataattatacaactcaccacaatgtagaattagtgggagccctgagcttgttttcctgtaactagacagtcgcacctggggggtgatgggagacaggaacagaacatcaggcattagattctcataaggagcgtgcaacctacctggcatgcacagttcacaatagggttcatgctcctgtgagaatctaatgccactgctgatctgacaggaggcagagctcaggcagtaatgtgagtgatggggaggggctgtaaatacagatgaagcttcacttgctcacccgccactcacctcctgttgtgaggcctggttcctaacaggccagggaccattacctgttgggaggctgaggacccctgagctagaggaagaggtgggaggaggaagggaaggcacgacaggcccagggagtagcagatgcaaagatcctgtggtgcaatggagactgttgcattctgggaagggaaaggcagtcccaaggcaggagaggtgggggaagaagaagagggtgttgggatggatgcaaccagagcaccccaaaccagaaagatgtttactccattaccttcaactgaattacagtggggtgagggcacctattttgctttctgccctcacttccgggaaatgcgcatcctggatcacagaaaagctgctgggcagaggtcccagtctctcagtgaggcctcaccagactagtagagttgtccagccacaatgccctcctcatttccccttctgtccaacaagctgtctatcggaagatcccagtctaaaagcaccagaagacattttgagtttctctaaggcctaaaatttaaaagctgataagtaacacaaggattccaagttactgctgtctctcccagccacgcagatgactgggttagacacttggctggtatgaggtccctgaaacatgggctctgtgagtagccaatgtgtattaatattaatgcttatgatatgtcaggcactctgcatgggttcattacccctcacagtcaagatgatgggtcccattattactgtcctgttttctttatttttgagacggagtttcgctcttgtttcccaggctgcagtgcagtggcacgatctcggctcactacaacctccacctcgcgggttgaagcaattctccctgcctcagcctcccaagtagctgggattacaagtgcccgccaccacaccaagctaatttttgtgtttttagtagagtcagggtttcaccatgttggccaggctggtctcaaaatcatgacctcaggtgatccacccacctcggcctcccgcagtgtactgttctcttttcatatgaggaaataaacgcacagggccagcagatgacttgctaacaaccagatcatttcagcaaaaccatgaaccaggcattgtgaagagagttttgtatacctggccttattcttaactagacagcacttcaccctagttgacgtatgaagaaatggagatcagggcaggtggtgggtaagggacctgcccaggttcccaccgtttgtaagtgatgtaccatgagttgctctcaagtgtgtctgactttataaatgctgcaccttatcatttcctatgcttggtaagcaagtgagtgtgaaatttgccacgcttttccttggaaaaactcaagcccattgaccaaacaatactacttgaaaatgacactgaacttttcatcactgtgtttctccacctgtgttcccttctgtcttactgccacctactcattgtgctcaccctccaaagcccagtttaacatttcctcttagttaagctttctctgctagctgatcattgcattttttttcaattaaggcataaaagaaaaaaaaaagacggtaaagattgtcctacttagaatatccttccattcatttgcaaaatggagataataatatgctatttacaacataggattagtatagcaggattattccagagcctggaatatagaaagtactcagtaaattattagttcaacagctaataatagtaccaattattattatcactaaattaatgcctctgtttcaggaaaaaaactgaatacatacagaatatcggttttctaattgttttttctttatactacttggaaagttatacagagttaagagacacagaatagtatagtggaaataatatttggcatgaaattgcctggattccatcagtagtagcctgtggtcttgagcctctctgggcctaatctttaaaatggatataataattatcatattggacacaattattgtcaagataacatgcgataacagggtcaagtgcccagctctggcctggtacaccatgggcactcaggaaatgtcactccgccttcataagcattggcctgtgcatgacatctatgtgataaggtggcctgaagctgtcctccccacccagaggtgcagcagaggcctggcaggaatgtgaaaatccaatggatcaagtcataaccttgactgaagagtatggtgagttcactcatggcaggaaccatctgatcattcatacggctccagaaacattttactcaaaagaaagtgtctttccccaacagtcaagattgataattagtttatgaattgcttcatttatcagtactatgatgtactgtataatccaccaggtttcaagttactggaattttgcaggtgatgggaaccagtctttttatcaactttgcataatctgatctgggctcagattgatagaatgctttgggaagaatcaggggagtgttttatactaggatctcctgcggttctgatgcgttaatgggaggaagctatccctgtcaaattctacaattttggaggagcttaaaacacctgaagacaaagccctgaattttatgagtgtctgcctgaaaccagaaacagaaaccccttacagcttactcaacagcgttaattcagcatggaaaggcaccaggaaaagatcactgcgtcttactcccaccaagtaaacaagctaacaaacacagaggagaggtgcaggttggcacccttaggccggactctgggtggacagccctgtcagagtctataaagggtcgctctgaggctccaggagtggcagatggccagagagtggccaactggaggcacactattgagcctcgggattgagcctcccactgtttacccctcaggaaaaagagagctttgagtctcctggccctttccccagagagcaggaaatggccagggcttgaggatagccagaggccgtccaaagttacccataccatctccactttggcctcagaggccagctctttcttctctctgtgctttttaaaataaaaacttatttttctagtgtaaaagtattatatgaatgttctatgaacttcaaataatacagaaatgtaaagaatagaaatttcccattatttgatgcctcccgctccccaaaataacctaaagttaacaatttaaatatatatccagaatttttcctctccatatttatatatatctatacatatataattaatagaacataaatattttacagtaaccctgttctcaagatgcttttccactgtagatgtttaataaatatttattgcatgaatgagccataatttatttattcagtcctctattagaggcctttggtttgttcccagtcatctaataaacatgattttagatataaaagacataattgaaatacatataacacatacagaaacataacccataactgcatatcataaatatatccttaaatatactaataaaacacgcatgcaatggagaggtgttttgggtgccgtctggtgtatatcctggatatccctggaatatatattgataaatcagcctcaaaaagaatgctttcagacagtgttttaggatctgtgggaacaaagggtggccatcctgcatttgttatgttgtttcaacatagcatttgttatgttgttttattaactttaagtccttggcaaagcagcttgactaagataagatccagaaaccagtcgtggtaacaaggcaacaattaatcttagatagaacagaaaaggaatccgcttcaaattctctttagaacaggaaggaaagggtgatcgtgggttagcaggaaggaaggaaagaggcaagaaaggaaagtgaaaaaagaatggaaatgctttctcctgctggtgatttggatgtttggactactcttgtcagatgctacagcgtaatcactgtaaatgttttaaaggacgcgatattatgacagatttccctttctgacttgttcctggggctgcacacacaatgatttactccctgccacgggctggaggcttggccactcctgggttggtccaaggaagcctggaatacccaatgcctgtgagagtgagcacgtccccctgtctctaggtgttgttgcttgtgctgaaatggagtctaccaagcattgccatggcatggaagggatggtggcggagtagatgccactgcagattgagtgcagtgtcccaggcagccaggggcagccgctcagcccttgcctggacctgaggactgttgcatcagtctccagatgagacagcagctgtcatggtggctgaaccagggaaaagaaactccactctgtggtctccatggggctagggaaaaaaggaaatgggtttttgtgattttcccttctttagaaacaaaagtgcttaaatgtgattctttagctctgtaaatgcaaaccacggcctggtggactggggagaacaattaggccaaaggctgagcacaggaagccaaaagcgggtggaaacccagacaacggtgctgagccgggggttggggtggttggggggagcggatatgatagcaaggaaggagtttcaatgtgaatgaatactaattagtgacatggatattaatgatgacagtaattaacaggggaaaggaagggctgtcattgtcccagggtgagtaatcaatcttggcaggtgataaataatggttcagcaagctcagcagaaagataatccgcaggcctgggggagaactcagctaatgcaggaaacctcacagtttctaggcaacccacagaaaagaactattttttttttcttttttgagacagcgtctcactctgtggccaggctggagtgtagtggcgcgatctcggctcactgcaacctccacctcccgtgttcaagcaattcccctgcctgagcctcccgagtagctgggactcaggcatgtggcaccacgcctggctaatgttttgtattttaatagagacggggtttcaccatgttggccaggatggtctcaaactcctgacctcgtgatccaccctcctcggtctccaaaagtgttgggattataggcatgagccactgcgcctggccagaactatttttcttttgaggaaaaaacagattagagtatctctcccacccccagcttgggactacagttcttatttgatttctgctttgttcttcatttcctgggacaaatgttgaacttgtataacttggaggaaagggacacacaggcacatgtacacacacacatattcattctctctctctctctctctctctctctctccaagaatacgaatgaatacgagtgtttttgatctaaagtttgactcacagatgctgtccaggagtagcaagagtgaggagaagcctagaagtgctgcctttgaggttggcgcggggaaactgcaaaattgcaaggctgtgtcggcagaactggggcacacaggaggatgaggatggccctgggggtcccactgtgcagggttacttcacctgccatggacccagagagaaacaaaatgtctaggctttctgtcctgtaccagtcccacttctggccaccagtcacatatctaagaaaactgatttctgggaagagggcaatcctcatgaagcccctctgctggatccccaggccttcagccaggaatccagcccaggagagttcttggcacatcccctccctctcaccaaagcctcagacccacggtaggactctgatatctaaaatgtctccccttgcaggctgtgttccatcaaacaatttagaggtgacaaagccacaccttcaatggtctgcactggtttaaagtgagatctttgggtggcaaaggtagattgaccagaaattcagaaccttccagaaaactgaactcctctactgccatgtacacagtgctgctctcagaacattgtttgcgggtcacattttcaaagagaggcagacagaagggaacttattcagaggattgggaacatatggtgaggaactccaggccacaccctgcaaggaagcagctgagggacccaggcctgttgcacttggagggaggacgtcgctggtatgccgcaggactgtctgaatagctgaagggctgtcgcacagagtggttaggttggggtttgtttttctatcatcaaatggcaaaactgaggccaaagggaggaagtcagagaggggcaagtttctgttcagataaatcaaggctgatttaactgggtcaggctgggtaggggggagtttgtgagtttccaggtactagggattctaaacacaggttacagcacctcttgtccagggtgttgtgaatgggacatgtattggctggggttggagtagacaagctttaaaagttccttcagggccgggcgcggtggctcatgcctgtaatcccagcactttgggaggccgaggcgggcggatcacgaggtcaggagatcgagaccatcccggctaaaacggtgaaaccccgtctctactaaaaatacaaaaaaattagccgggcgtagtggcaggcgcctgtagtcccagctacttgggaggctgaggcaggagaatggcgtgaacccgggaggcagagcttgcagtgagccgagatcccgccactgcactccagcctgggcgacagagcgagactccgtctcaaaaaaaaaaaaaaaaaaaaaaaaagttccttcagactcttaagatttatattcgttaaggtaatactagataccaaaacagctaagtcccaaatttcaggggcttaacacaacaaagttcagtcctttcagtcctcaatcaagtcagagccccacatgggcgtaatgtccatggttggaaccgtggctccctgcctattgtggctctgcattcccccaggtctttggagtcccccacatccagccagtagatgggattgaaaggggcagagctaaggagagccatgtaggagtttttatggtccaggtctggaagtggcatatgccatttctacccatattctattggcagaactcagtccatatctaagtgcaggggaggctggaaatgtaatctagctatggcacagtgaggagaggaaagaggtcttggtgaatacatagacgtttctgccacaaatgcagggacacattcattcaggataggcctgtgccggaagagatgagagttttgcaagaacctatgaggtcacctgtgttggtcagcccttgtaattgatggtagggagctgatgaggcctccttcttcaagaaatggtctgggggccaggcatgataaagcttcacctagcacgtctcagggaagtcctctatagacacttcctagaaacatgaatataagctcatcctgcatcatcagaagtgagtgttttttggacaagaatggaattgtaactatggaagtgtactgaagaatggaaagggttggttaggacaaaaaaaagtgcccatattatcctgctctacagtgtggactgtttggaattaggattctcttaggtaaacatgtttcttctgccacagtgttaaacacccaggaggtcttcagctgaaattgctttatcgttgcaggtactgacattgtgcagtggcttatgaagaacctttccattgaggacccaggtacttgacctttgaccccacccttatctcccctggtatcagtaaacatcccataaccaagttccaaactagattcccctgccctcctgagaactggtcttgtaaatgtgaattccaagacgtggaatcactctatttacaaataaaattaatttattttctccactgaatatttgtctttaaatttaaatcatgctttgaggaaatgagcaactttttagaatgccaaagagcccaatacaataatgtgtgaaatgagttgaattctcattagctgcagcaattaaagataagttgtagcactgtcactgaacagccttctagagccagctcttaaaattagattgcctgatccacaattaagatgtttaattatttgctaagactccctctgttttctgcttctgcaagaagtgaaggaatgattttttttcaactttaattgcgcatttcaattaggaagaccttaccaggaaaacaacaacagaaccctggccaataaaacaatttcccagtctgttctcccaccagaaaataggcagtaaaatttattttcacagtgtaattaggaaatggggggggtgttccagaaaaataaaaattcaagataagtaaagcttattcccatgtgctgtcagttaatacttttccgaatttattacatactcctttgccttgattaactgagtattcttgatgcctgaaggtcacatttataaagatccactaatacactctgatgttcttaatggacattggcgtgattagacttacctgccccaaattaaatggccctgaaccacaatgctttttgaagatttttttgaagtgcccattctgcatccgtgaccttcagctgtgagtccctgctggaatcggtgtgtcagcttggcactcctgtattttaacccaacatttctaatctgttgactgcaaaacaatacagtttctatgcagttcaattatatacagttgttagaactctgagtgccagaaaagcagatcattcatagaagtggcccgagtcttttcacccccttgattagtggctactctcacaactagtgaaaattcttaattctagtcaagttcttgattcacagggaaaaaactataaatgctaaccctttgtaaaggatagaacccaaagcaactcactatgtgttgtccctgatgcagcctgtacttctgagtgtccgcttggaaagcctggactgaatcagcatctacctgtttagttacatttatctaaagtcagtatttcttgtgattataatgctaaactaaggaacgtgtttcctcatggccaccttttctcttccaagagcactggtttctttgcctcctaaaataatcgttgtatttctgacatatattttattattactattatgagaaccctaaattggcgagcagtatgtgagaatgagcttcaggaatcctccagccctggcgtgagaagcttctgtgaagggtcctgaatgatgagagttatttctatgaaaatctgttatactctgatgcccttgggaagacatcatggtataggggcctgtttgggcttctgagaagtggctgaggagaagctaagaaccatttgtcagctgggaatagtctaaggggggagatgaggcaaaccgaggccttgggaaacagtcagatccagcatctgcccctctctcccttctttttcccatcagtcgatttcctgtggttattttttggtttttgaggcaaggtctcactctgtcacccaggctagagtgcagtggcacgagcatagctcactgcagccttgacctccctggcccaagccatcttccacctcagtctcccgagtagctgggactataggctcctagcaccacatccagctaattttttgttttattttttgtagagatggggatctcactgtgttatccaggctggtcttgaactcctgacctcaaacaattcttctgctttggcctcccacagtgcttggattacaggtgtgagacactgcacctggccccattggccaacgtctaagcaaaaacatttttgctcagagaatgaagttagagtcttagctccaagactggtggcatgaaagtcaccttcctacaggattttgttctttcttctctggggaaggagcaactgctgatgatgaaacttctgttctagctggactcatggttcttgaagcatatggactttaaaaagcaaaccggccagacatggtagctcatgcctgtaatcgcagctctttgggaggctcagctgggaggactgcttgagcccaggagttcaagaccagcctgagcaagatggcaaaaccctacctctaccaaaaaaaataaaaaaaaaattagacagacgtggtggcatgtgcctgtggttccagctacttgggaggctggggcagaagtatcacttgagcccaggagttcaagtctgcaatgagctgtgatcatgccactgcactccagcctgggtgacaagagtcagacctgtctctaaaaaaaaaaaaaaaaaaaaaaaaatagcaaattggtcatcactaagcaagtaaaataaaactctattcattccaattccaccagttacatgtatgtttctttcaaaggagaataggtggttcttgatacgcaaaacattgcattgtattcaacttcttgaaaagtttgcaagtaaagccaaaacaaactactttaaaaagtcagagctcgtgaaattaataattgctagaggctccctgagcacattaacaatttccatgtccaaaaattagttttaacctgtaacagtacttttggatttgtgaaagattgtgtgtggtagaagcattgaggtttgttattttttcttagctctgctcaggataaatctaaattcttaacttttttttttttaattgagacagggtctcgctgtgttgctcaggcttgtctcaaactcctgagctcaagcaatccgcctgcctctggattacaggcgtgagccaccatgcccgacctatattctcaactttctatgtgcatctatttatggctggtgccaaaggaacgaaggaacagattgactgtggcaaaaatataagtatttctatcaggttagcctctctctgtcactgcccacttcagtgtccttcctctaattttcaaaggaagtgaggttttcctctctgtccataagagaagggtgacacccttctcattcctgatgggactgtcatattggggaacgcactgggagtcctacgtctctatgggcagcgaggctgcattcttactgctggggatgatgaaactggtatgaatcagagctgctagcacttacggagtatttgacctgtaccagacaatcacttcatgtgaaatatctcacttagttaaatacaggttcttctatgccagaacttatgcccttgaccctgaagccagactttcttctgaaggtcagggtgaggaggggttaagccatgtcagactctcagaggtgggattcagacaagtcccagacacatagttgccctttccagccattggcatctcccctcctcacccccacactgagcaagggcaattgtatcatcaacacagacatctgggggtgatgacagttgacttctggtctcccagcttaattttcagccaaataacctgctttctaattccttctctctctatgcactgttcttacagttgaagcaatacacttggggagccttatcgctgcccagggctacatctttccaatctcagaccatgttctcaccatgaaggatgatggcaccttttatcgtttccaggtaagcctgctggctcctcctcctgaagaaccttttcttcacaacatcatctgatcttaggttagaactacaaagaaaacctagggatatctgagggagtagccctcactcctcatcagcactgggaaagccaagagaacttttctctgggccactgggtgacccacttagagaatagtaaaaggctgtcattgagagcctaccatgccctgggcactgccttagtcccttgggctgctacaacaaaatacctaaactgggtatcttataaacaaacaaacaaaaaatttacttctcatggttgtggaggctggcaagtccaagaccaaggtgccagcagattcggtgtctggtgagggcctgctctctggctcatagatggcaccttctagctatatccccacatggcagacaggacctggggcttatatcagacctcttttataaaggcactaatctcacctgtgagggcttcaaaggccccacctcccaataccatcaccttggggattaggatttcaacatgtgaatttgaggaggatgcagacattcagaccatggtagacactttgtacagatttcctcatttattctgaagagcacactttagggggtaaatattacccattttacagaggagaaaactgaattgctcaaagaattaaagtgtcatttagtaaatcctggagcagccttcatctgaacctaagtgagcctgatagcacagaccttgatctttctactgtctcatgttgccttctcggagtgaagtttctatttgcgacctaatcaccctccccacccatttcacactccttctcccagatccttccgtagagggaatgagggcagaggatatgggcttgaatcaaggtctaaccaaagggtgtgggagaagagttcttcagactaggttaaagggaggaaaggaacatgggcttaggtgcccagtaagttatgccagcctgacttttgtacttagacctctattgtctcaggataagaatatattgccctgtgaacaaaacttaacatttttgcatttgttttgcttacttacattttgcttctcaatgcctaggttaaaatgttgactcaccttagctgaattagagaagaggagagaattgtggggtagcatcagcaagaaggagatgggggagagcctgccatcagggaggctcctccctgggtgtgggagggaagcgcaggcatggcgcgcccctgagcactaacacccatgctcctttgcaggctccgtacttctggccttcgaactgctgggaacctgaaaacactgactatggtgagaactgaagccactgggaactctcaacttcaacactgtgtgtcacttctgggggtgcagaagacaaatgcttggtgtgggccatggtggtacatggggaggagggtcctttctgcttagtcctttctcatattgttgctatataacaaatctcctgttccacataacagaggaaggcccagcttactgaaagatgtagtccttggaggggaagcaggagagggaagaaaaatcttatcaagggtggtcagtatgttcatcttggggccatggagaaccaggatcccacagcaacactatcagatggtgacttttaattgttctttccagggatagggcttcagggagggctggatcaaggggctacctcctcctggccctttctgttctcatagacttgtcaaaacttactaagaaccttttggtgttcttgacagttgcaatttagaaaagagacagagaccagggaggagtatacagaagtcactctggactaggaaaatagagtgggtgaagttgagagttctgtctctctagacagggacctacaagacttctgccagatattctcagtggagattatttaatattcctatatgccaattctctgaagaagttttattatcgctatgcttaagagaaagaacctgaggcccagaggggccacaccctcacactaccacattgtctgaatgctcccttgattataagcctcttgagggcagaggctggtccagcttatgcattctcatatctccagggcatagcctatgtctgaggcagaattagtgctcagtaaatatccactgacagttctggttctttattgaaggtgaccaacagacactcactagagggagcagaacttgaactcagatctgagtggctccaaaacccatacttctttcacggtcccatgtgtgacatgcctgaaggttgtagctgcagcactgcccctttgcatgcatccttgctgctgactcagctgctgtggcagtctcatctgtggctctccttgggactgggacactcaatgagacctgcagcttctttgcagaattgtttaagacaagaaggcagatgcagctgtggtgagtgggagggagatgtgcagctgggtggtgatcaggggagcctgtctgggagacccatgggataagatacaaccttggagtcacacgtttgagcaagaggaaaccaacaacagggagccaagctgaggatggaatacaagcgagttgtacctactaaggctggagttgttccatggtcaagtgtggaggacgtcagtcatgcagaagggcaggctctggggctgtctgcttggctatccacaggcaccactgtgggccctctgacactgtgctgcaccctaaccaatgtgataagtggatccaggaagacttccgactgcaagtgagagctgcatttgaccgctcataaaactagtgcttctggggctgaaaagactgctcatgaaagcccaactcagaatttgaataattatagctcagttccatgcagcaacgtgtgcccttgtgaatgtgaaaaccagtatttttccaggcagtggagagggtgggaggatggtaagaccagatacctgggcccaagtaagattaaaatatttacttccgtaaagcttagggcatcttatgctgcatactaaagggcatcatctccctgttctacaggtgttcttcattttataattttaattgtgcatcatgaacagggagagaaataatagtttgtttcaggctctcattaaacaaaaattattttaaattcctgtgcctcaatttatggcaaatcagagggagaaatcaaggttcaggatgcacaagtgttcaccagggaccaggcatggtggtgcatacctgtaatcccagtgactcgggaggctgagatgggaggatcacttgagcccaggagttcaaagctgcagtgagctatgattgtgccactgccctccagcctgggtgatagaggaagaccctgtctctaaaacaaagaaaaaccagtactccccagggtttccaaagcagtttagttagaaaatcaggatgtatttatgaagagagaatccagcacaatgagcccccaggatcaacccgttccactagctgggtgatcttggcaaattacttaacctctctgtgcctcagagacctcatattaaaattagagtagtaatggcacttgtctcctagtgttttgttaggattaaatgaaatgcatgtaaggttctctgagttaatacggagtggtggttggtatcactactggggtggggtcggtattattgccactgggatgttggttgatattattatgactgaggtgaccgtctcaccaggaagcatgtgaaactgaagctaagaattcaatatagtatgatttggactgatgaagtaccagaaactttcattcaattgacaaacgtttactggtccctactctgtcaaattctatgtcagagatttgaataagtcacagcctttccccgcaagcattccaggctgggagaggcagcatgatgcagggaagaaaggcatggtgaggatctggcttgagtattcaaaggttttatgtgatgaatgactgagaaggctgaatagcttgggaggggcaggtttataaaaaggccttggcagtcaagtagagacatttagaatggattcagcagtttggggaagctattgtgggtccccaacaatgaacacactttcccaagttttttccctacttgggaaaaaattggttcatctataagatgggggtaataacagaacccacctagtagggttattatgaggattaagtggactgtggaagattaagtaagggctgtgacttagtcaaatagttcctgatattcagtgggctcaatggaagcagtagctgctacgatggtgatttttccagcacctaaaacggtacttggcccataggagacactcagtacatttttgaatgagtgactgaatgaataaatggatcggtgaatgtcatagaggaaactctgcactggtcctcgattctaattccatctccatcactaactagcccttgggtccatcacttcatttctctgggcctttagtttccccatctgtaaatgaggggcctgtacttgatggttgccaaggttacctccagtctaaaattctttggttctaaaaagtcatcagaaagtatgaggaaaatagagaaataagtgagttataggttccctagtttaggagattgaggtacataatgatgttgctagtaaaggcagaaagtaaagaaaggggtcagtttcttcagtacattgaaactcgataagctcaatattttttaagaaatttaattgcacatataatacatgaatgtgttccctttatacaatttttaaatatgtcccagttttgtgtggtgacacatggtgaacttgagatggcagtggatttctctgagtgagatgtgagatataggtaagggtggaatgccagatgtaaggacaaggaaatagaaatttttcggtaagaaattaaatatccaagagaaaccaatatctgagcttaagacagttcttccagatgccctcttgtagggctggctattgtcaccagtagtcactagagtcggttggaagttagagcaagccctagtgagggcactctgggatgcagacaagccccagggagttctgtgccaagaacagccacatcccaccttcctcattgtggtgaaaagattccttgtgtgactttaggcacagggacattagctagtagcatgtgaccctgtgactcatggccatcaggagtggccccagctctgcattccatgcatgataactcacttcacaaccccgctgtcccattttgaccccgcttacccatttggacatttcttgggatgactctgcctgcataaaacccacagtcaaatccaggttagccttttctgagttttacatttggccagtgcaaaatcctgtccagggcagcattgtcaaagcagctgccacctccactgacctgcactgctcaaaggtaatcatgacctggcccagtcgagctggtgacatgtcaagcttcctgcctgaggttgtccctaattctgccaggggtccaagagactgaaggaggtactttgtgatagatcggacacccctttatcagacacagtgaagcactatagctgcttggttcattggaaaagttggtaagtagaaaatcatttttaaaacgacatatgcacaccttaagcacctcatgtaaaggtaagatatacaaaggaacactcatttgacagccttgtgaagtaggaccaaagtgttctctttgattatgagctgaataattttagtttcttaaatcaaccgcactcaaaataaactaccctgttttggtatctttaaagtgcatcaagaatgtaaagacatttttgtagtcttttgtatattggcccctcctagatttttattatttttcttactttttcctgttatctcacctgtatcaaattcaccagcaattgccttagctaactctccttcattaaattgttccaaaccattcaactgagttttcatagaagcaacactctctctcttttcacattaatttcattgagacgtgtgatatttagtgaacttgtgtgattaaaataacagatgtgcctgatataagcagatttgggaacaaccacaactgactcctatgagcacacaattcgccgggtggaagcagaagtgtgggcataccagagggtaggctgctagcttccaggctccaaaatgtcataggtatcagtaaatttttcagaacaaatgaaggaagttggttgatccagcaaagagttgactagagatctcttagtaaagagatcttgttgtccaacaacaaaatgatcacaggttctctctggccctccctcttgatcattctgttgttcatttatttatgccattcatctactgttttccctggattgttccacttggctctggagaaggaggaagacattgaagaaggaaaggtagggagaagaagtgatgatgaaggccatgtttgaggaagaaacagggaaaccaggggccaagaacctttccttagcctgagttgagagacctaaattgtcttccctttccatagcctttttactgcacctgacaagacaggctatggtgctagcaacagggatgaaagctgagcaggacatagcctctgcccttaaagagacttcagcctagagcaggggacagtctagtaaatacaggatttcagtgcaatggaatttagttccatggtcaaggacatgtagatgctatctgaaacaccaacttgggtcttcaaagattagtaagaggttgccagatagagggaaggagagaagagagaaagactttcctcaaaaaggacacatatgcaaaagaatgaagctgaaaagagtttggtggcctcacagtgcctgcatgagggagaagaagttgatgagataagcagtgagcagatcataaagaaccatatttgccatcctaacgagcccaaccttacttctgaggccattgaggactccaggcagagcttttaggcactggagtaatgtggtcatgtttgtgaaatatcactctgagtgtaggatgttcagggtgaagcagagtgaggaggaagaaggggagttgtcaggattggaatatggaggagtcctcatttgatcatgactatgaaaggatttatagaggtcaggggtcatgaggtccacttagaaaacatatttttcccaggacagtgctcatgaggtccacttagaaaacatatttttcccaggacagtgctgggcacatagcaagggtgggtgggcgggctgtctggatggatggatggatggatggatggatggatggatggatggatggatggttgggtggatgggtggatgggtggatggatggatggatggatggatggatggatggatgggtgaatgggtgaatggatggacagatggatggatgggcttataattccattgtgctgctggttttgtacatgttgtcatttcctttcttccctcagccatctatctctgtaagaggacaatgcaaaataaagcaaggctggaactggcagattatgaagcagtaagtatgattattttccaggatacatataagaagagagtaaaatcatatctgcagctccgtctaagtttattttttttttcttttgtcccccttttgtccctttcagacagtggaagggaagtatcttctatttctcctcccttgttctcagctcctctgaccatcacaataagatggtgtttttacataaataactcttaaaactcaacaataaaaaaataagcagctcaacttaaaaataggctaatgacttaacagatattttaccaaagaggacacaaggatgataaataaacccatgaaaagatgtccaatattattagccatttaggaaatgcagattaaatccgtggtgagatactgttacatacctattagaatggccaaaataaaaaatactgatgataccaagtgatggtgaggaagtagaacaactggaactctccgctttgctagtggtaatgcaaaatggtacagccactctagaaaatagcttggcagtttcttataaagttaaacatacacttaccatataaccaagcaatcccacttgtatatacataccctagagaaatcagaactcatgttcacacaaacacctataaactaatgttcatacaagcttaatctgtgataaccaaaagctgaaaacaacccaaatgcactttaacagttgaatggttaaactaactgtggtacatccatacaatagaatactactatgcagtaaaaaggaatgaactgttgatacacacaaccacttgaatgagtaccaagaacattatgttgggtgaaagaaaccaatctcaggccagccattccatttataggacattcttgaaaagataaaactatcatgatgaaaagcagatcaatgattgctagtggttatggatggggtagggaattgttggaaggtgatggaactgttctgtatcctgatcgtggtggtggttgtatgaatctatacatgtgttaaaatttacagacttgtacaaaaggaaaaaagtcaaatttactacataataacatttcaaattaaaattttaaattgcacctttatacccactctcctgtgcttagtagcagaggcagaatctaagggtaaaattcaattcagaaaataagacaagatgtgtgtcacatgaggtatctacttcccagctttcttaccttccttctctatctttcttcataagatgagacttcttgcaaaaattagaggccccaccaccaaacttgggtccattcccatttgacagagcccagaaaccaaagcacttgaaaactcatagatcatttaattttttttttaacttttggttgcaaaatttttcccccaaactgaactttacatgggtcacagagaatgggagaaactggctaaactttcttataccttctacttccctctccctatatgtcttccaaaggatgtgctgctgagccatgaatgactgaagggccagcagctatggaaggaggggcaacattaaggggagcagagaatccttccctggatagtccagcattaacagcatcttcagacccacccaccgccaaagcccttcctgcttttactgcctcagtctttcaaaacaagtgtgaggccccactctgccaggccttacctctcctaggttcatgttcccaagcctaccaagcctaccaagcctaccaagccagctgggccatcgctcccctctctacagcccaagtgtgaatgcgcatgccattggggagcaggacgtgtgcatggtccttcacctctttgatcccactggcattgtggacctgtgaatggggtgcagggggccagaagaggaagaagcagtgcagcagtttgtccagagccctcaggacctggctagagtttgcattatcagatgatcatatgttggaatattatgatctccccagataaaccttggcctggttgttctgtggctctggacatcctgggagcccagtcatgcccctgtctgccccaatgcccagcaatcacagcacccctccttcaaaagactgctgttgtactctttgtgcgcccagtgcaagtagctttgacatgatgacattacctccttaacacaaccttgaggaaaggcccagacagtagaagcctggggcccctccctcctgtgtgtctcttccccatattttcaatgttttggaaaaaggtcccatacagaaatcagacagcatcaactcctgctgtatttgattcaatttctcttctcttgtcccttaatgttctgctctggtatttgtaaagaatatggcattgaggccaggtatggtggctcatgcctgtaatccccaaggtgggcagatcacgaggtcaggagatcgagaccatcctggctaacatgctgaaacccgtctctactaaaaatacaaaaaattagccaggcctagtggcacacgcctgtagatccagctactcaggaggctgaggcaggagaatcccttgaacctgggaggcggaggttgtgagccaagatcgtgccactgcactccagcctgggcaacagagcgagactccgtctcaaaaaaaaaaaaaagaatatggcattgagatgtgctctcaggttgaagttctgcacaaaaatgattcaaaaccaaaaaagcattttgcttccaaaatgcaataatttttttatgaattttctgattacatattctttttacaaaaacaaaaattcaaacagcaaagaaaggagagaatataacctgtgactccccctcacctaagttttttctatgcatacatttttttctttacaaaactatatcagaatcataacataaacattcttgtggcagctgcttctctttccccagtcattatactgtaggtatctcggggtctttaccatgtcagtaactataatctacgttattgtgtttaatggctgcctagaattctatgctatgactgtgtcacagttgattgacatttaggcattaccagttttgcttcctatgagcagtggaagagtcacaaagacagtttttagaagtactttcacaccaagcctgggtgataactgtgagctcatgtgtggtactctccaactgaagctccttttatattaataatccattaatgagggtaatcaattcgtgttggcatgagctctatgaaaatacatagcataatatgggctccggccttgcattcatcagaattaggaggatcattagggcgcctgtcaaactcccctcctcgccgcccatcctcatgttccattaggtaactctacagacttagagaaaatacttttctttttctctaacggcagccctcaatgacttttctttctgttttgggctttttctttcatgaacatcacaaacgtagacactccgtttggggcacttttttttttttttttgaaacagtttcattcttgttgcccaggctgcagtgcagtggcaggatctcggctcactgcaacctccccacctcccgggttcaagcgactctcctccctcagtctcccaaatagttgggattacaggcacctgccaccatgcccagctaatttctgtaattttagtagagatggggtttcaccctgttgaccaggctggtctggaactcctgacctcaggtgatccacctgccttggccttccaaaatgctgcgattacaggtgtgagtcaccacactcagcctcggccactttgaatcctgacattagaaaaagcatgaaagccaggtccctttggttttcctttcctgtgtccttcccagctccccactggaagaggagtcctgagaaatccagcctttggttttgctcctggagataccagcaggtggcaaagactcgttaattccccaataaccacagacaattttcccgattttcagcaacctttgaaacaagtgctgtgtgagttgcattcttgtaaaacaccttcatgaagagaggaatcaggtgaaccatagagacttcagacttaatgggtgtgtaaatgaatattaatagttcagctctgtacggagggtctggcgcaaagtcaaatgggatacatgtccaggggatttaaagcaggtcttgctattttgttggaagtaaccaaaattgatggatgccttataataagcataggtgtcgatgtgctaatttacgatgattaatgccgccttgttgattttcatttctcattaggaaaacttagcaagactccagagggcctttgcgaggaagtgggaattcatctttatgcaagcagaagcacaagtaaagtaggtgaacttgatagagaccttttcagagaggaaaagactctggaatttggaaatggtgtgaaggtgggattgtcaaagtgaagtttccagatggcgttagtatttctaatagggcctgagagcaactgagtagaaattaaagtcaggatggataagttttgtcttcataatcaatgcttctctaaagcaatttcagaaatgtgtgtttcagcagacaagggagatcctcccaaaggtagaactctggttataagaaggtgtacctatttccccaagagatttccagttattttctgtgttcaaaggctgaaatcccattttacccgttggactggagattttgtcttcatgggaaaacaggttggagttttaggaagaacaacaagtagcccctgtcttcttttccctgacaggggaggagtttagaaccaacagaaaaagaaggcacagaagtcagacagttggagtccaaaatatcagattattacattaattaaaagcaagagtaaggctgggcatggtggctcatgcctgtaatcccagcactttgtgagaccgaggtgggggtggatcacctgaggtcaggagttcgagaccaacctgactaacatggtgaaaccccgtctctactaaaaatacaaaattagctgggcatagtggtacatgcctgtaatcccagctactcaggaggctgaggcaggagaattgcttgaacccgggaagtggaggttgcagtgagctgagatcgtgacattgcactccagcctgggcaacaagagcaaaactccctctcaaaaaaaaaaaaaaaaaacaagattatagggcgtgacactggatatgtggccccaggtgaaaattaaatctgcccttcctgtacagaggtgtgtatctataggcctcctctccccagcatctccaccccaccccaccagggcataggtgacccctgtaagttttctgcatgcagagagcagctatcctgagcacaggctgacccagatgggggcccagagagggagagtctgaacttcttcaatttcttctttcaagtctaccaattagttaagtcatttttcctccacaaaggacaagagatgaaaggaagaaaaaagttggaagggtttttcccagatttttttctcctggatacatagtggacatttcttcctctctaaggaaacatgaggaatgggtactctatgttccccaccccacaaacatcgttgtcaaccagatccatttaattctgggaaacagaatgattggatctggatctcccctgtccctcccagggatgatgtctaggttagccaggatggttagttaacaggagaagtgggacaggagcaggaaagggatgctaagctgggagaatgggactatgtttcctctgggtaccacctgcatgtgagcagccgctgagtcttcagagcaacattcctgggcgatgttgcagcccgtggcctggagccgggtctcaggctgtgtgggtgtagactcatcacagctatggtcacagttggaagtgacctgaggccatctggtccagtggcctgtacactgccattgctgtgaacctccccccacagtctctgcctttctcctgtccatgatgccagccacctcctgaccacccagcagccccccggggataggcgggtaccaggcactgggtgcccccgaagaggtgcaggtgggagagtaggtaggatggaggctgggattcaactggactaaggcagaattatgcctgtgtactcagaagccactggaaagcaaagaggaacgctaatttgttcttccagaatcaaacagcatcacaagttataaacagaggggaaattgttacttcataaatacatggtatttctcgattaacttttttgattaactctgtgattacattataattgtgggccacctaagtacacagtaattatcacaaaaatcgcagggtgattatgggtttatttcagtccagtaaagtaaagcgttcccgagagagccgagacctaggagttacacggcaattaatctgagttgctttttacttgaaataaaatgaagtaatacatgcttttttaagaaaaaaaaaaaaagaaagaaaaagaaaaaacctcttatctatgctgcagatcagaacaataagaatctgtctttgtcacctgcaatttccctcttgcaatttgtgcctcccccagctgaggccagtgatatttgcctcctggatcttgtctcattctagggccattattctgcctttagaaagccagatggtgtaagtgacttataaaacacataattgcagcattttaaagacatttatttctactgattctaaatctaaagcaaactttcaaatttgaacatggaacactggcaagatggtggttacattccatcttataatttgtatatgcagtatcctttttgataagggggcatatcaatggataattcagtttttaataatccaaatcttaatacttcagatgaacagctgcattcttattcttcccttaggccaccatgttcattacacatgtatggcaatctgtaatctagcctaaaacaagttctcttaccatgtgtggaattcctgaggttttcggggggggaattatacacccctatttcacagctctgcagagagcaggcaccatgcaggtaccaatggccttgtgttcacttagcccctagcaacaggagcaaacgctggagcaagtgtcagaagggaaaacagaatacagagcttcttatttccttcctctctttactctttcaggattgaccggaaaaaagacaagacagaaaggaaaattttggatagtcaagaacgagccttttgggatgtccacaggcctgtggtgagaaagcgctactcaattctctagatttttttttcttaattgttcatttttatctctataaagaaaagaccgtctttagccaccaggtgtctcattcttaagaaaatcgctcagctttgtggaactggtttcgccattcatttatataatctcagtaaattttctggaatatatgtaagttccaccttttaaaaattattcattcggccgggcatggcggctcacgcctgtaatcccagcgctttgggaggccgaggtgggtggatcacgaggtcagtcgatcaagaccatcctggctaacacggtgaaaccccgtcgctactaaaaatacaaaaaaattagccgggcgtggtggcaggcacctgtagtcccagcgactcgggaggctgaggcaggagaatggtgtgaacccgggaggcggagcttgcagtgagccgagagcgcaccactgcactccagcctcggcaacagagcgagactccatctctggggaaaaaaaaaattattcattcctgaaaatatggaattgcaaatggagaagctatgggaattccaccaaaagacctttgtgtcccgaaggtttacattccccaaattaacaatttccatttccactgctattcaactctgaatcttcaactattctctgtcgaatacggttaattcttgttatccatggcagttatgttctataaagtctttgcaaacactgaattagcgcacattgaagcatcactcccgtgggaactaccaagctaggtccccgtgagcctgtggccacaacatttttatcagctgatcgatacataaccttttaaatgtgtttctgtataaagacagcttatgtaatatatatcattgattcattaacattaaactcatggccaacagcactgttgctcatgcctgcatgtttatttcctcctaaggcacatcagagaatggtgaacagcacttcagcactgtccttggggccattttaaacagcaaaatcaccaacaaaaagtacagaaatgcagaaaagttggcactaaattagccctaaatagaagggtctgaaacaaaaaggcaggacgtcaccttgttcaatttcagtgggaaacacacatatcaggctactcaaggtacaactactgagtaaggagttataaatgaaatttagcaagcaggcaaattcacaaatgcaaaatttgtaaataatgaggtttgactgtatttctgatttcacgttattaaaacaaatcttgcattttcctcatgaaatggaactaaaaaataaattattggtcttcttaaaatttgattaaaagcaaaaaataaataaatagctactcatcctgatatcgtggagtctttttcaaacggttaagtatgtaaaaaaaaattttaaggactgtgtctgaggcaatcttgccacttaaatagctaatttgctcttagaaactgtacactataccctctacatatcatccttagattatgaggtaagcttttctagatcgtatgggaactccacagaggaatgcatattatggcaaaatggaaaaaaaaatcatgcattgtctgtaatggaaaaagataaagattggtcctgatggtgtgacatgggctaaattggaagtgtaattttcacgtagtaatttatatgatgtgttttttttttctcagccaggctgtgtgaacacaacagaaatggatatccgaaaatgtcgacgtttgaagaatccacaaaaggttaaaaaggttcgctagtttagctgagttaaaaattcctgatgtgaatagcccttccagttctagtactattcaaatagtaatttgctacttgtaattctaccaccttttgtcatttgaaaccataaccatttcacaaatattgattgagcagctgatgcatgcttggcgctgtgctcgtgctaggatacagtggcaggtcctcatggagcccacagcctggcaggagtaaaacaagccaacaggcaacagggccatgaatgctgtgttaggagaggtacaggacagttgaggagcccaggaggggcagctaagccagacctggagtgggtgggggtggggggcttcccaagggcttcctgaaagagggtcaggtgttctgaagggtaagttgcagttgtcctggggaggtggcagggaggggaggaaacaaaaggagcaagaagtggcaaagctcacaggtgaaagcaagctttatacttagaagcaaataaaagtcttttttatggtttttttttttttttttttttttggatagagctggatcacccaaactcaaaccaccatcttgtccaactgtgaatgacccagtggtcacttgtgtttcactttactcaaaggagtagtggtcacagcatacccgagggtgccatgctcagactcccccacgattcatatgtcccaccctctccacagcaccagggacaatattgcaggacagcatgaccagactccgtaatattaatttccaaagagtgggccaggtacggtggctcacacttgtaatcccaacacttgggaggccgaggtgggcggatcacctgaggtcgggagttcaagaccagcttgaccaacatggagaaaccccgtctctactaaaaatacacaattagctgggcacagtggtgcatacctgtaatcccagcttcttgggaggctgaggcaggagaatcgcttgaacccaggaggcagaggttgcagtgagcagagatcgcgccattgtactccagcctgggcaacaagagcgagactccatctcaaaaaaaaattccaaagagtggagatgtgtccccaaacattcctatttcttgtgatgaccaattagctctctctcatgtatgcattaaaaaaaaatacacgcacacacacacacacacacacactagacatggcgtatgtatataaacttctttaatctacttacatattttgttcgtcactgacttaacaatatccactgtattatattttaaaatgttagtcctaaaatgtcctcatttcatcttcaagagccccataattctaacattacagaatttcatggagtcacatccaccttatctgagcccttctgcattttgatgattttgactacacattgcatgcccttcagtgtttcatttctttcccattgcaaagattgtgtttagtctttccgtaatacgaggaacagctttaaatgtagctatagctacggacatgtggaaaaacttaggccagaaaactgtttaacttgaaagggaaaccctgaaatgctgccatcccagttttgtaccagatgggaatctgctgaccaacggaaatgtagaggggatcttttgtgcatactctttggcagtggctcttgaactttctttattcagaatcatttggggcatttgataaaagtgcagatttccaaacccacccacaaagattctgatgcagtaagtccagggggcgaggggatactcagcaacgtgtcttttccaagcacacccaggtgattctttgcaggtggtctatggaccatatttggagaaacactgagatacaaggaggctattttcagcccaataaaagataggatttgggttatagtggtaccccaaagatgagatgacatgccttaagaggcagcattctcatcattgaagaaataaaagcagagaccaatctcttattgtcatgaggggattcacgaaattggatgagtcattggactagctgacccctaagccaccctccaattctgtgggtggatgatcctctgtgcttgcttcttctcctagtccgtgtatggcgtgactgaagagtcccaggcacagagcccggtgcatgtactcagccaaccaatcaggaaaacaacaaaagaggacatccggaaacaggtgaatgaattgacagcttgcactctcaggaggagacgtggccagtttaaaaaccctttcaaatgttcaactctgaagattgagcaagctttgagttcctggaaaccacagtggaacccagctgtgggtgattgaaccttttaagtgctgtgtgtgaacaagccacggaagcttgagagaaagaattctctacccagttcctccagcagttactagaaaagggcgtaaatgagtcatcccatgccttggggtaactgctgtaatggggtttcccacagtccgctgtgggagctggaggaaggagggggctcatgtcacacagtccttataattggaatgcaccagctcaggatggtctactttattgctgtgatttgaaaggaaagtttaagaataaataaagctctactcccaatgccatttcagcattacttggttgaatgttattttctttcatgatgagcagcccaggtcaacagacaatggctaattatattacttccttctgatatttactggtaacaaagcaacctactgtttatattatgccttgctggttcctagagggcaaaacccaaaggagtaaactttgaggtgcttgcccttgacaagtttattatctgatgggtaagaggtaatggatatatgaaaaaaaaaagctatttggcggggctcggggctcggtggcccacacctgtaatcccagcactttgtgaggctgaggcaggtggatcatctgaggtaaggagtttgagaccaggctgaccaatatgatgaaaccccatctctactaaaaatagaaaaaagttagccgggcttggtggcgtgtgactataatcccagctactcgggaggctgagacagcagaatcacttgaatctgagaggtggaggttgcagtgagctgagatcatgccgctgcactccagcctaggcaacagaatgagactctgtctcaaaaaaaaaaaagaaaaaaagaaaaaaaaaccacacagaaaaaaagctatttgatgattccagtcaagcatgccaaggacatgggtgtgacgtgcctgtgaaaggtgggcagaggaggggtcactggggattgttcaaaacaggtatttatggggcacatttcacctgtccatgctgttgctaagctacgtagaaaatacattgcctttaaattttggaaagcaagacttaaatcacaccacagtataggaggagatgagacaaaggctaaattgcagaatatgaatcttgtatgatagggatgtccagaggcacaagtaatttgctggagggcagagctgagggagttggagatgtctggccagaggaggtatttggatcttggtggaaatgcaggatttgggtttgtggagcgaggggaaaaaaataattttagtttggtcttaacatctgtgttctctattttcccagataacatttttgaacgcacagatcgacagacattgtttgaaaatgtccaaagtggctgaaaggtatgttttcctttaataatattactactttcttctaatttaacagggaagaaatgttacagggttatggttaacgaatgtgttcaatgccaagagttagactgtagttattccttagactggggtgcagaaaaacccacaggctccatgtgagtataactaagataacagacctcccttgagtgatgtcaagaaatgttccgttgctaaggctttacagggggtggccacgggaccttgtcaatcaaggaagaatgtcctttaaagctacataatgcacctttgccttcagcctctggattaattcaaatggaaattgctcccctttcagctataaaatgcccagattcactttataggggaaaagaaattatgtgtgtcctttgaggtgctggctgcatagacaggaggggactggatcatcgggaagtgttccgcctccacacgccatcaaccactgaactgcatcgaatcagctgtaaagaaaatatttggcccctccagcctggcttccacagcggtgtgtgtgcttcattctgcaccagtagctagttccactccgttaactcatgggagactcaattttatcaactaaatggtctgtttttttaactcttccgtgaagatgggagaccacatggggaatctatatggaataaatctaaccaggcagctcagtagtgaacatttattcatccatatgctaccgttaaagcaatgaccaattgcttaaggaatcaagagcttaagttgggtcttggtatttattggatgtcagataaactgagtcttttaagcccagctcctacagggggctggctgtgagagccatctataagcctgtaagcctttctctgctggctcctgggttgattcacatcttttttctagataaattacaacaaatggaaggtataaaaactccaaccccaaacaaagagtctgattgaataccctaccttcaggggctaaggacatccctggacttgggctcacgtctttattccagggtttctcgattgtggcactagtgacattctgagccagataattccttgttgtgttcttaatgtcctatgaattataggatagttagcagcattcctgacctctccccattagaggccagtagtcccccaccaccacagctgtgagaaccaaaaatgtctccagacattgccaaatgtcccctgggtggggtgaaagtcactcccattgagaatgactgacactcctgctttttctatgcaaatgtgctggaaagttgccctggctggagctcagcttacactgaggtactgatcactctggagtcgctgtttcagctagctgtgtaggctgcagaatcacctcatacctcctctctcatcatgtgtggcttctggccagagtaccaggctctgaaaatgctttttaggtctcactgtggttcctttgccccagaaaggtggctgtgagtgaaacagcagcatggcctcaactctcttggtgtcatccatggcctgtgaggaaccacgagcttctttctctgtgaactagggacagaaatggctgtcctagtatactttgagggtcggtgtgctagcaatgctcatgtctggccttggaaggtggaagagctctttagggtttgcaatttagaaagagcgtatatatgggagcatctgtttctttggatctatttgctcaggtccagtggttctaagtaccgtaatccaggtgagggagggggttaaaaaatggaaattcccaagcctcagccctagggattcagattcagtggttccagggttgagccaagaaatccacattctggataatcttcaagtggactgatctggtctttcaggatccggtgaagccattgcctgctactcaggctgacctgagagctcacatccaatttgttatatctttgggatgcagagaaagagcctgaacctgtcagcatgagggaggcagactccagggcaggtgtgcagagagtccaaggaatggaggaaaccaaggtggaggcggggagcccggcccatcctattgtttgtttgtttccttgctgtcagggaggggccccacctggtaccacctaattatgcttgagaggctgctcatattgaaggattattccaactggctactcctcggtgcccagctagaagctttcatgagtctctgcccggcagaggctggattttattcccagcagcaataactggcaacttttcaatgcgacacgagggtttttcattagagccacaaggaaacccccagataaggaggaggagggaaaggagacgcgtgttagctggagataaagcagctgggagccgggcctgtcagtggctctgtgaagatggggccagggaggaggtgctggcagctggtgagaagctgccagagatgcaggctgagctctctcaggtgggcacgcacatccacatccacatccccatcctgatctggcttccctgggcctgctccaggtgataagtggcaattccatatcccccaggaaaccgcatcccccaggaaaggtcttcatcatttttcacccagttctgtgagaactaatagtgaggagaggcaggagggctggggacagcgaggctgggctctgggatgtctacagtcagggttggactaaagggtgcatccagaccagcagggagggaaaaagggaactttgcaaactaaaggggcagaacagacagtttaggggatgggtctgaaaccgaccatcgaggtttgaaacctacccctgccatttcctgttttctaactgatgaagccagtggcttcttctctcggtgcctgtttttacctctttagaggggagatagtagttgtatttaaattataggattaatgagttcatgcatggcaaaagtatggtccagtccttgggactcagtctgcacactgggaatgtgaataataattattttccagcatgacacttaacttgtgctttggaagagagcagaattcaaggccatgagacagaatgaactggatatatggtgcttaaaggagcaaacaaagggcaggccaaggagggaggctgctaatgcaattctttcctgcaccctctgtctccccccagtctcccacacagagatctctgcaggctgcccaaggctgaccttgcactgcatgtctccttccactgcctcacacgccatcactaatctggggctttgcgggagaaaagacttgctcttctgcacagaatttctcagatcatcccagttccaaatattctgtccattgtcttcctgagtgcttaagtgtccccaaaatgccagcatcgtggcaaccaaactgcatttcctaggctgccttttgcacctggaagcaacacaaaaggctttctgagctgttacccaatttttgttgcagaatgtattgtctctgcacacacacacatgagtgtctcagataaatgacacttaacaccctaagctttttattttaactttttttttttttttttttttgagacggagtcttgctttgttgcccaggctggagtgcagtggtgcaatctcggctcactgcaagctccgcctcccgggttcacaccattctcctgcctcagcctcctcagtagctgggattacaggcacctgccaccaagcctggctaatttttttgtattttttagtagagacatggtttcaccatgttagtcaggatggtctcgatctcctgacgtcgtgatccgcccgcctcggcctcccaaagtgctgggattacaggcatgagccaccgctcccggcctattttaactattttttaatggcagtgtttcttaaatatggttcatccactttacttcctaataaaaggacactacatttcagttaattttgctagatgactcaagagtcagtagtcttctattatgctttaaaactgtcagtggtcaggatcttataaggtgccctgcttccccttccctaaatggccccagataataatattctttgaattcctgtttctgccttttagttgtctgtctgtctgctttctctactaacccttccccccaacacccaacccctgctttccaatctgtagcataccatgtgtatcagttagctgtcactgagtaacaaaacaccccaaaactcagtggcttaaaaaataggcttttactattgctcacatgtctatgtgccacctggctccactggtctcagccatgtttctctatgtggctatgggttggcgaggcagctctgctgatcttggctgggctctctcacatgtttggcttctgctggtttaggatggcctcagctgggacagttgagcactccttaatatggtctctcaccctccagcagactagtttgaccttttccacatggggatagtgggattccaagagagagaacagaagcatgcaaaactcttgcagattagaactggcattctgtcgcttctgttaccttttattggctaaaacaagtcactaagctggactagattcaagggcagaagaaatagactccttttttgaaactgaactaccacaccaggaaatcaaataaccaaattgattagctttgatcctaaagcaagtgtgaaaagtcttttttgtgaggtgtgttgttcccgataacaatgaaccttgaggcatggtgtttatttcatctgtagactatgcagaggctcttatgctcacttatctcatttgtgttctctggatacttgaagttgccagataaacaaggtcctactcttctctgcaagcgtccccaagggagtccctttttttattcatctaagccttatagcacttgacaaaccaactttgagaagcaacactccatgcattttagtcccaaactgtctagtctccatgtttggctgcgattccccagagacttctcccgacccatagcgagcttacaccacaatcactgcagctatcccagtgcactgctgcacacagagggatcaaaatgtttcattccgtacctgcatctgtacttggctcatcctcaccctattactgggagccattcgtgtgtcacagctgactgctgaattgattttttttagcatcatctcacttgcctgtatctgagattgccgctgctccctgaaattggatgctggttcttcctccacctcctgaccctcagtgatcatgaaatgtaattaatgaaatgagataagacagcaagggactggatacccctaagggtctattaaaaacctgctagggtgatagaggtttgggaacttaatgtctaattatagtttcaggggaggaaaaaagagggtcacagaagtcattacaactttgcttttatgggatttcagaaaccatggggtctttgctcctcctttctcctagcctgttctaggtgacagaaaaaaaaaaagaccggaggtatcattacagccagggtgactgtatctagaccaagatatggaatctgtagcatgtggaaaagaaggggcctccatacctggcctggtgtaagctcttcttcctgcagggctgaattcaccttcatgctccttcactcatcccaagtttctctattgaatgtgttttctctgggtgacttgcaattaaggagttctctttttatattttccctacttcccaccttctccaagtgaaaaaaaaaaagctagattaattaattaattgctaggaatcaaactttcttctttcctctccgcagtgctgctctgcttctcattttcctttctaatcagatccttcctgtcctggttctctgttgtgcatcacagttcagaaactgcatgtagcagagcgaggcgtgccagcatgctctcctcttcaccccctttaatattccaattccaggtcttctcatgtagaggctctgatttcataatgaatgctttagtgcatttgtactgtatttctaaagtaggactaatggtcgtatcccataatgctttagattccaggcctcgtttttgttggattttgtttgtttgtttgtttgttttcctggatagtagtttcccatagctgcaggccatacttcactgtccctttttcctggagcctagccatgtcagtatctcttcatcttctccccacctgctccatatatgtgtccttagctctagggattcctcctaggcattgcttaactcaggatggacagcatttcttcttcctccaacttgtcatagttttgtgtggtttttttttggtggggggcggtcacatctatacaatttgtagcaaaattataagtcttttgttaagagagaaaggataaaatctacaacttttatttttgtcatattttctcaagtggttggactgtatgtttactaaattctctttcattatttccttcccctccatgtttatcaaaggtagaccctaattagcaatctaaattgggaaggttttgcattaataactgtcctcctaccaggattggttactattgttagaagctgtgactttgctgttagctcagctctaacaactctctgagatccagagagctgtttgctatttaatggcatagtaggctctgaataatggctactaaatgactgaccacagagtgtacccctggtagccatctggtagattttttttttttttttttttttgccattactaaaggttcatggggcaggagtatgtgaacaaatagccagttccacatttccactcaagacccagttcaaagcccacgacaatggtgggtagcacatttgctaaaggttcacagatcagcatcttctagtgatgtgagaatttgtcatttgaaaataacaaaagcatataccaatcaggagtcagggataaagggacaagaatgctaaaattgctcattgagaaatattgttcctaatggacttctgaatttcctatatttattttatttcttccatctcatcccaattctgcttttctgccactcacacccagcggttggaggaccattgctgctgtgtactgttatatgctggacatcctacaaagctctttacatacctctattttcttctccctttttgcttctcctctcctacctctagtctttctgtggtcattggtattgactttggactgaaatggtactgtgcgttggccattgctgcctccttcattggcctgcctggccttctcattgtcttgtgtgtcccaagcagactctgttcatcttgtaatctgtacactaccaggaagcacatgttctgaaagagacaacctctctggctagttctacaaagggctgccttgatgaacttgccttcacactcccatcaccttcattcccttttcaactgtattggtttgattccaagcaataaaaccccagcttgaacctggttctgcaaaatagaagcatgccttggctcccagaatacaagaaggggctgtggaattgaaccctgggaaaggcagcaatgctactgagctcaggaaaagctggagccagggccttcagtgcctccaagacccattcttcctctctggtcctgcccactttccatgctgaccttattctctttcatgacagacatgtgttaggaaacatgacaccaccagcccttgaactttgtgactatacaactttgatatggtttggctgtatccccacccaaatctcatcttgaattgtagttcccataatccccacacgtgatgggagggacccagtgggaggtaattgaatcatgctggtgttttcccccatgctatgctcatgatagtaagttctcatgagacctgatggctttataaagggcttccccccttcattcagttctcattctccttcctgtcaccatgtgaagaaggacatgtttgcttccccttcccccatgattgtaagtttcctaggcctccccagccatgctgaaccatgagtcaattaaacctctttcctttataaattagccagtcttgggtatttcctcatagcagcaggagaatggactaatacaagcttctactgctgaagctggggaaagaagatatgaacctcacttgcgtcaggtatctgttcctggacaaatcaaccatggccaggagcagggcttataaataaatacatggcagctcctgaagtagccttgtgtacatgtcagagtacaattctcaggagacaagcagaagtgagcagaaacccatagaggccctctatgcctgctcacccattttggagtactcaccatccagaatccctatctgcttcactcagattcccaagagacccagcataagggtcaacccttgtacattcactgtattcctaggcagcacttctatctccatttggatctcctttcatgcctaagaaatggtgctggacagcctaggcacaaacccaaaagccttttaactctctgcattaagcttagatcttatcctatgtggccaaccttcatttctttcctgtgtcccaccttggaagctctagctaccaggcataaggcacctccagcccagactaaagagacaggagagcaaggaaagggtaaggagtccttgctttcatttcttgtgctgtttctgcacagtctgatgatgttgagaagcataagggaagaggagatcgccttccctctctgcccagcgtggggtgttctttcacctcctctcagtctttggctaccccagctgtgaagttaaccctctctgctactctctctgggaaggatcaccctcccctcccaccaagaagctgggagagcagttgaggcagcagactgctaaatgcccaggtcacccatgggaaactccaagatgcactttgctgtctcctgtcttttccatgcaatgatgatggcaaataggacaaatgagggtgcatagattcatgaacactgggtttatttgcgtgggttgtgatagtggcagcaaaataaaacatggcggtgccattatgcaccttttatctactgccacactctcctccaggtgactttattttctacatagataaatatagtaagaaatacataataatacatttattttttcacataaattgcagtcaaactacacctgtggtaggcagaataatgatctctcaaagatgtccatgttctaatccccagaacctgtgaataggttatgttacatggcaaggagaattcaggttgcaggtggacttaaggttgctaatcagttcaccttaaaatagagagattatcctggattgcccagatgggcccagcataatcacaggttcccggaaatgtggaagagagaggcagaagagtcggtgtcagagtgatgcagcatgagaaaaccatagctggctttgcagatggaagggggccacgagccaaggaatgcagggagcctctagaagctggaaaaaggcaagcaaatgaattcttccctagagcctccagaaggaacatcgccctgctgacaccttgattttagctcagtgagacccatttcagacttctgactcttagaattataagacaatacatttgtattgttttcagctgctaaatatgagataatctgttccagcagcccttagaaacaaatataaaaccccagtctctccccttctcatagaatctgaaggccaaattgttcatcctctttgtctttaatataccagcatctccgagcaccccgctgactaggagtgcctcttatagccccaatacgtgtatgtctcattctgatgattcaatacttccttttcccatcaataaaatacaacattcaaaatatgtatgcccatctaattttactgtttcctttacaaagcctctgactttatttatgtaacttaacaaaatagatttccctcttctaatacaataaatttcccttccgaccagtaccactcatctctgacactggccagcagattagttgctcgtaatgactttggctttgttgcctggttcaggttgtcaggactttctgtgttccttctccacgtgttcctctatagcatgtcttgacgcctcttgcctagaccttttttagagaaggcatgacatggcacaagctcccaggaacaatttcattcatgcttaatgcctgttgcaaagtcatattttttgctcttatgttgggtggtcacaaaaatctcaccttgggctctcaaccacattctcctaaaccaacatcaccatgagctctcaccacctctcttccacccacttctctaatgatattccaggatttttcttaaagagatctggctatgagcctgtatttcattacagcttaaataatcatattatttcccatttccttagttgctctctggacttttaagattctactgccttaggctggtcagcggacagctgccttcattgccatgcatatagtaataggcagctggagcctgcaggctcctcttgggaccaggtgctggctgaactctcaccacagcctctcctgagccttccctattgtcccctcagcccagcactcactcagggctccatatggggacttgtccacaggacctgacctggctggttggaccccacttcccaggttggagatgtgaccacatcgaggatctgctagaacacatttggggaggggtctgataaaaaccccagcctgtctcattgaaatctaaggaagcaagagggaggaggggaggacatttcatttttcaatccctatgttctacttcagggaaatctatttctggtcttaaaaaaaaattccccaataacgtaattaattaaaagaggtcctaccttttgccttgagctgccaagtggatgtcttttatttgagattcaaagctaactaaggctgagattattggaatggccagggcagatgtcctgggaggacaaagggggcccccccaccggctgtttgctcatctcagattttgagaatgccatggatgctgaaatgcctcataattgggagaaccccccaatatgtcatcgtgactcagatcctctggggcacctcagtacaactcgtcaccccctgaacaggatttcggttttctgctgctggcttgtctttgtgctgatctgagcaaaggagacaggtagcccagtgttctctctgtatccccacatccagcttgctctctcacattccctgtagtgggttgaatagtggagccccaaaagataggtcctaggccttacctgtgaaacctgtgaatgtgacctcctttgggaagagtctttgcagatgtaattcagttaaggatatctacataaatcattatggattatccagagactccaaatccaatgacaagtgtcctcataagacaaaaaagagagcggatgacacaggcacagaagaaagccatgtgaagacaaagacagagatgaaagtgatgcagccacaagccaaggcatgcctggagccaccagaaactggaaggaaaagaaaggaaaggaaaggagaggcaaggcgaggtgagacgaggcgaggcgaggtgaaattatcccctagagccttcggagggaggatggccctgccaacaccttgatatcagacttctagcctccaaaaccgagtataaacttctgttgttttaaccatttgtggtcatttgttattgcagccctagaaaactaacatattcctcaacatgcaatgccatttcttttataaagaattcaatcagcccaagtagctaagaagtggcttccaggtgcagcaccaacttgtagcctggtccttcctgccatagtgctttcttacagctcccttgcccaggttcattctgcctgagatgtcgtaaagctcttgatatggtttgcctgtgtccccacccagatctcgtcttgaattcccatgtgttgtgagagggacccagtgagaggtaattgaatcatggggcaggtcattcctgtgctgttcccatgatagtgaataagtctcatgagatctgatggctttaaaaatgggagtttccctgcacaagctcgctctctttgcctgctgccatccatgtaagacatgacttgctcctccttgcctcccaccatgattgtgaggcctccccagctacatggaactgtaagtccattaaacctctttctcttataaattgcccagtctcaggtatgtctttatcagcagcatgaaaacaaactaatacagctcttattggtgaagcctggccccagggaagatgcataccttgcaggagatttataggacagaggatgtgcctctagtgtgcccgtggtttcgcttgtctattttatatttgtagaggattgtcaagattctttggagatgctttcccattttctatcacaatggtcctgagtgctcaacaagcctgttatataacatgatgaacttgacaaagatcagttaaatgactcaaccaagaattcaaactaaggcttttcaactgggaccactgctgcttctaccccaggggtcatgataaacacctgggacagcgaggaggctctgaggtgtccgaaaatttacatccatcttcaaaaccaaaattaccaggggctctttcattttgatttgatgaataaaacatcttgtgtcctgaatgtttcagaaaattgaggaatgagatatggttctctcaaacttggatgtgcatatgaatcacctgggggatcctattaaaaagcagaatctgactcaggaggcctgggctgggacctgagatcctgcattgctaacaggctcccaggtgatgccagtgcagctggtttatggatcacacttccagtagcatgagatggcacctctgactaatttctctgcctgttcagcattaagctaattggccattattgccctttgcaattcagtagtaggaattgtggctctgactttgctgttgtgggagaagatgctgacacacaagctggcaatgcttaaggaaaaattttattgtggatcgataaccataaaaatattcataccttttggtcaaataattctgcttatggatatgcattctaaataaataacccagaagatgaaaaaaaaaaatctgtgtgaacaacggtgttctaccacagcactatgtatattaaaaaagaaaaaaatctgtgtctaataaaaaggaaacgattaagtaaattgtaataaagtcactcaatgcaaccaagacaatattgtagacatatgttcatcttctccctttcctcaaatgcaacatgtcactaaaggaacaaaaatggcatgaactcacaaggttaacaaactattaataatttcaacacatttgtccaagatacaaagtttacgtaattggggaacataaccacaggcccctatgtctgtatttgttattttttatttttttaattggtcagcgagtacaaggtatcaaagtaaaatcttacaatttttatacatttctgtatgcctgaaatatttcaaaatttaataaaaaagaaagtgcatagggacagagtaaagaacattctaacctacatgttgggggcagaagtgatgtgacaaagtgagccagttttcgcaacaaagcctggccttggctcttgaaggcactagggaccatggaaagcaggaatgaggcatggggctaacagcagaggaatggtcaagtctgtcacaggagactttgcacccctagatctcctgccctactaggaaacaatccttcccacctaccaccactgcaggagatgggcagttttttcttgagagaaattgagccacatacgctcagatctcagacacatcagatctcataagaggccacctgaaaataagagaattaatggaagctctacgcactgaactgtggggcctgtagggatggaaagtgtgatacctttcctcatctaccataaggattacggccaacactgctataacaaaagaggttaacaagagaaaagcataaatgcatttatttcatcagtttcacatgacacagaagccttcagaaatgaagactcaaagacccagggaaaactgtatttgtgcttaggttccatgaagaatgggaagccttgtagaaatgtgattggacaaaagggtgtgatctactggtaacagactgaggggaggaaacccagcaaggcctgtctgttcagattcttcttagtgtctctgagtagcattcctacctcccaggtaggacctctctggaatgagggttttcaagggagaagggagcgagtgacctttctaggttttgtggcttgctttgcaggagaggcattctagtttctatgacccactttggcgaaaaagaattcttgtttctatgacttacgtcgggggagaaaaagggatgggagacgggggcaggagagaaggtgaaagccttggcttctgaggcccttccattctcctttagttcaaagtactcagcatgccaacatactatactttagggtatcatgttctgagccccaacagaccctcagcccctccccgaccctgctctcaggcctccaggagccagacatatatacccacaggcaagagactgtcaaagtacaacctgtgggccaaaccatactccattctgtttttgcaaataaagttttattagaacacagtcacacgcattcatttgcaagctgtctatggctgcttttatgccacagcagtagagctgagtagtggcaacagacaccatctggcccacaaagcctaaaatatttactatctaggccctgcagaaaaagcttgccaatgcctgccctagggaaaaatagacgccccagaggaaagactccagatccctcatttggagctcccattaaaatactggtaaacttccctatgacaatgaagcccatcagtgacaagccccatccacacgcccactgagccgccaagcaggtttcagtacctcagtcttaagtacaaatggatgtccaaagattttccagacactccaggaaggctcagcgtgaaagagtataatcaaaataaaccgacagaaaaaaggaacttggaagaaccaaaataattcaacaactggaagaaacttacaataaaagtatagaactcatattatctgagaaatgagaaggtatttcatccataaaacaagaactagacactatgataaccaaaagtgaactctgaaacttagaaagtaatggctcaaaattaaaaaataaataaatagttaaaagagagtttaacaaaaagacaaggagatgaaaaatgggagggaaaataaacaattcaggatgtccaatattgaactggaaaaaaaaatataggacaagcaaacaaaggaaacaaagggtttaaaattagtgatgaatactataaaattcctgataattattttcttatctatcacacactgtgcccagcatagtaaataacaacaaccagcaagggccatcatgaaattgcagaacactctagcaataaagagatgattctaagttgacagagagaaaagaaactgaaccaaagaacgagaatcaaaatggatccaggcttctcaatagtaacactgcataccagaaaaaaaaaaacatggagtgatgcctacaaatttctaaaggaaagagatttttcacctagtgttctatgtctagcactatcagtcaagtatggagataaaagcatttttagacttgcaaggattctcatgcatcctttattacgaaactactaaaggatgtgcttcaacacaatcagggagtaaaagcaagagatagacatggaatccaggaaacatgggcttttcaacacagaagtgaaggaagtcccaaaaagatcattttccatcaagtctatagagcaaatgatccagtttcgagcaagaagactaaagacttcaggaaagaggatctctgggaaacaagaggacagaactgctcaattatttgatgtgtttaaggtataaaaaaatgattgctagatgttttacaggtttgttaaaacacttgcttggaaaaagtagtatgatatttagctgaacagcaaacaatttttatctagtttaataatgttacactgaccattgatttaacaaaaattgtaacacaaatctatttggaggatcacgtaagaaaaggagggagttgaggactggtgaatagaaagataaattcttgtctaaaataaaaaaatcaggaatagatataaaagcgtataatttagaaatatataggtagcttttagaaaaaacataaggtggaaagtagatgcctctctgagaagggatgggaggaaaaaataattgcttttgcttttttagtatatataatcatttggtactattttattattctaactattcacatacattttgataagaataaaaattagtctaaaataaattatatcaatctataagatcaacatatctattagatcataattataactagaaaagttgcttttttggaaaaaaatgcaaatgtttactccttgtggtctgctgatatttaaaagtctttatcataagaaagtccttccgttgggaatgctgagctggcagtctggtggagctgtagtgtcttttgtgtgttccagatgcctcgagaatcagtctttgtgggagggtggaacacaaacagttttgaccagtgtattagtatcagtaaggctagcataaccagggagagatgcaccaaggttcaggtaaagaatcaagtgaggaaaagatatataaaatgcatgtatatatcatggctgcaacagtgcaaaaatggtatgttcgttataagaaggaaataaggacaaatgaaaacagtttgatgtgtcagaagtgggagcggaaataaattttttcctttaatttagaattatgtgaagactgctataatgtttgtgtaaaacagaataaaggggttttctaaggaaatcagtggcattctttgctctgcctccctcctgcagtttaattgcctacacggaacaatatgtggaatatgaccctttgataacaccagctgagccatccaacccttggatcagcgatgacgttgctttgtgggacatagagatgaggtaaaaaatgttttaaggtttgggagtgggatgaatgtagacaaaaatccatgagatcatgagattaccttatattctatcttaatttgacattttttatcgctagaacagaaacccctcaagtagcctcccagctgagttctacttacagtttctacctccttatagctttgatttgtgcatggatcctttgtggctcccctctgaccctttggataccatgataactgagacagtccctcaccattccctagttctgattgctggaagaaaagaatctgttgttccaattttttttcctgttagacagcaacaataatgataatagctggcacgtattctgcattggccacatcctgcagtaagtgtctctcactgaatcccctcgacaggtaaacattactattctcaccactcagcagttatggaaactgaggcacagaggagttaatgaacttgcccaaggtcatactgctagtacagcagagttaggactagaactcaggcagagggctccagaaccatgatttcatcactctgttcttctggagtaactgccagcaacgattccagccagtttctccttccctgtgagggaagccactgtgtttacttaagaggggaggaaccaaagcccagagggacttggaccactttcagaattacagaaggaaacacacagacaaagctagtgtggtgtgccttcacaccccctgcaccttggctggatgaatttttatttcccttttcatgtctctgtcactcacattgtctttcacttttgccccttttctggctgcttttcctgaaatggaaaaaatcttataaaaataataaaagtcgcagatgctcattctaaaaagttcaaattatccagatgtgcataaagaagaaaatgctctcttcctccaacccgatttcaccttccagaaagaacctttgtttatagtctaatgctgtggttcccagagtggatcagagcaccctgagcactgtggggaactcacagagttaccactggatagtccaaattttttatggaaacacagcgatggttgacacatggcagatactgcataaactactagcttaagatggttcagtttcaacattagagcacgttacatcccttatgatgatacgcatctttgcaaatctggcttttcggagcagtcactatgataaaaagcaagaactgcacaaaaattaacatggaataagaaatagggacggtaagttccaacctaattccaaaatttaagaaaatgcgtagtgcccaataggtgcatattgtagttatttaagaatgaaaacaaaattttcaatttatgtgtctttcaaacagctactaagttgttaggatacaaatacatattaagttgattggtcctagccataataaatgacactgttaagtatttcttttggcccaggggcactgtgaaaaacttactgagacgctaagggtaccatgagctcagcaaatttgggaacatctgatttagtgtctattactttggatttttatgcacatataacattctatccttttgtataattgggttcaatatatatacccaaatatgtacatatatatatatagtccaataatttttaaattaacaataggtcgtggcagtctttccatgtaaacacatatagatccaccttactctttttaatagctacatactatcccctggcaccggtgaagtaagatttattttaccagtacctggatcataaatatttagcttatgtcctccttttttgccaccataaacaatgattccgggaacatctttctacacaagttcaattatttcatcagtatatattttccaggagtagaattcgtagaaatggtatgcatattttaattttagttcgtaggtccagattcctcttgagcaaaactgtaacacatctttttcattcccttagcttaaaagtgcccatttccccacattcttaccatcccaagcatcatcaatcattttgtctttgcaaatccaaaaggttaaaataattctcattttactgttttgtttccttgttaatatacttgagaatcttttcacatgtttattagacagattctagcaatatgttttgctttggatatttggatataaaacagtcacatttacttgaatcatatattttatctttttcctgatatatttctgaatctcattctttgttcttgtttctttttctcttccctgacttttactttattaatgttatattaactttgtaaaaaccctagtttctattctagttgtattaacttttaaatgttttaattaaaaacatcatcgatttaaacaaacaagagtgaagtatataaaatagtgaagttacctttgcctcccttaaatcccattcttcccagaggtatgttaacttgatatattttaaaccaacatttttgaacttgtatttctatgaacatttaaagaataactagtatatagtacgtatcttctttctaatatttctgatgagccctaggtagttccttctaagtcaagaacttaactctttctttaactcaggattttttttctcttttttaaaaattattgctgctttttttccattctatcctcacttttcaggaaatccttttttaagaagtctgggcctctgggatggagttgctacatcttttatattttctctattataatttccatcttttagtctttttattctatattcaaaggatacaatttcctgaattgctcttcagaatcactgctttgattttcactggtgtccattctgtgattttatactttagagagtttttcttttcccactgagtgttgggagagtggttgataatcaagcttttcatttccaagacttcttaatacttcttggactgttcttttcttagtagcctgctctgttctattggtgtttatcatgttactccccctggagatgtgatatagatttttttcatagtttatattttttccatattttcatatctcctctctatttctgccgcttagttttattcggggttattcattagagaatcatcatttctgctcattgtttcattcattcctctggtcactgctcagagcagatcattctttttgtatgcccagctatttggaagactgctcatttttataaatgaaggtcttagctttcaatcctgccatacattagaaccacctggaagtttctaaaaaatactaatgcctggtcctcacacacagccaattaattcagaatttctcacaattgaacattgttttttaatctccccacatttttttttaaatctccctttttaaatcagggagatttaaaaagtctaatgtgcagccatggcctaggactctatcagtagctggtgagggtgctctcagtgatggtatgggccaatggttctaagccatgctgtgcatcagaatcacctgggctcctctttaaaaatacacgcatactggggtggctctgggcgtctgcatcttgagcaagcaccccaggcgttctgaggcacacgacagtttaagaagtcctggtttggttcacggagttccccggcaggctttcccctgagcagttcacacaggagcagggctgcacctgaatgtatgaatggatgggcatagatcaattgccaaggttcccctctgggtcccgggtatgtggtccaagaacagattaaaagattgggccctctcttacagtgagacaggtggcaatgggagtcttggggaggtagacccccacccttcctagtgtgacatccctgcagccaagtgttctactctgtgggtcaagccctgatggagtttctgatgtctttctatttcctcgccaaggtactccccaacaagtcgactcttctccctccactaatgggtcttaggggaacccacttggatctgcgaaagccaatgagaggtggggagaaagctaatgtgtctttaaaatctccctggttcccaagatgttttttctctgtgtgtgtgctgtgctggcaggaacacaatcctctggccttactgtccatatgagaagctggccgggaaacatcccccttaacttagcaaacccttttggccatgtggaacctgatccatgttcctgagttgcttccatatgccccttgtctgatgccacccactgcctccacttccaatcctgctgctcagagctcggggtttcccaaggcttctgttggggacactcagctattttcttctctgatgcctccactggaatcgtaggctgctgtcgatcagatatgtcacaagttcagtctatgtgcttcgtgccttcctgaaatttctcaaagctctcatctgctgataggaaatttctttgcctctacatactgtgtttagtttttttggggtttttttgttgtttgtttgttgttttttttttacttaactgagctctgggcttttgcctgttccctcctcgttggccacttgtcccccagatcctcacatggctggcttcacttctcattcaagtctcactcagcactggtgtcccttcctcagaagggctttctgtgaccaccaatctagagtggccacctcatccctccagctgttctatatcacatcctcctcctggttccctttctaaatagaatgatttcagcgcctaggcctatctggcatacagcgggcaccgtgtgggctggagggaggatggatgaacaagtcattctttatttgatcgtttcattggtatttgggaaaggaggagaggcaaatgtgtgaacctaattcacaatgataaaatgaacttcctcttttgttcttgaaagtcagcaaagaagtatgtaatcatgtaggaaaatggggtcgcatggcctattggtttattccaacctattcagcactttttccccaaggaggtgctacctgccccctactactcatgccctggttctactcctgttgttctagcttcgactctgaacttcatgcctaatctaggatagctacagtgttctgtccacttacaggcagaatcaagtgttcagatacaagtgaaaacgaagccctgtttcttctcccaacagactactcctacccacttagttgctggcagtgatgttaggaaaaaacagggtggaatcagtgtcaacatcacactccagccaagggatggtttctgtccacaaaacgaaggctgaagatgaccaataaaataattgagtcactttctctcggtttcagtttaattcaatacatttgtatagtagtcaactatgtgctgtgttctgaacaagaagggctctcaagataacaaatgtagcaaggtaaataaaacatgctatcttaccatctggcaccagaactcctccttgcttggcaaaggacattaagccacttggggcagaaggtaaggccctaagggcagaagggttggcagagactgaaacaacaaagggagagggttgtgctgtcctgctgagaaaacgagacaaatgtattctctgttcctgagaggggagaactaagggcaggggaaagcaggggagggagagaagccagaggccaacaaaaactaagtctctgtgcaaggccagggaaatgcctagcattgaggtgaccagggacttttcaaaagcaggaatgtctagtatgtgcttttttaaatagtaggctgccaggaggtgcgatatgtacccatttttcaagaccctcaaattcctgtaaggcccccaccctcccaaacgcttcatgagaggaggggtttggtgggtgtgggtgaaggtttgtgggaaaggagagacagtgagaatgcaggactcccttaggaattcctgccaatctcaggtgggctttggacttcactgggctgggtgaaggggtccaggcaggctcgttatgatttccagggcccaggatgtcaccgacaatgtctaaattctgcaaggtggagaatatactgagtctgccgtggggaggttacagacagccaaatggaggatggccatagcagctgaatagaatcacggataagatgacataggatatacaataaatagcagaaaattgtgctttaattctttctccttctcagacaagctattcgatctggaagtccaaggataagaaagttatattcagaggggaaaaaaaggcaactgttttaaaggatgggcaaactacacctcaagtttatgcaacatagtgagctgtgatcgcaccactccactcccgcctgggtgacagaacaagacccctaaagaaaaagagtaaattctgagaagtaaagtttaattaaagaaaatagtgattgccagggcttctcattgaggagaagtcagtcaaaagttgccagatgacgtaattctttatgtcatctgaaaaccaccaggagagtgtcccagggatacgtatgtaaagtatttctggtggtgccactaactagatgctggagtctaatgaaacctggtgttgtcagcagaatgtggtttgtgatttgctctctccgcatgacttcagtttagctctccctctctgctgggtatcaggcacatgagcaaagagctacaaggaacctggcttgtccagcttggccgtaggcattcactcccagccaacctgacctgctgagaggcagagatcatccctgagctgcccatgcacagcgagtttgacagaactattaatccggaatattagtcaagctcctttcttatggtggtggatctccaaatatggccccattggtgccttccctctttacatcaagtaggacaccaagaccaaggccagatgaaaagagagggagcacctttttccctctctcaaactatttgagaaccagtaatccagaacccctgtggtggcttccaccttggtcatttgaaatatttgctcttgagacattccttcttggaatccatctgccatgcttggagaagcccaagccgttggagaggccatgtgcagacagtctggtcagtagcctctgctgagctcctggtcagcaactagcatcagctgttaggtgatgagccctcctggatgcacagcccagtcaaatctccaaatgaccccacctccagctgccatccaactacaaccatgtgatccccaagtgagaaccacccagtggagcctagtcaacccataggagagtgaaagagactaataaatggcttttttaagcccctggattttaggatggtttgttacacagcgtaaataactgggccaggcgcggtgacttatgcctgtaatcccagcactttgggaggccgaggcaagcggatcacgaggtcaggagtttgagaccagcctggccaacatggtgaaaccccgtctctactaaaaatacaaaaattagctgggcatggtggcaggcagctgtaatcccaggtactcgggagcctgaggcaggagaatagtttgaacctgggaggcggaggttgcagtgagctgagatcgtgccattgcactccagcctgagcgacagggtgagactccatctcaagaaaagaaaggaaaagaaaagaaaaagaagtaactggaccactcttcattggagtattcaggaccctcaggttgttcttgaggtattaaataaaattatgattgtttctttagtagccttggctctgagatggggacattggattattttctttttaaggaattgccttatttcgtaatttttctaataacttgtcttagtctgttcaggctgctacagcaaaaatgccatatactatgtggcttaaaaacaatataaaaatttttttcacagttctggaggctgggaagttcaaggtcgagatgccacagattgggtgtctggtgagggcctccttcctggttcataaatgtctgggtcctcacatggcagaaaggcaagagagctctggggtgtccttttataaggacactaatcccactccacgtgacctaattacctcccaaaggcttcacctcccaaaaccatcacattaggggtcaggatttcaacatataaatttgaaggggaacacagacattcagtccacaacattctacctcaagatccccagaatttatgtcatcttgcatgcaaaatacattcattccatctcagtagtccccgaagtcttaacttgtcctggcatcaattctgaagtccaaagtcttatctgaatatcatctaaatcagatatgaatgagattaaagataccattcatcctgaggcaaattcttctccagctgtgaacttgtgaaaccaaacaagttatgtgcttccaaactacaatggtgggagaggtataggatagacattttcattcaaaaagagagagagagagagagagaaataggaaagaagaaatgggtaatgggttccaagtaagtccaaaatgcaacagggcagaaaacattaaaccttaaggctctaggaataattctctttggctcaatgctctgtcttttagacccactggggcagcagccccacctccatagctctcctgggctggagtcatacacccatggctttcctgggctgatgctctggtcttccaggcccatttgggtggcagcatcatccccacagcttggtgggatggccctacagcagctttctcctggggtccctattgctttcccaggctggggttcctcacctgcagctcttctgggcagcccagtccaccatggctctgctgggtgcagcccatattgcagctttctgtggggaccccatcccaagtcactgggcaggagcatcctgatctacctaaattgaagagacgagttgatcctttaaaactgttctgctctcctactacatgtcccttgaactctgggcctatggtgcaagtggcagccctgatgaactctgaattgcttttgagtaattcttccattgtcttgaagaatagttcctggattctgttaagatgactcatccatactaatatacttatcaaacagtcacttggccacactattagtggtctcattttttgcatatgaatagacaaagaatttttcagatcttcaggttctggtttctttttgtgcttaacaattctgtctttaagtcacgttttactataagtagtcaggaagagccaacctgcaccttcaacacattgcttagaaatttcctcagctaaatatttaatttcgttgcttgcaagttttacctttcacagaatactagaaccaaataaaattcagccaaattctttgccactttataacaaggatcaacttttctccagtttctggtgatatatgtctcatttatgtctaaaactcatcagaatggcctttaccatctatatttctaccagtattctgttcaggattatttaggtattatctaggaagattgaggctttctttatagctctcctctttactttctgagccctcgccagaatatcctttaaaggcctggttacagcagtttaggttcctctcccctcctctcccctcccctcctctccccttccctctcctttcctttcctttcctttcctttcaagatggagtctcactgtgtcacccaggctggagtgcagtgtcgggatctcagctcactgcaacctccgcctcctgggttcaagcaattctccttcctgagcctcctgagtagctgggaattacaggtgcccaccaccacgcccagctaattttttttttttttttttttttttttttgtatttttagtagagacggagttttgccatgttgtccaggctggtctcaaactcctgaccttgtgatccgcctgcattggcctcacaaagtgctgggattacaggcgtgagccactgcacccagccaatttaggcttttgctgacatatatctcaagacccttccagcttctattcattacactgtaagccacgttcacatttttagttgttcattacagcagcttcccactcacagtacgaacttctgtcttagtctgttaggactgctgttacaaaaatactatagactgtgtggcttataaacaacagaaatttatttctcacagttctggagctaggaagtccaagatcagagtgctggcaaattcaatatctggtaaggatctgctttctagttcatagatggctgtcttcctgctgtgtcttcacatgacagaagggaaagggagctctctctggtctcttatagagtactaatcccactcatgacctaatcacctcccaaatatcctgcctcctaatacgatcacattgtggatcaagatttcaatgtattaatttggagagggacacaaacatttagtccttaacataattcttaagtgttttgaagatagcttgtatattccccaagtcttagtttagatattgattgaggcaaatgtagtagaaggcaaggtaacagagtggaaaaaaagaataggctttggagacaggcagtcctgggatccaggtcctggctgccacctaccagctgtgtgaccttggacaatctgacctcttttgaactctggatgtttaaatacaatgtcagcctccctggcttatattaagatttaaatagggcactgtaaggaaagctccttacaccatgtgtagcactatgaagctcctgcagaaatgagcattgatatagacaattgcttcctttgaatctggctttcttgtcctcagtttggtaactttcctccatctctagctgggggatcagcagaaatgaaagacagacacccttggagagctttgctatgtgttggtttgggctgtccagtgggaggcaggaacttgataagaatgaagaggcacagaggacaaataagagttagaaaaaggcatccagctagcgattagaaaacactgtcaggataaggacacttcatccacatcactatacacatttctaaactgatttcattttagtgctgaacacttgccatgtgaaaagtcctatgctcattacaaagacacatgaaatatggtccctgacctcaaagagctaaaaaaaaatagctggaaagacaatggcataaactctcgaaaatccaaatgctgacataaaactctactagagaatatgtcccaaggaaatatcgctacacaatggatgtaaagagactgtgcttctgtggattgtttgcttgaatttggctgagggacagttattgtaccacttacctggagatggatgttgaaagatattttaatttgcagaattattttataaccataagagaccattcagtggtaacaacatgttcaagtcttttcttaaaccttgaagtggatgatattgggaatactcaagtgatacagaagagatatgtatagggaagatgtatctaggaagcttttaatagaacagactcccagtagtgaaatcgtactaggaaaataaggaagaaatgtggatcatccagttgtagtaatacaattgtgaataatggatagttgagggaagccaagtatacatggttacattgtatcgactaaaaattcatgtctttcccagaacctcagaatctgacttatttggaaatagagttgttgcagatgcagttagttaagatgaggtcgtacttgaatagggtgggcccctaatccaatatgactgatgactttataagaagagaaagcaggctgggcatagtggctcacgcctgtaatcccagcactttgggaggccgaggcaggtggatcacaaggtcaggagatcgagaccatcctggctaacacggtgaaaccctgtctctactaaaaaaaaaaaaaaaaaaaaaaaaaaaaaaaaaaattagctggccatggtggcgggtgcctgtagtcccagctactcaggaggctgaggcaggagaatggcgtgaacccaggaggcggagcctgcagtgagccgagatcaccccactgcactccagcctggacaacagagtgagactccatctcaaacaaaaagagaagagaaagcagagacacagacacttacagagcaaacaccatgtggagacacagaaacacaggaagagagagtgcagtgatgcatctgcaagctgaagaatgccaacatcagaagttaaggaaaagtcatggacctggttctcccctaaagctgtccaatagagcatggccctgtcaacaccttgattttggacttctaggctccagaactgtgagagaataaatttctgctgttttaagccacccagtttgttagtcctttgttatggcaatcctaagaagctaatacaccagggtatcctgtctctctagacccatttatttctgctgaactatgaccttgccattttccagatacccccaccttctgtcctaagcatccctctgattctacatctacagtgacaccccaagatttctggcccactccaaaaattgcccttctcccactcttgccaccaccaaggaatctggtggaatgaatgtggactcaccacttgggtaccagaaaggggtgacactggtggtgggtgtgcatccatgaggcagtcactacaaagtctgagtgaatttctacagctgctaatatgggcacagccctcattcgagtacagctgccactagtaccatccctggagagccctgaatcctcctctggtaaagagtaaatggttgggtccatccttggtcatagcatgaccttggcagaaagagacaatgtcctgcagtctctggggcttaaatttactgccagcctcaaccccaggggaattcttccacaaacagtatttttggttcccttgaaagttattgagtttgattaggtctgtggcttgcgtttgagagaatccaggatttgtcttcatgtcttgttgtgaaaggcctagcctggtactttggaagaggtgtttcatggagtctcccattgtttgacctgatggggttagtctaccaccatgaccctattggactatgctggaaatgcagagttgcaagccagaggctccctgacctccaggctcatgatctattggtcatcatcattgtaattagaagatactgctgttgctgattatgtgtgttggtgaagaagtagttgggtttggatgcggtatgtctagagctgcataccaatatagtagccactagccacatgtagctatttaaatttaaatttgaatcatttaaaattaaatgaattttaaaattcagttcatcagtcacactagccagttttcaacagcccaatagccacatggggctagtggctgccatattggagagcacggttatgggatattttcatcattgcaggaaattacactggacagcgccagtctacagttatttgctttcccaagctttccacgcacacaagctcctttttttttttttttttttttttttttttttactaagtggaattttccaagtattgagaatatgtcagctccataataagaggaaacatgatttaatctcttactgtctgttggaaataataaaatatatgcatctattttttaaaagaggaaaaatgagtattgctagaccaatgtttcccaatttgtaatgtggacataaatcacctagggttcttgttgaactgtaggttctgatttagcaggtgcaggtggggcctatggttcttcttctggttcacagaccacaccttgaatagggaagagttgtagcatgtgacttgtgagttaggaccttatcactgtttaaagggccaaggacataaatacagcaagtgaactttaaatggaaagacagaagctgaaggaaatactcttatcgcccaacaccagaagaattagaccaatgcccattctttagtctgaatgtgagacagcatagcaaagatgagctatgcagcatggcagaattaagaactggggccgggtgcagtggctcacacctgtaatcccagcactttgggaggctgaggcgggtggatcacgaggtcaggagattgagaccatcctggctaacatggtgaaaccctgtctctactaaaaatacaaaaaaattagccagacgtggtggtacgcacctgtagtccccgctattcgggaggctgaggcaggagcattgcttgaacccggcgggcagaggttgcagtgagccacaatcacgccactgcactccagcctgggcggcaaagtgagactccatctcaagaaaaaaaaaaaaaaaagacctggtgccctctggagccttgctgtctagatttgattcttgacttcattacttcctagctgtgtattcttaggcaaactaccatgagacctcaccttccctatctggaaaatgggaatcatactagtacatttttcacagagcagttgtgaggactcagtgggttaacagatgtaaaatgcttgagacggtgtctagcacacggtaagcactgtgcatggttgttaaatcaataagtgcatgtaacattctgcttctaacaagagaatatgctttactctggatgtgtcaatacatttctgaccagttgtacatcacttggcttgaaacaggaccataatttctcccctgaggattgaggaaggggtgggaggtggaggatagtgtgttttgatgaaagattgggtccatgaagcatcctgggttatagtactagtgaaaaaattagagtcaaaagttgagtccataattgataggaatggtccagggagtttaatcaatggcatggtagacagcagccatttgaagggcatgccggcaaccatcacttaacatgcctccttaaagaaactgttcatcattggttactgttggtgtaccaaagtctgcatttggaatttgtgcagcttttgtagaatctgccccttaaatatgagatgtttccctttggtgagtgactgcaaaacagacttgagtcactgaagagaatatgacacgagcttttctctggtattgatcttctttaaaccttcttccttcaccccaaagcaaagagcccagccaacagcgagtaaaaagatggggcttctctttcgatgagatattgaaggaccaggtggggcgggaccagtttctacgattcctggagtccgaattcagttcagaaaacctcaggtaaatctctcaaagtttgagctgtgtgcggaatgtgtgtgaagaaatttgcataatcggtctctccatctctctctctctcaatgaaacgttatcagggttcaaattcaaatgccagctaatctggctgaggttgaaatggagaagaacaaattaaaatatgtaactctgtcaccaccataatagcacctactaacaccagcatgtttcagttcaagtctatatgacctttgtgcgactaattggaaataagtcttcaataataattagtcaaacggatttgacaacatcattcattaagtacagccatagaaccagggagcttcagagtggagaggcatctcagaggctgtctcctcaaaacttcccagtctggggtcctgaatatctgagaagctaaacggaagagggagaagtcagtgggctcatttcagaatttcaaagagcaaagtaaatatcactcagtaactggtgatgtaactgtagcagctacgtaacagtagcagctaataaaaacatgcttttttcttttagaatgacttctgtcgactccaaatagtggttactctgatcatctgacgccagtgagaacacctgattgttcctattggtctataactaatacttgatgagggaaatgtattaataattactatttaataggagaaaaaaataagatattcaaaacctcaggtccaatatgagaggaagaaaagggggtgaattgaaaggaaaagtctccttggttatgaaaaatttgggaacttgtttatttagacttttatggtattagatgaagaatcagaaatctgcagaaaatgtgacttatctgagacttatctagtgatcttagcaaactggtgactttttaatgggtaagatggaatctctctctttcttttttctttgtaccagattttggtttatatagtagagtaacacccatcttccagtgctgttttctttaaagatgtcttaataatgtttcaatattgtattactttaaaaactcagagcatgtgctgcgggcaaaggactgcccctccaaagttaatgtgcaacatccatgcacttatttgaagttgagaccatcggtcccatacgtcaatcaagtgatatttatgctacacctgtgctgtatcaagccctgtgagagtctgctgagagatgcaagtcaagatgtgtgatctttgcctgtaacgaccttgtaggtccttgaggaaaaaacacaagaaatgattaaatcattgaatgtctataaatgagtgtaaactctaagaaccatttcgaaagcatttaaaggagaagaatcaaagctgaagtagttaaatcataagctggactttgaagaatacacaggataatagtagacgaagaagcaggagagagaatattccaagctggaggaccaaatgaggaaagaggtggccgtgggactctcccactccataaggtcctgagaggacacgtagatgccgactagctgtatggagcgtgctgttctaggcatccacgtgtctgttataaaccagacaaggttgagtatcttattttgggttattatacaagagcctttccttgtgctgaagcatgattccaaacacatctcagagcttcatttcaatgcctaatgaagcatttgtaacagaaggcttgacttctaatactcttcactagggtggtgctcagactagcctccctgtataggaaggaaggctctctgtggccagcttgatggacccaggtggcctctctgtgtagccagctcagtcccagtttccaccccctccatggtccctatgagccacccctgggagtccttctcatcttcccttcttacctgttccccttgggtctccaagatggagcggtatagaggccccctttacctaactacctctaagcccgtaagtagcctcaggaccctctgctgcctgcactcttgcagagagcttgaagaatgacccagagtttggtcattgtgagggtcccaggagcatccactggctcagctgccaccttgcctggtcagagcattcattctagaaagtcccgagtgtagccagaaccacatatcagttcagactagtttcacaaattatgcatcacacttaaagcccagagtgcaccaaggagtgtgtccctggcaggtgttcagtgcttcttcctgccatcacctcctgcgcctctgccagctcctttccccatgccaggagggctacatttaatcttgggtgaaagcatgcatgtgagcatgtgttcatgtgccagagcctaagccacacccccagaatgcagaaatccagacttcagagggtcacccctgctccatgacaggaaaggaaatagaatagcagggaggaaaaggatagccaagagcctctaaaatcctctctggatgcccaaattccatttttatgatattcagcataactggatacatggtgggtgagagagaagctcagtcgtaaatcacataactgtaggactcttcagtcacccatcacagggcagccttttccccgttccattgcgttcatcccttcagctgcagatatcatcttagcaccaaccgtggcacagggctggcggatttagagctgactgagtaaatatcagggtggccaggcatggctatacagatgcacctccactgtggctcatgccatggaggcccctgggagttgtgcaatatggcacaacttgaggatcctgccaacctgtcatgttggccgtgctggagtcgtcccttctccgcaggattggtgaggggcccaggccactggcattggagcatggcaggaaaaagcctgaccagaactcacctgggtaaattacaaagtgcttctccacttcctctgtcctcctgtgctccctctcatctctccagtgaaagggctgcttagatcataacattcttgcacaacccacggggtgccagttaagtagccaagtggctgaatttctatcagagcttcagaatgcggaatggaggagccccaaagtgtcaccctggatcctttaaggaacaatttctatgatgatgtaatagaagttgacatcccctttgatcagtgtcttctgggtgggtctgtgagatgagggtgggggcatcatctctgtggactgggtggggtatgaccagcagcgcattttgctgaagctgtgagctctctgtggcagggtctacctctttttctccttttctgacccacctgagctgggtgcaggctccctttgcaccgagtggacccacagacagctgtttgttgagtgccttgggaatgctcatggcttctgtccacaaggcaggggcctcacagctctgatgcagggagctccgctcagtttcttggcctcatccttcttcctgctttgtgcattttcccagaataatgacagtcactccttcccatctttgctccctctcccacatctcccctacacaaatctttgtcctccctggcttgacaccctctgctgcacagcagagaatgagttaaaaatcaaaacccacagcaaagagtgtcccccgtacattttttgtgagctgtaacatctcctgagagaaggtagttgttcttctaacctgcagattgatgatccgagttccacacagtgtcggctgaagggagaagcaattaaaagagaacacagtggggcaccaggttcatctcgagagctcttgtctctggcagttgccctgagtccaaggaagacctcagaaggttcactaggcccagcaggatccaccacttaccaaacccatgattaataggaacagaggtgactcccacgacaccacaaccatctgcagtgtttcagtcactgcccagtgaacagaactcagcttcagtggtgctgggggtggttactaacgtaggcaccccggaattttagccccaccgggaactaaaccaagtttaagctctgctgcctacgtctctggttgaccagcagagggcatagaaacactttcttctctcctggagtttgctttttctctgggagcgaaccaaaagctgtattttctaacccatgaaaattctagtttatgaaaagatatgtaaactggtgactgagggcctgcccagacctcctggtaggatggagaatgatcaagggccaaatggtttgtcttacccagccagccttgagaaaatcctcttccttgaaagcctctagggagaaaggaggctcccactggggcagcccctggatggtcctccagccctgttctccactgcttcgccccagtggtatctgagcccaggctgcctcgctccaaaagctagtttccccgccagcatttctaagtcatgaacacggatcaaatgcccgcacaggggctgcctccctactgcagctatgacaattggcagagaccaggggcaggtcaggacaggtggtctcccagatattagtccttgtggcctgccagtcacaacggcccttctgctgcaagccatggaggctcagtgcaggatggatggatttgatgcagctgctggcatttcactccctgccgctgcccttggggaggagcggtacctgcaggttttttataagagcagaagcttccaaagcttcaaggggcttcccatgggcagcagatgtgcagagaggagctgctgtggctctctgcagcggggaatgtggcctgggctctgagttcccagctcaggcctgtggggctcgaagatggccaacactaaccaaagcctgttctgaatttcaaattgacacaaaggttcctcaaaaccagtgatggtaaacacatacgggatgtcaggatgctgctgtgacagcagttttgctgttgcctgagagagacaaggcaggtcaactccaaggcagacagaaggccagggagagtccccagtgtgtgcagggagagaaaactgctgtctagggaatgttaccccataccttccccctctcccttcttgccctttccccctccttccctccctttctctcccctccccttcctcttcctccagcatgcctgttgttttcacttgtacttaaaaaaattcttggttttatgtgacaaagaaaacctttttatttttacataaaagtttattaaatttgattccgcggcctggtgcaatggctcacgcctgtcatcccagcactttgggaggccaaggcgggcggatcacttgaggccaggagttcaagaccagcctggccaacatggtgaaaccccatctctgctaaaaatgcaaaaattagctgagcatggtgacatgcccctgtaattccagctactcaggaggctgaggcaggagaatagcttgaacctgagaggcggaggttgcagtgagccgagatgtagccactgcactccagtttgggtgacagatcatgaccctgtctcaaaaaaattgattatgaaatttgtatttccatcagctccggtcatctctatatccagctgagtgatgtacattttcatgtggcacccaaatcatcctgcaaaaaggaccctgagccctcaggaaccgcagggagcctgcagagctcccagggtcctcagggccttcccacaggggctcagcagctcctcctcagtgctgacagaggtgacagaaagtgacctcccatgtggcattgattgagggggcaggaaatcacccaggtgtcatccatttgtgtgagaagttgcaggggcccagggggcgtgggaagacgctgacccagaaggttgcttccagccagggattcagcccagacggcctccctctgtgaacctggttctcctgtctgcctagcatggggctgaggaagcctcactgacttcgtctctggacatttgaccccttctgggccttggaaaagccaacactggcttcttcctatagagccaggttccccgcatctttcacctactggtcagacatggccttccaggcagagaaagccttgtaggtactctcaccagcagatggccattttcacttggcaagcctcccggccacttccttcttttcacagcagacctgagagagtggacagagagccctacagaacctagggcaggcctgggagatggaggagacccatgccccagctcaagagtcaagggcccacctgaacaatgaggtaggggaacagctcctttcaagcccttccttccccaccctctctggactctggataaagaaacacgactgctttcctctcacccagaagccagaaggacctgagcacccaggacttgtggctgtcagagagctgtggaagggcaggggacaccagatggcagcagcaagagctgggcggcagcatctgcccaggccacctgcggagagaaggctggaatccgagggatcacactgggccagcattgagcctgtggccaccacactgacccctcctcagctccccctcacaggacctgaaagcatttctgagttaagtctgcataggaagttttccagagccatgccacatatccctccatccactcagtgcccattttacagatgaagagagaggcacccagaaaggtacaccaaggcaagatatggcgtagacaggatgagggcagagccagcttcctgatctgatggaagtcatgaagccttctctgccttacgcttggctctgcagggtcgctgagaggttcctttaaggagatcatcagaatcctaaatggcaaaaaatggcaaatcaggggaagagttggagcccagcatttggggacacacacacacacacacagtcgtcttgccttgcagaaattgggttgcattactccagtctgccactgagtggcacctttgggccatgcacttggctccaaagacatttctctgaacagcaacagaaaaacatgtttaaccctaaaaaaaaaaaaaaaagaaacaagtacatcttactttggatgaaatttgatgacagattgaatgcactgtctgcactttccaccacgtcatgtttcagcttcgcttgtccctccctttctgttgactagactacctgtgattcccgctgctctcggaaccagcacaggacctactctcttactcactgatgggggagctggcctgtccatgcacagggcaaaggatatgacacccagacctggatcctgctgcaaggctgccttgggaaccatccttaagacccggtagctgttgtccaagctttggctctggctgctgctgctctcagcagaaaagagctcactgctcccatgcggatgctgagggattaaacagaggcaaatacggaagtgagcagatttttctctcttgctctcagcagaaggagaaccattctgcagagaagttttcaacatatgcctcttcagcattgctccagatgcgtccgtcttcactctgaaacccatatattgagcacctactatttgccaagcaccgtgctgagcactgatgtgaattggctcagtttctccatctataataggaatggctggttcattcttacacagatagtctttatgattccaggacactgcctgcttctgggatctctcctccattttgatgccatcacttgatcccaactagatttgacaaagggtctcacactgtctgcatggtggcatgtatgtagcactggggttctcaaccaggaatgagttcatctcccaggggacattgggcaatgtttggaaacatttttagttgtcataacttgggaaggggggttgctattggcatctagtgggtagaggccaaggttgctgctaaacatcctacatttcacagaatagcctcaacaacaaagaattatccagcctgaagtggcaatagtgctgaggttgagaaaccttcatgtagaaggagagaaatcccgttctgataacgagaagcacattgatcttttaatatgcaattcttttctgttctgcaccataggaacacctttgatgttttcacaatctccatggtctttgcagctcatgtagtggcatcagggcaggctgagagatgcagcagaatgggtttcatgggacatcagctctggggccatctcaggcaacatcccgatgctgagccccctggaactgactgtgtttctgctcccacttcaggttctggctggctgtccaagatcttaagaaacaacccctacaggatgtggccaagagggtagaagaaatctggcaagagtttctggctccaggggctccaagtgcaatcaacctggattctcacagctatgagataaccagtcaaaatgtcaaagatggagggagatatacatttgaagacgcccaggtttgcttatctactcaagtggttgtcataaggtgttcatttgtccccttcattgcctgacctattaacacaagttcaaggcattgtgggtagttaaaatttcagatttggttatttttaagttcatcagtggaaaccatttcagataggcgcacagcaaaatcccaggatcgttttcctagatgggttatgtattacatagaaaccaaaatgtgcagttatatgctttatttgttccaggaaagcctcaaagtgttttacaaaatctgaaggcttgtaataagtcagtgatagaatctggaaaccagaacacagcattggggaagtgggtgtagtgagttagcagggccatgagtcaaacccacatctgtctacctctgaagcccacactgataaccacctctctacactgcttccgcagtgatctccagctctgcagtgaatattttttaagcacatctatattccaggctctgcgctatgtgataagataccacaaagaacaggcaaaacccctgttctcaccgaggttgagtgggagacagacaagtaaatgggcaacttcaacagtgtgaaaagtgccccaaatgggtgaaccctaggttaaagcaagcctgcaggagggactcccaaccctgtaggacacaattaagatgctcacagatgctagtgatgctggctaaagaaacaggaaccaccctaaccagcagactaaattttgacggctgggaggtgccatttctaaaaataagcattgggttggtttcttacttcctggcccctaatttctatttcctgtcaccatcccacacccagtgacagggcttaagattttgcttatctccttgaccccacttacttctctcacctctggggcccccagtagagaatttgggtggtttgccccttgcagacattattatctgatttaggaaactcagtgtagctgcaccaatgcaaataatggcatgagaacagtgtcccttatcatccagaattaccttgtcatttgctcagaacttcaagatggaaacacctaccaacctcaacaccataactatctacttctctccccctggtcacgagctccatcaaatgcctgtgccaatcacgaaatcatgactccttcatataccccttgcagcttcaaagcagaatgtttgagtcatgagagctctttgctgagatatttttgcttatgtgtatgtacgtatgctttcaagcaccatattgacatggccagagaggagagtgacaggggagttccgtgggggttccctgcatgaacaagctgaagctcaaactccaatatttatgaaacacaagaagagggatactggtcaaaaccttgatgcatctagcacagtattaacactccaagcatgacatcaggagggatttattttaattttttattatgaaaacttttaacacttggaaaagtggaaacagcaaaacagcaaacatttatagaccctcatccagcctcaaaaatcatcagtacacgtctgatcttgctttatctctagccccatctactttttcacctgccaccaggttactttacaacaaatccaagatgttgcatcatttcatctgtaaacttagatatgtatctctaaaaaaaagatccttttgttttaatattgccacaatatcctttatctccctcccttcctcacatccccttgcaatttatttgatgaaggatttagatcctttgtcctgtaaagagttccaagctctggatttttctgattgcagccctgtggtgctatttagcatgttcttctatcatctctctttcctataaattcgttttataagatatttaatcagatttaggtttgatttttatggacaaaaccacttcatggattgtgtggtgctctcctatcagaaggcacatgtctagccacctctctttttgacctttttgcagatattgatgtctatcgcttatatccattagttaattagaggttacaaaacaacaacgtactaattttattctttcttcacttattagctggaatactttcataaagagaaacttccctccaccactatggtattaactagcagtacaattcacataagaaaagcaggataaatatttgattctctcccttcatttgccagttttcaaaatgagtggtttgctattatcttcctatggtaaacattagggtctattttggttttactatctttgtaaactcatgagtttaaacatatatgctatgttttaatccattttgctgattacttttattgatgcttggattgggccatctctggccagttggctctttctgacacagccctaagagtgatctttgacatcatccaaatagcagggaagctaagatattccagtctttgcccttacccagaataagctgtttctccaaggatccctgattcctcttagtgagaaatggtatttagagactaaaatctaggcacttagagtgtttcattgttcctggattgtttatcatttccagcccttttcagtcgacagagctaggaaatgtgttgctgtttataataaaaatacatcctgagttcatactgatacttttaattcaaattctgacctacaggggattttatttaaccgcttgtttcttacacctgtgcctcttttctctatgctgacaatcctgactttcaagggcactggatgatagcataattactcatttgctttatactacacagagcagtctctaaaccacaatgctaaaaatacagcaacagtatgattatcgcctggttctttaattgttgcatagtattccgttgtgtggaggcaccatagtttagtcaaccagtcctctcttcttggacatttatgttgtctctacttcaagaaagttttgatggaagaagtggggaagtcagcctaacgaaggttacatattgacaagtatctcaatatccaacctacagtgctctaccattttccaagtacttctaaatacattctatctaatttctacagcaatctagactagacatgaggatgtcttaagcatccccatcttcttcattatctgctaggattagtctcccatgaattcaaataaaacactcttcctaagccaatccctattttcagaccaatttcctattgcttctgaagtgtatttccaccataaatatacaaagtgttcctttctagcagagtgaccttggacaagttgcttaaattccctgagtcttcctttcctcatctgtagaacagggatacaatggagcctacacataggggtggaatggggaccaggtgaaaggaagcatgtcaaccactaacgatgtctggcccacaataagacagagtaaatactaccatcttatttttctaatgtcactaatattctctttttaagccgtagtgtttaatgtatttggtaaaaatttttaaataatttcacataaccttagcacccagagataacccctattttggtgtattttcttccttgatttatgtgtgtagctacgtgtaaggtctgctcaggctgctaccacaaaatagcacacactgggtggcttaaactacagaaatttatcacagttctcgagactgacaaatccaaaattaaggtgtcagcagatttggttgctggtgagggctcacttcctggcttgcaggtggccgccttcttgctgtgtccttataactctggtctctcttcctcttcttataagaacactaatcccgtcataagggcctctctcatgacctcatttgaacctaattacctctcaaaagacccacctccaagtaccaccacactgaggatcagggcttcaacaatatgaaatttagggagacacaacattcattccacaacagggcgattttgcaaatagcgtgatcctgtaacctgccttttacctaaaacaggggtcagttaaaaaactatacttttcctaaaaagagccagatagtagacattgcaggctttgtgagtcatgtggtctatgtcacaactattcgattctgcatacaaaagcagctacaatgcaacaacatagcaatgtaaacaacataaatgaggacctatggctgtgtttatttatgaacagtgaaatccaatttcatataatttttcacaaaatacaattcttcttttagtttttttcagccacttaaaaacataaaaactgttcttcgctcatgggatgtaaagatctagatcacaggtctgtatctgtagatttgaatcacagactgtagtttgtgaccctgtgctaaataaaatctagcacatggtcatgaaaattattgaaatgcttcaagaaatccagaaagctacaggatagaggattgggcataaaggatcttcagtttttgggggagagtaagttagaggagacttggttttgacgcagccatggcaacacagcaatctgaattgtgaatgtttctacatgaggattgagtgttgcggagcagaggtcagcaggtgccaagagactcacactgccttaccttcctggacagcactggctgcctgccccagcaaagtaggtgcagttcagaagttcccaggtataaaaaggaggttaaaatcctcagcagcccatgaccagccaggacttgcactcagatgtcctcgcttgctggccaagattctgctcagaccacactgtccctggattgttagtgctgagggcttggtggtcgcactgagacctggagaagttctagtccctagagaaaggccaagagtctgggagttccttctagaattatccatttaagttctttaaactttctcttctcggtttgcctctctgttaaatggggatgttaacacctcagcccatggggctcaggggctctgggtggcttcctcagctggtcatgatggttctcataaaccccctgcagtggtcatatgctttaatattagtgctcagtagcctgagagaaagtacagccagatttatggattcactggaagcagggactgggggtggggtgcagcctctctccaatgggttttgtttcttatttgaccacacgcattgttagagccaagttaattgcctgtatttgcttcctgtggaaatatttcacaagacaccctgttatcgtgggcccagcatttgtacttgtgttttgctgatccgtttagcttttttgaaaattttgggccaagaccaaatcttccataaaggtctgtgggctgtgaccatagtcctcagctgtttgctgtgttgttccaatttcatagatttagccttgtgaggggagaaaaatatataggccatgattatttttttttaaggactcagttctttatgctatggatttaattctctgttcccaaccatgtggccttaaaggacctgcattgtcacctgcttgctatgtggtctgaggcaagggccttgaccttttgtgccttagtttcctcatctgggtgatgggggtgatgtcttctttacagcccgctaaggatttcagagaaatcagatgagctaatagccctgaaaaatctttgaaaaagtaaaaagtgctatatatttgtaagtgtgaactcacaaaaattaatgactttagtactctctggggtttcgtaattctaagctggatccaaaagaaattctctcaaaatatctgcccttagatgggaaaaaatgccagaaaaggatgtaagaactgaattttcaggtcctggaatgcatcctaaggaatttgagcttctcatcctgaagacagtagcaaagcattgcaggcttttacctggaagatggtgaatcccatggtgatgggcatagtaggctggagccaagagagagttctgaaccctggggcatgtcatataaagctctgctggcagttgttggtggagagaattaaaccacaggaagtattgagaaccttcagcttccttgtagggcatttgtctctttccaaagccttcacaggctctagatgagatagaaatcaaatgccagcacagtggctgcctggcttccattttaaatctcagagtaccaaggatgttccaaggactatctccctggatccattcaatcatttgtccatctgcccatacacccatgtcatgaacatccattctcccattcaagttgggaaaccttgacccgtgcggcataatattctgtgcagagggaaataacatgagaaataggaggcccagatggctttttttttgccatcaggcagagcttatctaaaagcacatcattttcaaacaaaacaaaccagacctaagaaagcacttcattgagataggattggattggaaatctgtcctttaagtggactgatagtggaataggacaagccagtccagccccattggctttgatccttgcagtttcccacctcaccttcctactcgtcccagccccactgctttcctgacctgtggtacctgctaagatgccccaccctgccctgtacctggagtgtctgggccttccagacctctggatttgaaagttatttcatgggagcagaaatttggtcttctttaccttttataagttcctgcatcacaaaggtaatgctgaatgctgaatgtcagctaaatgctgataattcattccagaattataacattttcagctgtgcctatcaaagaagcgggggacaatttgtcccttagctttcaactttggagagacaaccttggggagtacacctagtagatagtcaagaaaagcaggttaaattaaattcctacaatgtgccgattcagcaaaacttggaatacccactaagtgtcagatgttctaggcgctgtgaatatacaaatgcgtagggaggttcctttccttaagcggccctgggtctgacttaccacagctctgcttggccttgatgaactcacaaaaggatcaaagagcatgctcaaggccagaatgaggtctgcgtgataaaagagctgagaaagataccgtcaagtccacatccgccatgagcagacaagaagcctctagcaaaacgtttatattattacctaagtgtagatgtttaaatgcaacttgattaaggaatgcaaggtttctaccatttgctttgtttaaaagccaaagcccagtagagtatgattttaggtttgcccagattattcagaagtagaagtcttcccagctgttcatctttgctccagtggtggaggtggcggcattgcgtgccagtatcacaagaccacaccaagtttcctggtattaatcctctattggaaggcatttcctggtagactctcatgccagacatattttaataaggaattctgtgacactgcttgctctgggggttgctcattttatcctgtaggtggttttatttttgggagatgaacagcagagggagggatgcattttgcagagaataaatcagtcatttgtgatccagttctgtttattaccacacagactagtagttcctgacagctactgagagaagacgtcaaagagttcaattccaaaatttcttggttgctacatctaagcatagattccttataccaaaccccatgacctccttgaggaggaaatgaaaatacttttcttcttttttttttttttgagaaggaatcttgctctgtcacccaggctggtgtgtggtggcacaatctcggctcactgcaagctctgcctcctgggttcacgccattctcttgcctcagcctcctgagtagctgggactacaggtacctgccaccacgcccagctaattttttgtttttttttagtagagtcggggtttcaccatattagccaggatggtctcgatctcctgacctcatgatctgcccgccttggcctcccagagtgctgggattacaggcatgagccactgcgcctggccaggaaaacacttttctaagttaacatccctggtatttgggtaggtgaaagacaatatgcaaagctgtctttgaagctacacttttctaagagtagggattgaacagcatgaaaatactgtgccctttggccagttaaattaaatctgtttttatagatgctttgcagagtaaaggcaaaggatcatttactctcacatcctcttatgacctggaatgatgccttatgtggaaacacagggctcccatgtcctacttaggaggctaaggaaatccaaagggggcacttcccattttagatccacatgatcccaggttgttcatccaaagatacatccagaaggagcaacagcttcctatctttcacttatgtggatgtccatattgttgcggtatcttttctgttgcctcttctatgtttgttaagcagatactgatttgtgatccacttcaagtcctcaccactgtgctgtcctgcaagaaccgtgctgaagaaaagctcattttccctaggcttcagctaaccatgcctaaggtctgaggacctttggtcaaacatattcaagtctcttgaaaggtgagactcaaggatacagacttatgacttcctaagggcccatcagccctcaacgctttaccaggttgggaccttgtttccaaagatgttcatagctcccttcaagtatagatggcaagttgtgcatggactgcctgttaagtgagaaaccagagcctgggccatccctggtgtcttggccattaccattgctaacagcagtgatagtgaatagtacccaaaagggaattgtaagcagtggccacaccttctactaggatgactcagatttaggactcaagaggaggctcctaactttcctgcaaccacacatggagggattttgtctcagccaaccagtactgactccccttgggacccaagtaaaggacaatgaaaagcagcacttcaatgtgagaagagcgtgagctttggggtcacagagctctgggttcaaatcctggttccatacttaccttgggtaagccacttgacctgttagagtttcagtatcctcatttgtaaaatgggggtgtttaaacctaagcactacttcagagcaaacatcaccaacaactgaaatagtacagctagactctgctcccaaatcctctttgcttctttctccagaatctctctcatcccacaaatcatcccttgcaaggacagtcacagcatgaaattattattgccacttgacatgtataatcatttttgtagtgcttccacttctacttccacatttaattgtgtgattgacaggactagaaaggtgagcttttggctcccagtccagttccttgtccatcaccccacacagcaacaccacattctgtccacacagcctcattttccttcaagagactacatgggacccaaaagctcccaaagtctggatgtgattctaggcagcttaggtatggagggcagagatgaggcacacacacctacaaaaagaaaaataggatacttgaaaatcacaagaagagctcttggccgctgtgcaatgctccagctgggtggttctccactccaggaggacgttctgaagctgggaaatgagatctgtgctgtcttaggagcccacagcacaggggaggacataagggtcttcttgaggagttcagctgcatgcttgtggcccagggccccagtcatttgtctgattagcttccccacctcttgagagagtcactgtgttttgtctaaaaagaaaggagatttccaaatgaggactctctgagcaaaatattgattttcagcaggtgtggttttgagacagtttgtactgcatgctctctccagctctcactgtgcctcggactctattgattctagttggttttgatcctgccttagcattccaggaaagcagagctctcctagcccaagaagagaaaatgaaggtggagtggctcatcggggtaacatccctccactacagccatcaaccactccagggatatgatgcctcccactgctgaggactctggctaagacactggtgtgatttagagccctagagcattggtttatcatcatatagagaaccaccctcatcttctttggaggaggtgcctctccactgcatcccaaggtgggagtgacctctggtagttctgcttgttcatagtcagcttagtcatctctgttgtagaaagagaaagagagagagggcaagaaagggaaagacggagggagagaggaaggaagtgggaaaggagggaagaagataaggcaagacaaaataagacaaagcaagaaagagagagagcacgcgggccagcacgctttttctccatccccttaggaatttactctcagcaggggcttggcttggctggttttgccagtgactcccttgcactttgcagattctgaatatacatttcccttaagactggttgtctgcagaataggggaaacaaaccagcacccccataaatcagcagaggtcactgccaagagctttgtacacttgctgtccctggcagtgataaactcattgcatttgggaaatggccaaagaccctgagtccaatcttaattctcattcccagaaaaatctcagttttctgttcacccacccccgtttactgtctttgtgtttcctagacaaagctggcaaggaggaaagaacacagttcaataactggatcatcaaaggctgcatttcgttgcttgggggaggagttgcagggcaggaaagagtcacagatccctaggctgtggaaaagagaggcccaggccagagggaggctgaagccatggggtctgcatggggtgtgagagatccgcagaggttctcagattctggttttctcagacccgcaccttggatctgctattactgctgtggtcggttgttcccttgaagggtggttcaggctgttataatggtggtcaagggctagcagtgggattggtgtggtgagaccacctcatgggactcatgctccagtaggttgtgttcttattctcttatctttctccccacaccatcctcaccttggtatctggctttggagttggccatatgacatggagaagatgagagtggtgtccaaactgctcctctgacccacatgggcctcctgagagtggacaacctctctctgctgccctttcctccttgccccttgattgtctttctcctctgattgatcagactgtgaagctgcaagaccagacccccccctccctgcaatcccacagaattaggagacatatttctgtctctctacacagatctttccactttgatgaggatctttctggttgagagaccaccattccccacttgtagcaggataggtcatccccaggtatacacattcataccctgtgcctgtacttcatctctgcagcccttagctgaattggctaaatgcgtctctgtgcaaagtctatcttgcctagttggatctaagctttatgacattagaggccgatttgtcttattcaggctgttatctcagcgtctgacacagtgccctggcacctagtaaatgctcaataactatttgctgaatattattttgattcagtgtttagacatctgctttatcctgctctattttgattgacaagttctttctcttcatgaaccaggcttttccctcctacaatgagtctataagaattagctagatcagaggggaatttggtgctgagccagaagagctgtctaggggaggtttcctcacttcttatggggcagcagaggggtattgtgagatattgagaagtcagaacaagaagcagggaactgttgctttggagaagggtctggagaggttccaggcactatgataggcttttccagatgactcaggagccacctggctctgtcagccagaaagaagtgatgcctgacacaaggagacagtgtgtcatttttactgtggactaacatttgtacctaagctttaaatgttaaaataatttggctgggtgtggtggctcatggctgtaatcccagcactttgggaggccgaggcgggtgaatcacttgaggccaggggtttgagaccagcctggccaacatggtgaaacaccgtctctactaaaaaatatataaaaattagccaggcgtggtggtgcatgcttgtaatcccagctacttgggaggctgaggcaggaggattgcttgaacccgtgaggtggaggttgcagtgagccaagatcacaccactgcactccagcctgggcaacagagcgaagactccatctcaaaaagaaaatgttagaacaatttaaagagacaacaaatgaaaccaaagaccaatgatacccctcagcctgggctctgagaccattagggatggctgagccaagattttcatgctcctctgagctgagtgtaatcctcattctccttctgtgcagagagcaggaacttgatgcagtcataaacccaagcaagtatggagccagtaaacttgctgaacattaaattccaaccggcatttcagtgaacatgtatattcgactaatatctgagcctgtgctagacagtatgcatctgtaaaaataaacacatactgttcctcaaggcacttaaacaagagtgagctggatttttgtctgaaattttcagaaaaacacttagtgaagtgtgttcacactaagtttgttaaatcagaatacgtctggactatccaagtagtctcagaaccaggccactattggaggctgggcgcggtggctcacgcctgtaatcccagcactttgggaggctgaaacaggtggatcacttgaggccaggagttcgagaccagcctggccaacatggggaaaccccgtatccactaaaaataaaaaaatcagctgggtgtggtggtgcatgcctgtagtcccagctactcatgaggctgaggcacgagaatcacttggaacccgggaggcagaagttgcagtgaactgaggtcacaccactgcactgcagcctgagtgacagcaagactttatctcaaaaaaaaaaaaaaaaaaaaaagaaccaagtcagtatttaatttcatttgagtccttccagtgggtttattcccattagtggggtaactcccctgcttttgtaaatatgagggtatctcaggaagaataagtcccaaaacaagattctttgggttccaaccaaagatgaaaccaagagggcctcacatgtgaccaagacattttctgctttctactttcactttctttttgtttattttttaaattgagatgtaaaagttgtatgtatttatggtatatagcatgcaattttgatatatgtatacattgtggaatggataaatcaagccatttaacatatgcgtggtctcatacacttattgtttgtagtgagaacacttaaaatctactctcagcaattttcaagtatataatatattgtttttaactgcagtctgtagtcaccgtaatgttcaagagacctcttcaacttattcttcctctctaattatgtggtgtcctttgaccaatgtcttcccagtccttctcactccccacagcccctggtagaatggccattctgctctctgcttctgtgagtgtgattgtcttagattccatatacaggcacatctcgttttattgcacttccctgtattatgccttatagattctgtgttttttacaaattgaaggtttgtggcaaccctgcatcaaacaagtctatcagcaccatttttccaatagcatgtgcttactttgtgtctgtgtcacagtttggtaattcttgcaacattaagcttttttagtatgattatatgtttatggtgatctgtgattggtgatctttgatgttactattgtaattgctctgggggtgcccaactgcacccgtataagacaatgaacttaatacatgttgtgtgtgtgtgttttctgactcctctaccaaatcagccattcccccatctctttccctctccttgggcctctctactccctgaaatgacaactatattgaaattgggccaattaataactctgcagtggtctctaagtgttcaggcaaaaggaacagtcgcatgtctctaactttaaatcaaaaactggaaatgattaagcttagtgaggaaggcatgttgaaagccaagataggctgaaagctaggcctcttatgccaaacagcctaggtgtgaatacaaagaaaagtttattgaagattgaacatgctactccagtgaacacacaaaagataagaaagcaaaacaaccttattgctgatatggagacagttttagtggtctgaatagaagatcaaatcagacacaacattcccttaagccaaagcctaatccagagcaaggacctaccttgcttcaattctatgaaggctgaaagaggtgaggaagctgcagaagaaaagtttgaagctaacagaggttggttcatgtggtttacaaaaagaaaccaagtccataacataaaagggcaaagtgaaacagcaagtgctgatatagaagctgcagcaagttatccagaagatctagctaagatcattgatgaaggtggctacagtaaacaacagatttgcagtgtagattaagcagccttatattggaagaagataaatctagggttttcatagctagagaagagaagtccatgcctggcttcaaagcttcaaaggacaggctgactctcttgctagggctaatgcagctggtgactataagtcgatgccaatgctcatttactattctgaaaatcctagggccttcaagaatgatgctaaatatattctgcctgtgttctataaatggaccaacaaagtctggatggcagcacatctgtttgcggcatggtttactgaatactttaaggccactgttgagacctactgttgaggaaaaaaataatatttctttccaaatattgctgttcattgacaatgcaccaagccatccaagagctctgatggagatgtacaaggagattaatgttgttttcatgactgctaacacaacatccgttctgtagcctatggatcaagaagtaatttcaacttttcaagtcctattatttaagaaatacatttcataaagctatagctgtcacagacagtgattcctctgatggatttgggcaaagtaaatcaaaacccttctagaaaggagtcacccttctggtggatgccattaagaacatttgtgtttcgtggaaagaagtaaaaatatcaacattaatgggagtttggaagaagttgattccagccctcatggatgactttgagaagttcaagatcctagtgaagaaagtaactgcagatgtggtggaaatagcaagagaactagaattagaaatagagcttgaagatgtgactgaattgctacaacttcataataaaactttaatgaatgaggagttgcttcctatggaagagtaaagaaagtggtttcttgagatggaatctactcctaatgaagatgttgcaaacattgttgagatgacacaaagaatttagaatattacatcaacttagttgataaagcagcagcaggatttgacgggattgactgcaattttgaaagaagttctactgtaggtaaaatgctatcaaacaccatcacatgctacagagaaatctgttgcgaaaggaagagtcaattgatgcgacaaacttcattgtcttattttaagaaattgccacagtcacctcggccttcggcaatcaccaccctaatcagtcagtatccaacaatgtcaagacaagaccctcccccagcaaaaggattatgactcaccaaaggctcagatgatccttagcattttaacaataaagtattttttaattaaggtatgtaccttgttttttcagacataatgttattgcacacatcattgactacatatagtgtaaacataacttttatgtgtactgggaaacgaaatatttcttatgacttgctttattgtggtggcctggaaccaaacccacaatacctccaaggtctccttacataagtgaagacaagtggtattttgtctttctgtacctgacttatttcacttaacctaatgttctccaggtttgttcatgttatcacaaatgacaggatttccttctttgttaagaccaaatagtattccattatgcctatatactgcatttcctttacccatttatctattcattgatggactcataggttgactccatatcttggctactgtgctctccctttcttttgtgctgggtaaggagtgagtcttggtgaatccttgtcattgctctgtctttttctggccaggcatctctaaaatgtgtcccccagctgatgggaggtctgtgcctcctccttcgatcccttccctggaaagagcaccaaggaagaggtccttaatgaccagtcctgcctctcagatgagcactctcctcctccctgaccagctctccatccccctcaccactagggcctttgtctggcttcatgagaagaacaatgagcatacatgggggaagatgcttcctccaccaggacagccattaactaacaagcccgccctccccagtgaaggccaacctccctcctaacacattctctcttggaacagccaagctttcctgtgcagctgagctgaattccacttcaatggataaataatcttgcccactgacaagtcctcttttctaagggaccaggattttccaacccttgatgaggacagatctgtttggaagggaccacaagattctaggaattagctggaaatcaggggtgaaattatttgccaaggccagaatgtataacaaatgcccctgggagccgaggaaaagaggcggcaccttgctgcagcacctgcccctcctgggtgttagttacatgtcctgtgatgtggttgccaagaactccttccaggacgaggtggtggccctgaaatgcacaaactgacccaattgcattattgcctgtttttttaaattaaactttttattttgagatacgtattgattctgatgcagttataagaaatactgtgctgtttacccagtttgccccaatggcaacatcttgcaaaactatagtaccatatcacagccatgatactgacatggctacaatcccctgattttattcatatttcccagttttacttgtgccccatgtatgtatgtgtgcatttagttctatacaactttatcacgtgttaagatgtgtcaaaatacagaaccattctgtcaccacaaagatccttcctgttgccttttataaccacacctcccttgctccctctacttcctcatctctaaccccaggaaccactaatctgttctttgtctctataatttgtcatttcaagaatgttatgtaaatgaaataatatagtttataatctggagcttggcttttttactcatcctaattcccttgagattcatccaagttgttgttgggtgtaagaacagtttgttcctcctcattgccatgtctggttttaatcattaagcaccccaacatggcacccaagcccaattacaaatccctcaggacatgatcctcagggaacttttattctaagagagcccatatgttttgtttggtgctgctgagtttgggggtgtggggatggaacatgttgcaagtttttctaggtacatgcaaacatacctaggttccttcatctccttccccaaaacagtgatcaattggattgtaatattctttagcactggttgacagcccttccttgtgtctccttgtcaccttcctccccaggagcacatctacaagctgatgaagagtgacagctatgcccgcttcctccggtcaaatgcttaccaggatttgctgctggccaagaagaaggtatctttgggaagggcaggcttgctcttagcactgttgactcttgcctgctgcttgctgctggtttgaaatgagaatatcatcccttgggttttatttatttcctactttcttctttcccttctctatctgctcccattctaatggaaaacagttaggattgtcaccaccccagccccactgcaaggtccaggatggggcatcctacctccacatccctactgcctctctctgcatgttctgcccatggtgggggtgggtacgtagggtgacaaaagactaaggccacagtggctcagcataggagtgcagggctggcagtaacaccagcaaaacccttaggacactggagagagcccctcactgcaaagtccagccccttcacctcagacttctctccctgaccagcccagagaggagtatgaggccagggttggggcagctctctcactggtcagaaagccttgtcagtttcaagagcacaatcaggtacctaaagtcatcctggggtttctccctccttgacacccccttcctctcccgcacctgccccacggtgttgcctttctctcttaaccaagaagtaactgcacccagctccttcctcctcctccttagaactcagccatggttccttgcagcccatggagtcatggatttgaggtgcaggggccctcagcatgcaggtgaggggtgacagaagcaggaataaattcagctagattcctgggaagagaggaggaagagtaggcaggagaatagggtccaggaagggaatggaaggcaagagagagggctcctggtttcagtacacctgcccaccctctgtgcttttcagctctgatctgaggcccatgtgtggttaagtgtggctcaacttgcaccaaaccctatgacttctgtgccatggcacttagggagcacaggcatccctttctcctccctcctggactcccagccccaggccctaagcacgtggttgcccatcacatgctctccgctgggctgcctctcagccacgcaagccttctctctgtgtgctgtcaccctcatgtgccaggatcctgtctgcgtatctggttgggaccacacaactccagagtcctggagagcatttataacctgctctcctgcccttgtgtagccctggaaagaggccatggagtctgagaaaggaaagaggacttctggggtatcccagttgtcagcagctctctgggtttcctgcatccctccccacaggtgtggctactgtgatgggcagtgtggagcctggcctcctgtcgattcccctgctggaggatgccaatggaggggctcctttggaggaggccgacaccctcatacatggctctaatgcccattttttctaagaactagaggaaagaaaaattataggaacttttgataactccagcccagatctcatggatgaaggtcaaagtaagtttttcttattttctgtggctcaagacccctgatctgatcacagtttggtgactttctaaggctctggtagtttaaccagtctaggcctgtctacacacctagaagaagagaagctagaggccattgattctccttgtgggtttgaacacaaaggaaaaatgcaccccaaaccaggctgagacccctgtggctgcagatcctcccttccaagaagaaaacctctcagaggaggtcacttgagtgaggaaggaactggcaacctgcctgggaaaagttccttagagttatcctcccagctcccgaagtaagggatgttcttgagacagaaagcccttgcagataccaacaacgtctcaatactgaggagttgtttcccaaaacagtgacaaaacctgctttctccttctgtttcttcctgagagtctccaggtatggatctgatttgtaactcggcactttcaggtaggcctagagtattcttctgatttcagggacgggttcaccgtatccaggtcataaaaggtatgtgagattcacaacctccggcggagagagggaatatgaatcagcctcacttttctgctgagaactgacctggacggagtcttgaggcacagccttctgatccttcatccctaattcagcctcttttctaatattttccaaataaatgatagtcacactgaagaatcaggttctcagggggtaggtgagctgagtcctgagggctactctaggaaacttcagtaccagtgatgatggttttccagggcagctcaatggccagtgcaaggcagaggagccaagtgagccagaccaatggccaccctctgtgagccagaggataagaataacaggccgacaatgccagctgcagggcccaggactggcctgacttgagccaagtgtatgccacccaggctggccacagggttcaagctgagtcctgccatccccagaatagagacttggtatggtacccggggccaagcatgagtccttcagttcctagtacaagaagaaaggccagcccaactctgtggtgttatgtcgtttgtgttgtattttccttctgcaacctcatatctgtcttctggcagccagctgagctgacaaggggcctggctgccaaggaagccccccaacttcatccacacaggcggctgcctttggcctgtcccctctgctttcagcacagtccgcagacccacagacctcaggctgcctctttagctccctcatttcagttatttgctgggtgtatgtttgtgtctatgtgagtgtgtgcactctccgaacttctcagcctcgggctcaggaccctggaacgggatccaggatacactagcaggtatttgagcggtcattctactctcccggaacccctgcagctaggaaatgtggggtgaaaggaaagtcaggagcaccccacacctctcttcctcctgtagtagagggaggctaggcctggaaagacattcaagggctttgcctctcctcgctcctgttctgggaaccccagctaagagttccccacaatggtttctgagcttcctctagcctgtcgtacgtacatcttggcaggtgttatgtcaccttttggatactgagaaaacacacaatccccatgttattgtcttctgagacccaagaccctttgtccatggcaaaggctatgagtagaccctccttgctctaaggacacagaacgagggtcactaggaagtcactgaagttagcaaactttctggctgcctctgggcaggggaatctcaagagagaaaacagtcctaaggcagactcatggatgagtagataacttcgcttccccggcagccccttcctgacgtccctcccacaccctgctggctctcagagccagtctgttctgtgtcaggacttggggggcccccagggccccagggccacaaccaccagggctcctgcctgtgggcacggcaggttgaaagcagcaagcaagctgctcaaacccaccgactgtggtcctgcagcaaagtcatgatggttctgatccaagccccgcaagcaccattcatggcccccggagaagcaaagcccccctctctgctccctgctccaaggaggcggcaccatttctcgtgggcttctgtcttctgtctctcccattgactcttccaacagctctggctgcttctcttttcccatttttcgccccattttgctttggtttttgttattctttagctgcagctgctgctgtttgggaaccacgtataagctgaagattttttttttctgtatttttctccctacccttttttttttttcctaaagccagaaagtgagcaaggtcgtagaacttccctagaaaagttcactcgcagtgtggtaagttcagtcggttttcttccctcagcttttcttttggttttggttttttctttcttcttcttttttttttttttccctttggttgttgtttcctttggggtgggagggagtccagtgctttctccctcgactcagcccttttcttttgcgagtgtctgcagcttctcttctagggatgaaaatgcaaaaaagagcaagcggctccctctgcagaaggtgcacccttgatcgcccagcctcaggcctgggcatttgatcatctgttcagggctttgaggaggagggaccctgctgccctcggggctgtgcggtttgtgcatcttctgcagcagctcagggagaagccatcgaactataccgtgaaataaattggctcagaaccatagctcatcgaaaaaaaaaaaaaaagccaaaatttccctctgtgaaccctggcagtcacgccggtgtgggtcgcgagctaatgttgctgtgtaggcggcttttgctgtgtgcagaaagcggccgtgctgcatgggtcctggcgatgtggcctagctggcgtgtgtgttagtcgcctctgcatgagtcccttccagcccccatcagcctcatgtgcacagtgtgatagggagaggagggaagtagctgaatccctgcggtgtcctgggtactccccgggggcaaggtcctaccggcctcctcaggccttgattctaacaggctgggtaaagatgggcttcagattcctacaggttcatggtacgccccagctagagaggtagagctccccacagtggcacataaagacagccgtggcaacaggtgggagtggggagtccgtggctgttccctggggtgcatggctgagactctctaccatggtttgtagaacaacacaggccaatctcctctttccatgctggtcggcccaagatttgaacattgagctcagtgcacaagaaatactcaatcccgctcaatcacggggcccatcctgtaccatgaacatcaaaccagagggaaccagggagcagggtcccatgcagggagctggccacattcccttcccaaagggtggcagcccattgatattgacttgcctttgttccacctctgttgaggaggaaaatccttgtaaaacctgactactgtgtgactggtatacgtatttcatccttttaagaaaaagtctaaggctcctgggttgaaagcagcctagtcatttacgtgtcgtagctagatgcattttaagtgcatttaaacattatcttgaatttgctacatgtaaacctcaaataactctagtgggtggcaattaattaaacatcggtatccatcccttcccttcctcggtcttccctctctgtggcctttcctcatgagaaatcagaatgtgcagaacacaaggcctgcgggtgcctggtctatcttcatggctgctttgccaatggccgtgtggctccgcacaccaagaagctgccacgggctgtcagagtcaaggcttctgggacttccttcactccatgatggcctgagagaaggtagtgggatcccatctctctctgtttgtctcttttgaggactggctactgtgcgggtggaggatggttagggattttgctgacaagccaagggtgcctgtgtaagcagagccttgacagcccccggaagctcttgagggtgaccgtgcaggccacgggtgtgagaggggaagcctggtacttggacaaaacgtccagacattttcaggctgtttttcaagagaagtgagtatcaagaaaggcaagaatggtctcgcgaagctctgtgaggagcatttattgatttcctttcatcccagaagtggtgttggcttgggggttctcccaaggtctgttagcaaagcatttggaacaagaaagcaccaagacacccctaagtgtctgaagtgcacacatgggagagcttccagagggagtttcagagtgagctgaaggagaaaagtatcctaagctcctgagggtgtggataaaaggcccaaactattaaaaaaaactaaattcctaaattccctgctattttatgaacaagaaactctaacaggtgatgcattcagaatttggggttccagtggtggagatggattgccatccatccatgctcctcctgctcttggggtgacaccatagccccacaagatgtggctaagtttggggaataatatgacccatgtgttggctctcagattacttaagattggaacccaggaatctggtctcaacagcccagtggtctcatcaaacagaactaactaactgatcaaccaatatgccttgcaatttgatagccattctctgactatcatatgcctaaagtatttgatttctctaagagaagatctacgtgaatgttttatctgctatatactgcaagctataaaactaaatgaagggccagttcaatagcattcctgtgttgctgggaaagatgtgtaagaacatgacccatgtcatggggctaataatggaaacaggggagtgaagctgggcagctcacggaccaaagacgtgaggccaattaccatttaggattaattgatggcaaaaagaaataatgttgatccaggtgattggataactcattcagctggaggcttgtcaagactgaatctgaattcagaatttctccccagaacatgccaatgtcctttcttttcttggtagaagagaaacacttggaaaaaacaaattgttctttccaagtcttatgttgtgccatgacatagagggattatctgttaagaccacatatgcccccttttccatgagatcctaaggagacatttaatatggttcatggaagcttttagggccatgttagtttgggtgacgaaggggcctggtactccccagtcaatagaggaagtgctgtatgagcttctctttccaatgcaagcttcattccaggttactcaggacttggatatacaaagcaaatgtctggggacactgggccaagcatcctgtcattttgcagactgaaaccacaaaccctgcttatttgataaggcccaggttctgaactaaacatgactgaagtccacgacagggcgcaactagcctaccatgtacgttcatccaaaatggaaaacaagactccctctggtgggcccagcctcacagatgcccagctgaccaggcaaaacacaggctgggtttcagcccctattgatcctcagctgccctggtgcagtgaataacccacgccactgtacatggccacccttgtccgaggagcctgtttcagaaagagctgtaacacacagcagcttctccagggcccccaatacatggcctcaggtcatgtgatttggagcctgtctctgcctaatcctgctcatggggaagcttcctttcacagtggctgtaacatatgaaaaccacagtaggagaaatctggctagtcactgtgggttgcctttgcttcaccttccagctgttcttcagattctttggtgggaagtctcaggcattactgaccagggagaggaggtgccttctctcactgaagactctttcctgttgcttggtgatgtctagcctgccactctctgctatcttcctggttttgcagttgacagaggacaataggagcatgaaggtggccagagctgaaatgctcaccctcccactgcttcttgagacagagtctcactctccgagcctggagtgcagtggcacaatcttggctcactgcaacctctgcctcctaggttcaagcgattctcctgcctcagcctcccgagtagctgggattacaggcacacgccaccacacccggctaatttttgtacttttagtagagatggggtttcaccatattggccaggctgttctcaaactcctgacctcaagtgatccacctgcctcccaaagtgctgggattacaggcatgagccaccacaccccgccctctgctctctcttaagtgtgcttgttgcttcagcttccacagagtctaccacagtggggtggggggcctcaccaaagagggcctggctctgacatagaggaccaggagcatgcgtgggagggagagggggcaagaggaatcggggccaagccacagcagcagctcccttgttgagatagatactggctgaagccatctggtgagagctccaatctggggaggagaagctggagaaagtcctttgctcctctgtccagttccacagaaaaagccgcagagggtgatagcactgaagttaggagaaaatggcagccccgagtgaggctggtgtcagcctccctgggtacctttggaggctcagttgaaaccttacctgccctcttgagagcttcatcagctccagccttgggctccaaagatagatagatagaaaatggggttgctggtgccagagcaagcactggaggccacggaggagaagggagaggaggaccaggcgttcatccacctcctaagagagcatcgaagtttagctttgccaaggtgctccttggaattgcggcaggaagggccggaagctgcagaaggcttggcatgtgatgggtggcatctctgcgacaggctttcctgtcctgcctgcctgccaaggaatgcagcaggcaagtcagatggggagcgggaagctctgggagccagctgccactcagcctccctcgccccctccttccatccccctgttccttcccctgccaaaagccaaggaagagctaatgagagccaagaagtcaacagctcactcatccccctccaggcagctctgcagagagaaactcccagctccaggcccaggtgctgaccggaagtggagggctaaggctctccgcaggggagggggcaggcaggcaatcagggcagtcagccaaccggcagaagcagctcctgcccccaggaaggcggtgttgttttcccctcctcctcaaggtttcatggggaacagccttgcaccctggtggaatgagttcccaaatacctagactcagcagaatccccagagggctttgacctcagttgaaatgatctttctgtgcctctggcaagggccaattggctaaaaatctttccaaagggttagtttttattgcaaacagtccttggactcctttgggaccactgggtcacaaacattagtgccagcctctcccatctcagagcactgagatccagctgcagtgaaaccctggccctggctggagctggagggagacttccatcgaagtgtttgggaaggaaagcagggaaacctgcctctctggagcagcaagtgcatgtcctgggactctgagacacctcagcagccctcctgcagactggctcctgcttccagcctcagcttgctagctatgtgacctcaagcaaatcactagccctctctgagccctggttttctcctctgaaatgacttggactaggtcgtctcgatggtcccttccagctagcggtgttctgcaggtctgtgcttccctctgtcctgagatttctgagttatataactcattccttagaatgggagaggagctgtcttcttgcccagttagttacctgattcagaagtgcctgccagcctgtgaggctgggaaataaactgtggatagacttgagttgggtgtatttacaaagcctggacatgcactggcaggagaactgagtgccccaggctccccacacctacaccacaggccctgctcagttgttcagggttcactcgtccacggtgagtcgccggagggtcagggaggactcacagagaacagggtgagtgccctacacccttcagcttgccagttctgcagtccccacccttccggtctggatgcccagctgtgtgtgtgtgtgtcaggtggggtcagctgggcagaaaggtggaccccagggtcggtgttgccgcatcactgcatgcactgtggggtcccaggggccctatgggtataggaaggaatgaaatgtgagcacttgggaatctcagcacactctgctgctcacctgctaccaggctttctggttccccagggaaccctgggccagcttgttgctgtcctcttttagcgatgggaaataagagtatgagagacagtgttatcctgtttacaatcagtggtgaagtccgtggttaagaccaggttacaactcctctatgcttcgcttcttatcttgactctgtgtgaaattaggaaaagcatatttactgttatagttttgtagctggaaaatgaaaatataaaagtctattttttataaactacaaaatgtaaaacaacagactcagtatggctggtgggtacagagaagacaaagtggctcctcacggggttgacaggagtctcgagacttttatcaaaaaaggccagaagttggttgtcatttttgagacactgggccctagaccctgacgtttccgttggaaggaggagcccccagctgttcccgctgatggttcaacctgtccgccaaaagcagccaaaatgctctccccacggagtgcccacttggagaaaaaccccactggtgactcaccttctggacatgtggggcaatcagggcccggtggaggcagctgctcctggctttccctggtgggccctccctcgacccccgcccaggccctctcctgccttccccagaccccaatgtgccaagcagtcaagtgaaaatcaaatcctctgaggcagaaagacacagctgtgtgtttacagccactgattcagatccaaatcgcgtaccctgccagtctctagcaaggcaggctgggggcaaagtgtgtgtatgccaagcagggatctatttcgggaggtgacctgcaggccttcgccatgacagtgccttcctcccacccactctcaggaaaggtgctctcactttacaagcggctgatggggttgtggggtctcggcatgcttgtcacttgtgcagtcagaccccagtgccatcctcgtgcagccacatgggaactgtgtgggctcccacctgcctagtaagaaggcagagagtgaaggggagtgcagggccccccgcaggataaacagcgggaaggccgaccactcagaagacaggatgcccgcctctgcctaggacagagcctgcctcagtcctgtccggggagcagcagcaccgcagcagagggggccagagaaagagcatccaatggcaggagtctggcaaggcgacagcactgccaatgtcacggtcaaggagaggagacccaactctgcctgtggtccagactggaaagttcaaagagaagtcagagagcttcaagtctgaggacttcaaaggctaagaagtaagacccccccccgacccatggaagtccccccaaaatgagctcctggtggaaacaacaggggatgcttcccccttttaaaatagtgatgagtgtccctggtttgagttgagttaggaaagcatgacattttggaaggaggccaggatacctgtccataggtaggaatagcctgtaagatgttgccctcctgcagtgtggctaaatgggacactgccgggggtgggactcagagcagtgggatttttagttttgtcatgtttgcccaaaggtggatgagagaaagacccttgggtgtttgcttagtggcttcccaatgggtgggaaggtgagacggggttggaagcatggagccaccccagcagtggcagggccacagggcagcggttcttccatgccccctaatcatggccacattgtatcagcctgagcatgagcaacagcaccatggccacatacgggaatgggcctcattggtgtaatatttggcagattctctccacaccccccgtggcggtctggcttactgttaagaagggtaaccttaaaaaatacatttcccactccagaaaatactcatatgtggcctgttagcagcacaagaagggtgaaagcaatgcccattcctgcctccctccccctgctcacctccacgtccctgtttgcccctttgtaggtgaagtgagtatattcagcgtcttcatggcaggggagagggtgtattaatccgtctatgtccgctggaaaggcagtctctgagcgggccacaagggttcagccatggcccatccaataacctttttgatgacttggatgaagagacaaacattccaaccacattcaaagatccagacctccaaagtgtggctcatttggtagataatggaattatatttggaaagcatttcccgcagctgggatgatgggtcaaaaacagatagcattttaccagatcatatttgtgtgtgtgtgtgtgcgcgcgtgtgtgtgtgtgtgtgtgtgtgttttaaattcagtttcccaactacaggatggcatttgtagcctttcctaaaaatcaagtttaaaaaaaaaaaatttcttgggttgtaattgacgataagcttagtgtaagcaaatgcagaatgcagctgctttccaaagggcagctttaggctatataacaaaagtgggaaaggaaaagtgttccattgctttttgttgctctaagcaatattaagtcttggttctaagcccccacattatcaggaactttaacatctagagacaattgagagagaagagctagagagagaaagtgaccctggaagccacgtcggaagaggctggagtaaaaatgtctagccccccagcagacttgatggccaccgtgagctctttgcatttgtcttcaagagtggacacttccgggttgctccagagagcaaggctagaacaaatggctagaagatagataggtagatactaaaaatattctaacaataacagaatattccaacaatagactatgtcccctcaaagggcaacgagctccatgtctagccgtttagaagctgaatggccaaggatagtgcagagtaggtttctacaccagatcccatgatcttttgcaactggaattctatgctgccccaaatacttgttaaatggatccgactgcatttcattctgtggtttataaataagtcctggaaaaggagaatgaattataaggaaggagtttgctgagattggaggagagggatctgaaagactcaggactagactccgccttgagggagaaaaagccacaagatgacacactcaaagcaagggaaaccgtcaggaagtggaattactgcccttcacatgtcatccttgccttcttttctgttttttgtttttttttttggcatttgctgccgcagcagctgagctctgggcaacagggctctctctcccgaatgtctgaaaggaggtcagcaagtggaggacacaggcgcccactggcacagggcattggcaaccatcgtgcagtgagccccagcacagccagggtggccatgtgcgtggggcgtcctggcccaaggttgaagaaaactcatcctgtcatagttcccatccggaaagggtgttttgttgaaagcaaaaaggatcataaagtcatttgccttttacccaatgccagttccagattccaggtaaatgagctaacatcaaaaacacctcagccggctgggcgtggtggctcacatctgtaatccgagcactttgggaggccgagacaggcagatcacctgaggtcaggcgttcaagaccagcctggtcaacgtggtgaaaccccgtctctactaaaaatacaaaaatgagccaggtgtggtggcacatgcctataatcccagctactcgggaggctgaggcaggaggatcactagaacaagggaggcggaggttgcagtgagccaagcttgcaccacctcactccagcctgggcgacagagcaaaactccatccccatcccacaaaaaaccccccagagacctcggactgaggagaaactatgcccccaccctggcttccctcctctagggccctgccagggggacttgtcctcagcccagctcagggaaagggaagggttcccatgtcacattctttccagctgtcctaagaaccaccccgattgccgatgacactccctcctctcttgggcttcaccagggctgctttcaactcatcgtgggattgtgtaattatggtgattacagcttgtgacttttttcctctccatcttttgctttcaaattctttgaggcctctcattaaacatggcgatcccggtaaagtcagcaaagttttaataagacactttttacagctaaagaaagcccagtcagggttgattgctactatgttctctcagatactccattaaaactctatcaggtgcagttggtgcctaggtataagaggtgggggagagggaaggcagggaggcagagggcacctgtacttagtgacagggctggagaaccattccacaccatgcccctggctttttttgtttgcactaagcaccaagtacatctgagcccccgtgcctaacaggaaaagacagactgtcaagcaaggaccgaaagcctggccttaacatcatagcacattacactgggaaatggagatggagcatccaagacaacacttaacccaaccttgtaatcttctgcagcaaaagtggtgggggaattctgatacgtgctctgtcctggttaatactagaaggttctgaggcatccataattctaaataattaaaggagtcaatcaatcactagcctttgtgagtcatcacaatccggtggttttacacctgatggaggttttacacctgatggaggtttccttggtagtgattcagcttcacatctcattcttggctaatctttaatcatagcttgcttgcttgctttttgttgttgttttggtttggtttttgggggggtgttttttttgagacagagcctcgctttgttgcctaggctggagtgcagtggcgcaatctcagctcactgcaacctccacctcccaggtttaagcgattctcctgcctcagcctcctgagtagttgggattacaggcctgcaccaccacactcaactaatttttgtactcttagtagagacggagtttcaccatgtcagccaggctggtctcgaactcctggcctcaagtgatctgcacacctcggcctcccaaagtgctggagttacaagtgtgagccaccgtgcccagctcatagctttcttgaatagttatcatagctgtaggacatcatgagaaggaccatcaaggagtgtggcttgtgtgtgtgagccccgtgacccacccttcagcaggttcatccaggttcccctcatttctatattccctggggactacacagatgcccgcacagtgaagtgcatcttgctccagcaggactgtgtttctgagaggtccctgattggctgctcgtggctgaccgtcccataccaaccagactgccttttaccctgcaggtagccagttacctcactacctgtgtctcaaaagagcaaggagctggattgtgactgagcagcaccaaccacctggagttaaatgtcaaaaacgtggcagggacatttcccccaactgcattcccatccactactgaaggtggcctgctcgtgtgaccccttgagaacaacggtccctttagtacccaccagaatgcagagaagtaagctaagttcgagacaggcaaccccagctgaatccctttttctccacctgatattatgtgaccctgggcaagtcacttgcatgtctgacaggtacaacaaagcccactgcacagggtagatgttggcattcaatgaggatgtgatcacaagagctgccatttattgggagctcacactcacagtgttggactgtgtcatgctggctttgcctgggatggactttggttctacttcagctccatcacttagttgtttgaattgcacagcttctctaagcctcagtttcctcatccataaaagggagataagagtaaataagtaggaataaaatgcataacgtccttagcacactgtgtgcagtgcgtgtgcttaacaggtgtagctcttagaatcagtttcatcattatgatattatttgcagctcatacttaggctgcgcttattaccttatttaatttccaacaatattctgcaagataggcatcattatatacatcttgtggttgagggtgggtacgtgggtatctcctatatgacagtctgcacaaggtgcatgtattacagagatcagctcatggtaactactcaataaatggcagctatgattgttggcttatttttaaagtcaactcagagagttagtttttctgcatttcctggaaatgaagggactgtggtgcccagcaggccagcttctgttctatggtcgatttcctggggcccctaagcacttcccgggaagctgtgggaactggggggcttgtcagcctgtaaggtgctgggaggtggggagggccaccaggcaaatggtgcacgtgttgtggggatctggcatttggccgcctactgagttgaaggactcgaaggtgcctcctgctaccagagacagataaggaatgggtctacccaagataagaagatgaaatccactcctccaaatgtagccctccatgtgacagaaacactcacctctcagctgtctgcttgcctggagccaccctgagcaatgcaacctcaacaagtccagttgctccgtcagtccaataaacagaggtttctcttttttaaccacttattccaaagcgaggtagtggaggagtcagaagcacgtggcaggggatgctttgaaattccttgataaaccggacccctggggtgggcactcctactgcctatagtaccgacagaaacagaagtggagaagttgtttatttccaatgaggtcaataaatgcctttttcatgggggagaattccatttttatatatgtattttaaggtgaatgctttaagtttgcagtatttgtcagagtggcatcttaggagctgatagaaaactctacagccaaacaagcgattgcctgtgcaccttgcatgagatgcttctgtaagtgcctgtggtctcaacatgcacatgaacgcatgcactggtgtatgcacatgtgcacaggtgtatacacaggtgcatgtgccgcctgcctgatgttcgcctctgtgttcagtgtatggtgtgcatataaccataagctgcaaacctgcaagtatctctgttgcatggattgcatgccctctgcagctgtgtgtgtgtctgggcaggggctcctctaaagccacaggtcttcacagtttcagctggataagttattcttcacttcccttcctaaaaacacaattgcctagtgctgctggcgcagagtcagaatggccgctgcatttcacccccgaggtggcttccttccagcagtgggtgagtgatcccggcgttcgcacactctctaatctgtggaatccttctgcacagaaggtgttccaaaatccaaaagagatgatctgtttgtccatggcatcgtctctgcccaccactcctgttctcatgccctggttccagggacagtcggcagcacccatttcttggtgtctctgttttttctgcccattttttgtacccatagtttttctctcctaagaaacaaggagctgaggggtccagaaatgatgctgagatgagtcccttgtcccagaggcaatgtgcagataacatccttagatattgacccagtaactctcttctcctagtcccattccctagcagaacagggaatacccactacctttgaagatgcttctaaatccaataacagcatccttaggcttcatttcctggtgaaagcttccataactcttcctctgtgggccctgggccaaatcctgcaggaaacgtagcaatctcacatttctacacactacaccatcaggggagaaaaaagctgggaaaccgcccatcctctgtcccatggggaccaaaagcatctcagcagcacgtgaaaagagcctgtagggaaataaggttctctgtagctaagagttccaatgacctaagtttctgtccaggtatctcctgaaaacgctgcttagtctgttccctggtgtacttcctccggttaggaatccatgtctgataagtgcctgctaaattgcattcctgatagtggggaagaaagaaatgagccggccctctttgcatatgcatccaaatgggcatggacattcactgaattgttatgcttttgtggggggatgagaggtcagcaattctaggctccgccttttcagctggctaaaccaaggaccccaagaaatgtacgtgttttgggtgaacacatttgcaagagataagtgtcctcaggaggatggggtcagagtcctcataggtcctcaggagaatcacatactgccaaccaaataactttctcttgccgctttgtccacaatatcaagtaactaaattccagcttcactgtctcccgtagtcatagtcaagggttacttgaatttcctagttggaaaaaagtagcatcaacttgttgccaatagcaacacagccatgtccctgtttcctagagccttttggtctttgcctaatttggagtgaaccagagcttagatgccagagtccatttgggaaggaggaggagaagaggaacaggcgggcattaagtgggtcacaggaaggcatgccaccgagaggccttacaggcagaatgccaccctcattccactcctgaagccaccaagaatttcctgcaagctgagagaagaaagagcaacagggttgttccgtcagatgagaggagggagagaagagagagctggtgtgaaaagggggcatttccaccacacagggatgcagagtagcagggaaaatggagatgcacaacttggacgcgagaccggggagtctggacctggcattctgccactcatgtagggctcagctgctgagtccttgtctctcccaccatccctacccagctccggatttgtccctgcacagctggggggccatggagaaaggtcccccatcactcagcaaaactgacaggcagaagaaagtgatgagcatggtgaggccagggtcagagatgccaggaacaccagcagggagggcttcctccacctggctgggcaccccgaattaggcacttggcctagaatgatttaaagtggggttggttttcattagagtaaggccaccctgcctgccccaccttagaaagggaaacatcacacctgctcctgtcctccctggggcatttgccatgtgtgttcctagaggcatcagcatcagtaacacagggccacaaacagaacggtgggttcacccagcctgtccagcagctaccacctgaaatctacatgcaccaagccatggtgacctgcaccccagctcaatgcagtaaccaaaagccccttttgccaggcttgtcagccagcagatggcacctcctttctctcaggatttccaaatgggatgaggggaagccgcttcgcagcatagaacctgcctgagataagctcaagcatgctcaagaacttaagttcttttctcagggaagttgagaaaatcaccctgcattgcccagagaggttgcccagtacgggttgggcacaggggactccttcatccctgagtgtttccatctgcctccttccttgagagtgacagccatgtgcaaagtaagaggggcatgggtcgtgaaggccgaccaactcagctttgccactgactagccatgcactcccaggcaagttactcaaactccgtttgagtctgtttccttgttcgtttagtggagtttatagaaatgcctaactggcaagcatgttgtggacataagtaagtgcgggtgcttgtaaaatgcctcgcatgcttgacagacacacaatagttgctcaatggtccatcagcaggtggctgtttgttagtaactgtcctcacagctacctgtgtacctagtgggggaccattcccaccatgccactgtcaaggcctgagtgatttgaagaacaaggcacttgaggagagagggtccatgagctacccgtgccattccatcaaacaggcccatgggagatcaggggataggtgggtccttttacatttaatccagataggagaactggcaactcttcttttgtagattcaaaaactttttaaaatattttaaagcactggtagttgccaattatattagtccattttcacaatgctataaagaaatacctgagactgggtaatttctaatgaaaagaggtttaattgactcacagttccacatggctggggaagcctcaggaaacttacaatcatggtggaaagggaagcagtcttacttggcagcaggcaagagagagcgagtgtgtattaacacttaaaaaaccatcggatctcatgagaactcactccctatcacgagaatagcatgggggaaaccacccccatgatccaatcacctcccactagttcccgctctcaacacatggggattatagggattacaattcgaagtgagatttgggttcagacccagagccaaaccatatcaccaatacaggatagagtaaggtgtctgagcctactagtggtcccagtgacattctgtgggaattgctttcagaagacgtgactgctgggtacctcctccatccccagtgtttaccaggcagagcctgagtgtttacaccacacacagcctgagtctttataccactgtacatgagaaggtaggggtcgggggggcggggtggggggtgctgttgcaagaaaaaaaaatccattacgtttattttgatcaaatttattattttttaaacaggttcagttttaagtattcatgaatgtaccatttattaattctttaatcagtgaacgtctcttttttgattaattcacttttcatctatcccttgacttttttaaaaaaattggggtattgttttatgtttgtgatatagcttcctatttaaaaggggtcaaataaaaaaatattttaaaaccacataaaatgcccttaagcccctgcgagagttgaggaaggttgccaaggccctacaagtaacacagaccccaggaatgggtcagccacaggctcccgcccctcctcactgcggaagggtgagaaagacaggaatggcctctcttccttcccatgctgctctgacctacctctgttgtggaggaaccataacgggttccatagcccggtttttccatttcctatgccccaccttgtttcacagagttgagttaatagagggtgataagaaatagagaatttaaaaagtgttttgaaattattctaggttaagtgtggattttcccaccatcccctgccagcgtttctccgacatctcagactgcactctctctccccagttttagacatcattgaggaagaagatgccacggaattctttgcattcccttttaaaatcatttcttttgctttgctcagtggagaaggagcaccaggggcagcaaccttccgggagtcacccgatgaagtcaggcaggcctttggcttctcccatcctgctgaacccaagccaggatcccctacctttccacctggctcttgggctcctgacccttatcctcagcaagtctcccccaaccccaccccaggcctctaattccacacgtatacatcctttatgaacttgagcaccatctattcaaaggtgaccttcaggctccttgagagcacgactcatctctctctggggcctccacttcttgcctgctaagttgcatggtgagctgtattcaacgaaacacgatttttcatgagcagggatggaaaatgcctgtgtgtcacaccaaagggatccgtttgcatcaatggaggctagaaatagtgttccacattagttctgttgcgagttcgaattccccaacagaggaatccaggttcctcctgtactggagggggaagcattgaatttctccaaacccagggatgggcccagcaactgaagaagggtaaggagtgggaaattccaaggcatagatgtcatagctgggacttttttttgtcctaattttttttttcttttgagatataattatgcacggtaaaatgaacagacctgaagtacatggctcaatgaatttgacaagtgtatgcacccgtgtaacgtataccccatcaccctagaaggctccttcatgtccctttccaatcaatttcatccttctcccccaggggcaaccgtggttgatttctttcccccataatagcctggattttgatttggcagacttgagatctgtaacttcggtcttagttcatctgagcagatcagcaaaagaatctcatcagaagctcagatgtctttactctcttagcattgaaaaagatcctccctgagccgctagtgcttggctctgctgtcccccagtatgccccaatctgacccccagggctactctctgagccacagccctcctcccagccaaagaaagagtttagcatcagtctcccaggtaagtaagtggcaaaagctcttggtaacccagatagtgcatgctttgttgattaatatgtggaagtgcaatgcacagagccacagcatgtcaagcagcatgttgatttttctcactgcacaaaagggggctattccttttgtgtgtttcctttcagaaaacaaaggattccatgaccaccttcttccaggctcctagccatcaagatggccacagagctgaaatgattaatcagagcggagggtgggaattgaatgtgtgggtgttagtgaacccagcactgagcccatggtccatgaaattgaaggatcccaaattctactggattacactttgccaaatgtctcaaaggtgaaaagcactttgtcggtatgcaaagctttggtgtctctggaatgtaccttctgcagctcagttcttaatcactgtatattttttcacttggacaaaggctgcctgctaatagcattttcaaccatcctcagctgcttcgctcagctacgccaaggcctcgggctgagctggctgcggtttcctggcaccatgatccattcccaactgaccaacactgaggaacattacacactcacaccctgaaaaaaacctgcttcctctgtaactatgcaaatgccagacacaggcaggcagaattaccattccccttctgaagtggttccttcaggatcatccaaactggagacagagatgagagtaaagagacggggcagtgccctggagggtacaggcaggagctcccctctctctgggcacagcggattcctcgggagcttcctgcaagcctataggggcatgcactttggggcagctcatctctgaacacaggtagcctctactatcagatttcactttgatcactgaaaactacaggagtctcagctcttcagaagggaagcagctgctgagcaagtgtgattgcagtatttcttccccaaagccccgggccaggcatctacccatgcccgcatcctgcatgattaaccgccttccagtctgagcctgccctcactcacgcgggaggtcactgggtagcgagtagattgcagctgggctgagctgcctctcaagccgacctgaaccctcatgacctccatctttagcagcaagctggcatttggtaaatgcgcgaaagcaggagtggggagagggagacaaaaatgccaagcagcaccgcctgggttgctgagaggttgggaacaatcccaagggtggcccctaagctggtcagctgcaccatcctaccctgaaatcctgggaaataaaagcagtcgggggaagcgaggagcgggcagtgacaggctggccacaggtccttggagtcagagcggtgaggctgagctccaggatttagtcaggaagagaataattagcaccttcaagcccagcccagcccagcccattctgtagaaaggggaagggttgagggtatggaagcctcagggccaaattcacctaaaacaaatagacacataatcctccagaaatagaatctccaacctccctcaacccacagtcccctctccagccaaaataaccttgttaataggaatgaggctgcagtgaaggtttgggcaactggtaaacctcacctcctttgtctctgggctttgaatgtactcattggcaacagactcttattcagaagcttgagtgattttttttttcccatccaccagctaaatgagagccccaaacgctgtggatagcaaactcagaacatatatatttgggtacataatgtgtgatttgtggccctggcgaaggagggatgggaggaggaggaggacctgatattggtgtgtggtggttatcacagcaataagtggcacctaaaaggagagcaaacttcctttgtgcctttcataggacagggatggacataggtaaccgggggtaggggaggtttgtaagagctctcacacaaggaggcccctaggctcagcagccccgtgtttccccagcaaggatgccccacacccccatgtttcctgccttcaggcctgccccaggaaggcacattcccgagtgacaaatgcctcacactctatgtaagaaagggcactcaaggagagtcaccgctgggtgtgtgccacagaacccggggctggggggagcccttgaaggtcagcctctgccttctaagagctattgttgtacctaacctggtctagacaaaggagtagtcattcttagtgattttcaaagactgacaccataaccctcttggattttttaaaaatctgattaaaaactccttagccaagtataaatgtatcctgctgcaggctaagtttagtgcacttgaagattcagataaggttgctgatggggtgattttgtggacgtgtgtgtgtgtgtgtgtgtgtgtgtgtgtgtgtgtgtgtgtttaagatggggagaaaaaatgaaaagttttgtctcactagtgaaaatggggagtgaaagcaatggggaggaaaaaggtcaaggagaggtagggaaaggcagactttctgacagctcctgagggcaatttcatttttggacaaactcccatctatagcaccagaattctcaaagtcaggctggccatgcctctccatggagatctaagccagatgccacattgtcctgtatccagcaaatccacagcccgtgttgtttattagataaacccgttatccatcaattcatcaatcagcaggtttattgaggaccctaccaggcttcacaaacctgatcaattttttaaattacatctagcttacacgcagccaagcccagtaaacaagacgagccctcacaccccacttggaaatgaacatgaggaatcgctggcccttgcaatctcacggccaaacactgcagccccatgctgacgagctatcacgtgctgcccttcacagatggcggtggtgtcgctgacccactgtcaataatatgggtttggagtgctttcccagacacagtgatcaatctgcctgggtctagccatactgtcctctaaagccctgtgcaatgatgcggatttctaaagagggtgagctggagaacgggcacacactatgtaagggcaataagcaaagcgacggagcctcgctcgtgcccctcaccctcctcctggtgcccagtcgcaactcccctcctagatcaggggcttctccgccatctctccagggcacatacacaacgggactctcctggcacctctatggctgatgcaccaggcctcatgatccagttcactgttttagtttttgagaagaactgccacatgggttatagttgaagggcttgtaggctttcctggtatggggtcatcaaactctgcctctgggtgccacagatgggaagccaagaacataggagacagcaggagtgcactgccctggggcctacagtggctctgagccccagcaaatgccccccactttcatggtcccagaactggtcatcaagaggactcaaggtctttgtgtctaccctgcattccaaacaggactctgccttcttaagactagttcattcattagcttctgatcagccagatccttggccaccctctatttgagtcaagcccccgtccctgatctcagaacaccccaagtccaccttttcctcccccacgtgaacaaaatcaatttcagggcagcccgccggcattaaaaattgctctacctaaaggtttaaatacctggtttttggtaagtaaaattcccataccacaaaaagagtaccaacaacacaccctcataaggggaccctccaggactccctgaaccttccctggagccctggtttctccagctgtccaaagttaaggctcccatacacctagagatcaaatatcaagatggtcagttgggttggttggtcgtttggcctacatggctcatgcaacaattaattcacctgtctggctctctgtctctgtccctctgtgtgtgcgcctgtgcgtgcctctctgtcgctgtctctctgcagggaaagtcgctggcgggcaagcgcctcacgggcctgatgcagtcctcctgaccgttcctaccgcaggtccagggcctgggcccgcggaccccacaggcaggcggcggcgctccacatctgcggacagagtttccttacgaggagacttggtcactgtgaaggagaaagagtgagggcaatgaagggcgatggtggggagactcggtgggtgaatggggagaccagaaagaaagagtccacagagcctgggctgggcccggtggaggctcctgtttacagccctctcttctttgtacagttgtattccaacactccactcgctaagaggccctgatcccagctcattcaggggagaacacgtcgtggggttcctgtcacgactatcacttgagattatattattatcctcactccctcgctgtctggagacggtcacaccttctggcaaattcaagaggcatgagtggaccgagagcacatccagcatttgcatcacctccctggcacctcccatagttacagccactacatccccaccgccgcctgtcatccctcacgtctctgtggccacccgggtgtcactgccagcaccaggcactgctttcacgtaaaatgtccaaatcacatcttcagcaagaaagcaacctcacggattgccccgcctcaaggtctttccaccctctttgagatcagcgttcggagaggtccccgccagcccggtggctgccctcaggtcccgtcacatgtctcaagggtccagcgttcgaggaagcactgttgtagatgacagagctttttgtttcacagctgcggggattctgctgaccatcttttagaaaattatttcataatttattctggctttgcccccttgctccttggtttattccctcatgttttactcaaaataaacatggccatgaactcaggggccattgggattctcccctctggcagccccaggtgggagctgggagggtccccagcccaggaggtggctggattgcagggctggcagcccccacgtggtggcatcctgacaggcacagtgagacccttgctgggtcaggtctcctttgtgtgtgaagctggggcagagtatgctacgaagggaccaggccaggccacagggctctcctcccagtctttatctgaaggcccagccaaagcacccctctaaaccggtcacctaggggaaatgcaaaaacctgcaaaagatccacctgtattccctgtgtgtgtgtgtcaaaatgaccatttgccaacctggctgtgaggtaatgtatgtaaagcaccgagtcaggtgcctgatacgcagtaggtgcttagcaaacggtagctaatactatcatcattgtcattgttattgtgacacccatgagcccacagacagagctgtattaagtaacctgttttgaatccagacattcactcccccacttgctatgactaccctcctttgatctatttttggtcataggtaaaaaaaaaaatctctcttgggagcatataaacaaaaaacatagaagcaataaagcgatcgctggtatttcttttctcatgcagccaaattcgccagctggtgaccaaaggctcagatgcttgcttatttgcagacccggcctcctgggtgctccccagtgacccatctttccaccccaccacctccaagtcctgtctatgtctgcttccacacagccctgtccccagggcaccagccttctgtccctcacagcagtgccatcgcgggcattaggagtcttcgttatgttgtatccttgtgagttcttgactaccatgcccaagtttcccccactggcaatggttcctctcttggaggtacagtggaaaccagagagatgacagatgttgagtcctcagtgtctcagaggcagcaattcttgctggacacctgcacatgctcagcacagaggctggtactttggaggcactaaccacttgatgagtaaatcaatggcataaagccccattccaagttatggggtcttttgacaggcccctttcatcctctttctctttgtataaacctcatgtttcagaacaaaattacagtctaagttcatttgcccccagccttgcccaaggatccccgggctgtgctgacccctaggcatagggcaaagggtgttcccaagcagcaggcacctcagtgccctcagttatccagggcaaggggcctggctgccccctgctcctccccatgatgcaggggctttctaagccaggctgcagacagggcagggttggcttcttggccattccctctgtgcccccttctccttctgactggtctcaccctggagatccccagaggatctgaccagagccaggtggactgtggccctgagatggagctggctgcaggcttacaagcacctctggggacatccagaggggagggtcagtaagcacaacggagctagggagacttcagatggactcaaacccagagcaataatactctcacaccaccccacagctaaggcactcatgttccccagtagatcaagccagaagctttgcaagaagggagtggaacgaggctgcctatccaaggtccatctaccacgcagaacttggtcatgcaagtacatttggaaaatctggtcttggcccgtcccccattggcctggtctacacagccaaaaattcagactagattagatgtttgcaggcaattctgtagcaaagcaaattcccctaccccgtcccttccccctagaagctgccttagcctccctgactgggtgtggtctctgggcctaggactcctccctatgaggaaaagtgctctccagccacatcttggcagccccacaaccacagcatcagggcagctgcagcaagtgaccacccacccgtcgggttagacacacaaggcaccaggcactggcatctgactaaaataacctttccctacatgggaagaggaaagcttgtaggctggcacatataaacgtccagccgcagccagatggcctgaactaagcagcaggaactctctgggctggggaggagcctcctgcccttctagaaagtgatgcgtcagctttgttctcctgggaaggtgttgctataccccaggaacaaagcagggcccaactgccagtgcagtcagctgggcctgcgctccaggctcaccaccgctaagtggtcaggtaccgggccagcatcctgggagggacctcttgcgactctgagttgcagcttggactagctgaacacatggggacatgctccaggggcttcttccctggcaggattcctgggatttcaaactacctcaccaacaggacgctgaaccaggagcctgccacccaactggcccccttggtgattgtggaaggtgatgtttttcctaaaatgcatccctcctgttctgctccatatacatgtgcttcaaaaaccaccaccaggaaagccttcccagaagagggaaaggattaagggctctcttcctttgggccctgcagaatgtattggagggaggtgttgctgcaaggtccaggagctgggaaactctgggctcggggggagataatgcaccaccagcctcaaaaaggagctgcccaagttgaatatgtagcaaagaccatgggataagttgaatagtggccagacgaatcactaataactcaccatgggaccctctgaagagaggcctgtgctcgtgtaaccatagcaacagcagatgccagcaacctactcattagtaccacccagtgataaggcatcccctgggctagacccaggggccataaagtagcaaagtagcaaatgtagcaataaagggcccgggtctatacggggacagggtccaaatgaccaggacttggccctctccccagccccgatgagggctcagagccagctgctgtcagctgtctggggagggaaggccctgctccataccaggggtccctgttctatactctaagcccactcaccgcatgatcacggactcatcggaatggcctcctcttagtgcatgtggttctctttagtttatttttctggaatttggggattggaccccagaaccaaacatgctggtacagtctaaaaataaatgacttgaacccacttcaatcca

SEQ ID NO: 756 - DNA, 629678 bp, Homo sapiens; identical to SEQ ID NO: 748

SEQ ID NO: 757 - DNA, 633454 bp, Homo sapiens; identical to SEQ ID NO: 750

SEQ ID NO: 758 - DNA, 516441 bp, Homo sapiens
cctctcccgccgcgcctccgcctgcccgcccccgccggccgaggctgggctgcgggaggcggccgggcggccccgagcttcgctagggcgaccaaaacaaaggcagcatccggggctgggtggatgcaaacaaccatgaaagactgggttctcgctctccccggctctgctgctgctgctgctgccgccgccgccgctgctcctcctcctgccgccgccgctagggctccgctgtgagggggaagcaggggcgcagctgctgggcgtgcatccgaaaggtgagagccagagagcgagcagagggggcgggcaggccacgaaaatgtcctcggccgtggggccccgcggtcctcgcccacccacggtgcctccccccatgcaagagctgcccgacctgagccacctgaccgaagaggagaggaacattatcatggcagtgatggaccggcagaaggaagaggaggaaaaagaagaagccatgctcaagtaagccagccccagccgcgccatccatgcctccgtgcctccatccgtccattcaccactcactcccctagtcctcgcggctgagtgtggggaaggggctgccagggtgctgggtgcggacggaggcgcccgccttgggccaggggcgcggggcttgagcagggaagaggtcaggggaccggaggagggaggggatatgccacagatccaggaacccaaaggccgggggaggatgacttgagactggggtgcagaggagggatgggtggacgggggccacgctcgtggtgggaagtgcagaagctgagaggtgctgatcccacccaagtggaaggtccctgggctgggagcaggttagggggcaggggatgagtagaaacaaggggaggcaggatgaagaggtgctgaggacagctcctcttctcttcttggagttgtttagctggtcggggttaccccagtgaaggctgcctatatttatataataaaaatgcttatttttagtgttcattttagtaatcattcatctcacagatcaaggttgggtctttttttgggcaattgccatctttggtaacctgcctccccagcttctctttaaccttttattcagagtcttctacacagcatacctgtgtgaagacagattctcttctccatatgtaatgccactggcaatacaaagtttttaatcatgggagaagctgacagggactctggcctgaataacatagaggttcctctttagtggtttccaagagacctctggggcctgttcagttcctggaggaaacagtccaataagggattgggaatttgcactcctcctcacttctttagagcgcatcaacccttcaagggatttctgtctgatgccccattttcctggtgatggggagaagatgggactacttgctggtggtgcaggagtgtgtgacactgtgctgctgcttgcctcagacaaaactgcttacaagggactggcagagagacggggctttccttgcttagcatcacccatagagtagagctgaaggaggcttcaaccctgccttttcttgggaagtcttcatgtattcaggaaagttttcactctgaagcaggggaatgtaggggccctgactgtgactgactccttggtgtcccctgcttaggctggaaggtgtatctggggccaggggattggcatgaagagccaaaaggaacctgttgcatctggagttacctgatagcaaaagaggggtggggagggagcaggggtgaaacccagacacagagcacattctgcatggcctctcccccaccccctagaagtgcctcctcgagagaagatgctgccgaagaagatttcttctgcttcccctcagtgcagcagtgcctcataggagaggaatggagggaggctgcattcacagaccgatggttccccaaccagggcaactgacactcagataggggagggggatactgagggagagatgtggctgttaggtcacagcaaaatagtagaaatccagtcattcctgttctttcattgtagattcagaaaagggccattaactccgaaggccagagctggcctggttctataaagagcagcaggtttctgaattccctgctccttctcatccaaaaatcaaatactttaagcctgccggcttgagggaggcagaaccctcgttaatctgctgcctgtccctagtggaagaatgacgtccctggtgctgcaggcttcccctcttctgagactggaagtaatggatggtgtctgatagtgctgctgtctgtctgtctggttgtcagtccgtctgtactcactggttacagcccctgccacctgtcctgaacaccttttcggcttgtcaggatttacaggtttgctgctgttccttttgctgtttgctgcagacagcaggtggatggaggcctccagtagctagtggaaaatataggctgctgcttgccagagtccggataggaaggggaaggcacggtgcaagtagtggccatcatgcctcttcattggctgtctcaagcatggtggagagtgagggattttaagtgggagtgggtgagttttaggacagaattccaaacctgctaactgccaaaggacagcaattataagattgtatgggcttatatgggcaaataaaaattaggagcactgtccaactgctcatgtctaacacatcttttccgctgcttttcctgtgactgctttctactggcttgcatatattgttcctttgttgcatggattcacaaaatatcactgtatatgatgctgttatacaacagctctctataatcctggacctctgtattaactttatccatcagcctcctctgctaatgtcttggccttttgttcagtgacagattggtgagtgttttggaatcccagtttgctgccatgtaagcatgtcatattgtctgcaattagtggaaaagtgctgtaatttttttttataggggacactttatgtcttaaaaactggggataatgggaactatttagatgacacatatatatgaggacataatgacacatagtcatagatggtggcctttttaaaactttgtgttaaaatagattggaaaacaggattcttttaacagggctttaaaatattgttacatcagagaaaagtttttgtggtaattatgggtgatcataatcacacatctgagaaattactttcacaaaacgctctacaaagcttaagttctggcaatacggcaattagacttaaaattcacttgtgttattggtgcagaactatctccttaagctacctactgtgcatgctgtctcttttcacaatgtataaaaataggcgcagagagaaaatagaaaatgatggatgaatatgtgaaaccaacattataaaatatcaattaaaatgtatttgtaagtttcatcggccttgattgtaaattactagttgaatttggctttgagaatgtctttaaatatgtataaatggaaaaaaatcaagctactttaaaatcaagattttagaagattttatttgaaattgaaagtactttatcataaaaagaattcgttttgttggcaaagtacactaattttaagtttaatggccatataactggaaatagttggctcccacaaattatgtttaatgattgacttaattatctgcaaattagaggtcttttcttaatcttaatagtgttttggatgtgagtgtgtgtgttctgaaggctttctgaaacctaactttctcgatgaatactccttcaagtaactgttactagacatcatgagccaatatattacataggctgaaaactgcattatctgggacctaaatcagagaagatctcattagatctaggatcttactcctttttgtaaaaaaaaaaaaaaaaaaaaaaaaaaacttcatagagaaagcagctactgaatagtaagagaagagaaaaaatgtagagagttaaggcgatggtttgaggatgagaatcgagtaccatattggaatataatgtaaataggtaacatttattgaacattaacctcacactagctcttattttaagttatttaatctaatgccaaatagttaaactgtgctcaagtttattataagtataaatatttggattctcacaatagcctgtgcagaaggtaaaccaaataatataattctcacatcctcacactaccctcagagaatttagtaatatcctaaactgactcacataacatggtccaatcatgattcaaaatcagaccttttagtctaaatccaagtattttcccgtacactacactgtcttcctaccaagaagcagcctatatttcatttatattttctttaaatgaatttatagtcttttctcagttgcagagaagtggcttggcaaaaaattaggctgattcagatcagctgctgatcacagcagagcctggggcttcacctatactctttcatagagtgttagaaggtaataaaaagcatcacagtgtagtggaaagaccattaagtttgtatccgagtgtttttaggttctagttctagttctgccacttactgtgcaaacatgggcaagaaaattaaattgagattgtatgaagtttcatttttttcctacaaatccttcagtccatggtatgaattgatttataaagagtattgactttgggcttctccttctcttcttaacaggtcacctagcatttgctttctaatcatccataattactacttttttcctggaaaggagagagaaagtagaatgagaagaattcctgtaacttcagctttcctcctccttttacttactttacacaaatataatactgtggcctgaaatatatccataaggttcattatgagagatcccagttaccaactgggaaaagaagaaaagtggaaggaaaatctggggaaccttgagggggatgaggatagcgttcctatgtatgcaggtatcatattttcattagggtttgaaaagattttaatatcttacaccccaaaatatgaaaaaggcattatttaagtaaatacattactaaattagaaggagaatatggaaaccagtgtgggctggatgtgctactgctgacttgactaatagaagcataatgtcttgggaatgttatttgctcaactttttaaacgaggaaaacaatttttgtaaacttgtgcagtgagcttcctggaaagatatcaaatatgaattcctaaaatcatattattatccgcccatacctgtaataagcagatggatgaggttgcagtaccatggcttataaagtcaattgtattgcatttaatttgtcctcatgggctgttttctacttttatacatttggtcctgtgagttgggtattttagagttggtcctgagagtcaaagtaaatttgcctgaggcacgtggcagctagcataatgaatccagaatccatgtacactgacctcaaaccattattgttcttttaagtctttaaaaaagtgcattgagtgctggctattatgatttgtttccctcatctgttggaaaggaaactaacatttatcgtgtaccttctatgtattatgcatttgactggatgctttacaaattttactcacccaggctcacctcttgaagagaattctagcctgtgagtatttattagttttccaatgttagtgaaattcccagaactagcttggcatcttcctgaccctttgctcatgacatttgattctggagtccagagaacaaaacttaaaggagtgagagaggagcttcatgtggctagtaacatgttccacccttttctgagggtggactctccagaactgtctggcttccgcagttctggccccaggtgactctctaaccccatttgtacctggagttttccttatctgcttgctgttttgcccacagggttccctaataccatagcattttcccaccattccacctaaccatgagttatctttgtttgccactattgttctgaattttatttattaaataggctatttctaacaaagtgtcatatgatatttaattcaacaagaccattgtttcaggtattagaattaggtcaggcattaggctgctggggtagaataaaggcgaatcctctgcttacagcccaatgttggctgagttcctatcattttaaaactgccgtagtcagaaaaagaggtgagtgctggatagttggatagaacactggactagattctggtcttaacattatgactttttataggtgtgaacattgtcaagataatccatccaagcatcagattttatatgtaaagtggaatttataatggcagtccttctaatctgtgaagctttaaaatgatagtggagtcatcatatcctccaaattgctgtttccaagaaaggtgccattattatgcttatttgttaaaactgtagaacaccaagattatattttccagtagtctttgaaggtactagggggcttgggaagatgagctcttggagaagagcccacctatcctttcatgctagcaatgcagtgttgccagggttgcagctcccagtgtgagaatttgacaaggagttaaaaggtaaaatgagttcagggcttggtctgagactatatttaccttctttcttttctttttttttttcccctctcattaaatagctcgtacatgtttttagcacaaaaagcaatgtgggcaaagtgataaagtttgaaagatctaaaaggcaatcctaattcaaaaatgagaagagaaattagcttggggtaatttcctcatcttttacagaaaaaaatttggagaaatacagtaataattttagtgtcactgggtttaataaattcttcattttcagaattagctgaataaggggtcatgtatatttgtcaggtagttttctttcatgtcagtttaccattgagtgatgtaataaattgcatgtgtttaagaactttttaagattctttattggatgccttaggttttctgtatttatattctcacattcttacatcgagtttatatacacttattttgactagattacttttctgtggacagcaagagggggttattctgcagaattgattttagatgtttctgcttctgttgcaatattgtgaaaacttcctgttcatacgaatgcttacttaaaggcaaaatagagctgtttaaaaggaaggtgactgtacatgttgattttcctttatctgtttataccaatttcctgctattattatgtatggtaaccccttctctcaattttgagtttcaacccggatgacaaattatattgtcttcctctttttaaatcttgctttctcttccccaaattcttcatttataacttcagaaaatcaagcaattaacagtgttaaaatatatctcaacaataagtaatgcaagcaagtggtagatataaaatcttgatcattgtttggtaaatggagaacactttttctgagaatgaggtattatcagccaggcgtggtggctcactcccgtaatcccaacactttgggaggccaaagcgggtggatcacttgagctcaggagtttgagaccagcctggccaacatggtaaaaccccgtctctactaaaaatacaaaaaattaacctggtatggtggagtgcacctgtaatcccaggtacccaggaggctgaagcagaagaatcgcttgaaaccaggaggcagaggctgcaatgagctgagatcctgccactgcagtccagcctgggcaacagagtgagactctgtctgaaaaaaaaaaggaaataaggtattctcttttatggaatctcaacagaatgatgctttttatggcaaagctgaatttaaaatttcaaaacatttttcaaataatagtagttatgaattgcgacttcatacaggactgtctttatgagaattctcctttgagccttgcaaagagcagcctgcagtttaccaaagacatctttaatgtgtgagaatttatttaaatagattttgggatgtaatattttgatattcctctgagtttagatggcaaaatgaggtaatgttacagaaagtaattgcatgttatttgtaatattttgataattcctctgatgtttagatagtaaaataaggtaatgttatagaaagtaatttcatgcaatatgtaagtaatcaatgcacttaattataatattagctattttaaagcataatgaatgaaagatattttgtgtaatatagaaaataataccatgctaatgatttatacattatttagtatttgtttgtattacccatcattatgccaggtaatttaattatcatctggaagatgatagtatatttacatagagaaggtatgtaaattgaaaaccaattaagatatctgtactgtcatataaaagtcttacactacttagcttcttttaatggactctcatgcataatatacacactcacaagtggaaactaatgtagtaatcttgatggagttttcttgctgtatttgctggactttacatcgtccatttgattagttcacaatttacatacctacatatggctttctgtacttaaagcagtattgcttaatatttgaagactatttttaatctcaagaatatattttaaagttgtaagttattggtgcacaagcattgtgtgccatattattgtttttgttgtttaaacacagcttttaaccaatgtaacaagaaactctttgaggccgggtgcggtggctcacgcctgcaatcccagcactttgggaggctgagaagggcgtatcacctgaggtcaggagtttgagaccagactggccaatatggcgaaaccccatctctactaaaaataaaaaaattagccggcgtggtgatgcatgcctgtaatcccagctacttgggaggctgaggcaggagaatttcttgaacccgggaggcggaggttgcagtaagctgagattgtgcctctgcactccagcctgggtgatagagcaagactccctctcaaaaaaaaaaaaaaaaaaaaaaaagaaggaaagaaagaaactctttgataggatgtctagctgctagctgttttgttttcaatttatgtggtttttattctggaaaaaataggcagattgtatatgaagtacctagggtatgtaaaaatcaatgtattgggtttctttaactatatggtagtatatatccacatttagaggttctatccaggtcagaaagattacttagcgtattggtagaaagagatgaaaacaaaagtaaagtaaccaaatggcttttccttttatatttcacacagcttagcagatttatcttccttggctatctctgtattgcaatatattggagcttaagccttctttcctaacccctttgtttctgggaaaaaatgaagacattttacatcctagtatctggaataaagggatattgaaatgaacagtctcatttattttagatattgaaattttagtaagatccaaaatcctaaagagattctaattttatattattcatgattgtgacagttttcataaaagtgtaattttgaaaaataaaatacagtaaagtcttcttatattgagaatggatatttcaatttacagctgtctgcataccctaggtcaaatctagccacctaatatatagcaacctgaagtaaaaacttgatgctagtctgaaaaagatattatggtctaagtatcatgccagacacaagcattagaaagggattttatggtatttagagctccaaaagcctaagctttaacagtcactattgggtacaactatgatggataatcagtccaggggctatctagtccctgacttccataaatgcagcatagttaaaggctataggaggtccacatgcaatagaagagaaataaacatggtaccaggccacaagaagcagatacttttgctagtaaggttgtgcaaattaaaaaaaatatgacatacgcactttgggaaaagactaaatactcaagaacacaaaatagtgcaaattgagtggtggttatgataagaggtgaagaatcttttgaagctccctcttgcccttgcttctataattccatatccttttgatttgccttcaatgtttctaaatgcttctattttatcttctcttgaatctcagatgttggcgttctcatggggtcctattctccatattctcccattttatatgcagttccttgtgtatctccgtcaatggctccaaccatgtatatgtcaatgatccctagatctatattactgcattagaatttactactaaattctggattcatgtccttagccacctgttaaatttctctacctgagtgtcctataggcacttcaactttattgtgtcctgttataaatttcttgactttctgcctaaacgcagtgtctctgtatttcttgtctgtgtgggtagcatcaccactgcaactcctcacttcacccatcatcaaatcctacagatttaatcttttggaatcttttaaatgtctgtcttattttccaatcccattgtcattaccttaatgtaggctctcttcagtacttatctggatgcctgaaggaacctcttgattcatttttctgccactaatcaaaattcctcccatctgatctgatctccacattgctgccagaggaatctttctaaaattcgtctgatcatgtctctcccataaaacccgcttgctttcagagtaaagtttaaactttgtaatctggatcctacttgctatttctgttctttggtccgtgaatacattcctgccataatcttgctgaactagttttcaagggtaattgctatttcacaacatggtaacccaactcatacttttctctccatcagaaatatccttttacatctgactaagttttacctagccttttgaattagctcaagtgacaccttatctggtatatcttcccagacttctcaaatagattttggtattcgtcttaacctcttttgattgttttatttgatttttctataacctctttctcttaacagtgtcctctcagtacagcataaattctggaaaggaggaccattcttatttgaatccctcatataagcatattgcctggcatagaataggtgcccattttttaaaattgtatatggatggatgaatgaatgaatgaatgaatgaattagattcaaggaatgtggactggaggagtcacccagggctgctaacggtataagtaggaggatagagtgggatgattattctaaccacgggaattcagtcagcaaattttgaaaacaagaagtgagttgagtgcttttagttatcgagagaaccaggttgaccagaacttatgaggaaaatatattggatactagacattataaggtaaaattaacatgtaatttttgatggcctgttgtatcttgatttatcattcttaggtttttgaaagacagcattcttaaagtatttgaatataggtgaggatgtaaattatatattttaaaaagtaatcctctggacagacatgcttaatggaaacattttctttgaaataaaacatcactaacttccatgacagtttatagcatagtactgttagttttctgatttgatatttagaattagatcagtagtgtattgccagaaagcattctactggttatattttttaataaaaaaggatacctcagttaagccatcttctagacttaaaatccttgaaggaaggtatcttatattaatcatcttttcattttcattgcccaactctgtaacccatacataataggcctccatcaagtgctgttgaactaaattgtatagcctgtgtgcccaggacacaacagcactgacttttgcatttcagaattaggctgagttgaggtgtgagtgggaactcagtgactatgtcatccaacactggtaaattctcagctcacctgcaaatacctgtacctaaagcagcatcactaatacatgtcagatgcctcagaacctttctgaacatagtgctccaggccatcaactgataagagttggcaggaaagatggcaataaacattctagccactgaggatttatttttactctaagaagagaaaactgaggccagagactcaggatttcatttttcattactgagagagctagggataagactccaggtcttctgtgtcctagtacagtggtttttttccaccgtcaccctttttacacttggttccattttaactaccaacacattcaaacatttaatttttttcatttctgtttttatttgctttctctttgagatactatttgttatagaaaactccatgagaacttataattactttgttcattttgaatttggttttattaagtaaataatatataagtaaattattgccagattatataagtacattattgccagggactaagaaatattttatttaaagattccctttggaatcatatttgttggaattttatttaagctgtatcaacatttcttaattgtgataattttatttttaattttaaatttttccctgaaaggtacatttttactagcagtaatttagttatgattccaaataacttttcctattatgcttttgaattatgtatatattaaaataatgttttggttttttttactcttaaaagccagttgatttttgcttacaaagaagagctttctttggttcctcttcacttggaggtttgacttcaattactgtgggtcagtaattcaaggaaagttagtgggatgaggtgtgaatggctactcacatatatatctaagaacttgtatttgtatacacacacacacacaaacacacacacacatatatatatatactctcatctcacctgtgcctccatacatgtaatctcacatacccacatccctgaagacttgaaacattcttctataaagtcttaaggaagttaattctatctaatttaccagaatttgtatatttgtatgatctagacatgacttgcattaccttttgcacccacagccctttctgtggattttatggcagtggctattctggaagaagcagccctacatccatatgatcccaacatggctgtagctaactggactaatggtggacagttggcccaaggccaggtaatttatcgactggccaaatactaatgagagtgtctttcaaatttttaaatagaaaatcatcagagggccaaagaaaatgaatgatccacattcatttgttcttgaagcaaaaatagattgggcactactcatgatatgctaggtgtggtactagaattaatagccttttgtagaaggaagtaaattttcttgaataatcacccacgtaaaattaaaatctatgataaaggcagcacagaacattgtataatattttgataaaataatactttatcaggaattttgactaagatcaggttatccaggtgtgcttcccatggaaatgacagtaaggactgagctaagatctgagaatgaacagaagttaagcaggcaaataggggtgaagtaccctctagaagtaaagaatgagagccagtgatggaagggggagtggtaagcctgaagcactggaaggaagccagtcttgtggaagaggaaaaagtctgcaaaaggcaggagtgtggtttgagaagaatttggagaggtaggcagaaactagacatggtagggcccaccaggtcatgttttagagttttttctttattttaagagccaaagggttttgaagagagatatgatataatcttattagcatttttaaaagatcattctggctgaagtatcaagagcagattagatgaagtcctggggcatgtatgtgtagagaccagctgggaggctactgtagaaatccaggtggcagatgttagaagcagaaactttggtggtgatggcaaaatgttaaaatttgagagagatttgggaagcaaaaaccacaactgttattgttgttttaattgattgaatatgggttgatgtcagacttgtgccaccaagttttgggagtatctggagtggtggaagagagatcccaaatttagtcctggttatttggctttgtggtaactttgagaaatccgagagagatattaagcaggttaaaggtcaggaactcagaagagagtatgggttagaaatgtaaatttatgagtcatgtgtacacagatggccatgaagctatgggtgaggctgagtgattaaattcagacaataagaaagcctaggagtaagctttaatgaagtttcacttttaaaaattgatagaggacaatagccctgcaaaagcattaaagaagaaatggccagagatataggataaaaaccaggagagccttgtctcactaaatcaaagggaagagagtattttgaggaggctaaggcacactgactatgatagctaaaattagatgaacaaacaaggaagactggaatcacctaatgttgataaagataatgagaaactaaaagtcttatatattgattgtgggcatgatagagccacttgagaaaactctggcagtttcttaaagagtttagcgtgcatctacactatgacataggaattccattcctagatatttatataagaaaaatgagaacatacactgacaaaaagacttatttaagaatcttcatagcaaccttattgttaatgaccctaaaattgaaatagctcagacgtccatcagtagaatgaatttaaaagctgtgaaatactcacacaatgaaaaattcactattccacaataaacaggaataaaacattgatacataaacaacatggatgaatctcaaaaacattatggtagataggaaaagccagacacaaatcaggcagactgcatgattgattccattcatatgaagctccaaaatagggaaagctaatctatggtggtggatatgagattggtaggctcctctatggtggcaagggtgaaggactggctggaaaggggtaggaggtgactttctggagggttgtaaatatcttaaatattgatagaggtatgtattatacatatgtatgcatttgtcaaaactgaccaaactgtttacttactacgtgtgcatttcactgtatttaaattttacctgaatcaattttttaaaatgaattctgcagagacatcaaataggatgagaactacgaaagagctattgtattcggtaacaaggagatcactggtaacttcaggaaaggctttttctacaaatttatggggtcagcactagattggaatgggtagaatgggagaaagatgaataaaaacaaatagttgttgcatgtaaatctttcaaggagcttggctaagaaggggaaagaagcatgagaagatagctagaggagaatgaggagttcaatttgggtttctttaagatagaatttaaatggataaagttaagaatgtttagaaatcaaagaaggagagaatacagtggaggaggtggtttgaataaaagagagagtgtattttgtgacgggaaagaaaagatgagggaccttctgtctgtttctattttttctgtaagtaggagttggctcatcttttgagagtgaggggagtttgagatttgaggataaagaaaaaagtctgaaatagttgagttggggagcaagagtgtgggtttatcagcaagacaattgattactgatctacagatgaagccatgctgggtcatgtataagatgagtcaacagaaagggagagactgacaaaagcatgcagataagagaggctttttggcccatgagacacaaaaagaagagtctttgatttgacctctcaagctgaatcattgtgaaacctgggtcaacaatttcctatgtatgtgatctttctttttttcttcaacagttattttaagttctggagtacatgtgcaggatgtgcagatttgttgtaggtagttgctggtttgctgcactcagatcaacccacctcctagatattaagctcagcatactttagctattcttcctgatgctctccctcccctgcccccgacaggccccagcgtgtattgtttctctccatgtgtccatgtgttctcattgttcagctcccacttataagtgaaaacatgtgatattcggttttctgttcctgtgttagtttgctgaggataatggcttccagctccatccatgtacctgcaaaggacagaatttcattcctttttatgactgcatagtattctgtggcgtatatgtttcacactttctttatccagtctatcactggtggccatttgggttaattccatgtctttgctattgtgaataatgaagcagtgaacatacatgtgcatgtgtctttataatatgatgatttatattcctttgggcatatacccagtgatgggattgctgggtcaaatgctatttctgagtctatatctttgaggaattgccacactgtcttccacaatggttgaactaatttacattcccaccaacagtgtagaagcattcctttttctctgcaaccccaccagcatctgttgtttcttgacttttcaataatcgccattctgactggcgtgaggtggtatctcattgtggttttgatttgtgtttctctaatgattggcgatgttgagcttttttatcatatgttgattggccgcatgaatgtcttctttaaaagtgtctgttcatgtcctttgcccactttttaatggagttgtgtaaaactcaaaactataaaaaccctagaagaaaatctaggcaataccattcaggatacaggcataggcaaagatttcatgaccaaaacgtcaaaagcaattgcaacaaaagcaaaaattgacaagtgggatctaattaaactaaagagcttctgcatagcaagagaaactatgatcagagtgaacagacagcctacagaatgggaggaattttttgcaacctatcaatctgacaaaggtctaatatccagagtctacaaggaatgtaaacaaatttacgggaaaaaaacaatcactatgtaatcttaaactgacttcgtttgagtaggtttctgtttctcccaaccaaaagagccctgataaggattagtagtgtgtgtgtgtgttttttttttccctacatggaatttgactaagtctgcatgcatattaagtctgcactagaaatagactaagttttgagtttccatgttgagacaaaagaaagatatttccatttcaaaaattaatacatctgttttcatacatgtatgtatatatgcatgtacatatacacaaattcatatgcagtcttcataaattggcattcttccaacaagataaattatccttcctctttttcacatgtatctttcatctagtcagtttatgtttttgtcctttcacctgggatgaccttgtttattattatttgaaaggtctggaggatacagaataaagaatggcattatttccttcagatcttttaccatgagggacagtctgatacccacagtgtgatagggaaagctctgaccacactagtttgacttgtttcccatttcatggttgcagagtaatttggatttgttttaggccaggcccctcagaagcagactctgagatggagattattgtgcaagacgcttattagggagtactttcaggatcaacacctgtgtgggaagggaagtcaacagattggaaagtaggagaaagtgggctataatacaaatacagtaaggcctcaatgagtcccttgggagttctgagactagctggaatatcttgctttgaccagtcactggatttaggctgcctggggaagaggatctagccttaggagaggtggctggcttcagcagagggcaatttcaaagggaagtctgatagctaatagcatcctgacatctggaggagtaagaccccagcctcgcaatggacatctgggcttagtgcagcatccactcactgattttagctgaaaattaaaataacaagtttgggaaagctaatatttcttaactacctaaacattaaaggaattcacaggttaaatatcaagtcaactataggatgatgagaaacctaagatttattgacaaaatggaatatataagtcaactggtaagactgtccagattgtggacctcttttggggatttacaacatcatccaaatcttaaattacaagtctatctatagaacacttgcaaatgcctgtgaggcaatgaataagagttgtggagggtagtgacttcactgaggacatttaatttgaaaggtttggtttcatgaaatcgttagctctataagatttcatttcactaattttttgtaaataagacaatatagcaggaatcttatacagtattgaagatatgcaataatgggattttacttcagtgacctaagttatagggcaactatggcatatggtctttggaaaattccctcctcccatttaagccattgttccaaaaacagtccttacctcttcctttggtgtgggtgccttctgttagcactaaactctgaggactttttttttttatatgggaaaatagagcggtacattttagaagatctattccataatttagtccaaatatctccactaaattagcagtgtgtttttgttagaaaaattaagacaaacaactttcacttctcagtaacctagcatgatacaactttctcactagcatagttcagtgtgaatcaggtggccctcttctatcttgaagcagtgatccctgaaacacatggccacagctggggaagagagggaaagagcaggtagaattaacatacattattgttgccattggccaggaccaggcaactgcaggagatgataggaaatgtaggagagcacatggaatatttgctgagcactaatttcagaaatttaagttagaataatttaataaattaatattttatcaattaagctacctgtttccaaaaatgtacctagtttactttccttgatttaaaaaaaattaacttgttgaagacagaaaaaaactgggatgcctgggatttgagtgagaagagcgttagcagccagatcagtggtttccacactgtgtctggtgcagttatcccagagtgttggggaataatgttgactggacaagaaggcaacagggcaggctccaggtgtcttggctctacaccctactgcttgattcccagctctctatctgttttgtattttgtggggaaaatgagttctgctgcaaaaagaaatatctgataactactcatctactctatcaccctccttttaaagctatggagttttacacaaccatctaaccaatattttggggctatagggacaaagtccctgtcctccttatgcctgtactccagtgtgtcccagaaagctccagtgatttcctaacatcagaataagatctagaacccatttttctaactttcagtctggcctgaagtgacagtgagattgtcaactgagaatattctgaaaattttggcatggaaatgactgtctagggagtgtcttaaacaatggcttctatcttggagaagggacacaaacctcctaacagttattttaagtctaatatgtgggccttgtttggacttcacttctttctcacttataacctttagtgttgagcaaattctcctctcagagtacagtatgtttgttttatagcacagtgtcataatcaacaaataacattacaccaacagcaaaaagtgctcatatgtgcactccttgttattcttactttgactccatgcagttggtgtgacagttatggatgctatccctactttacagaaaagaaaacagaaaaaataatttaaataaaggttacacagcacaagtagtaaatgttccacagaactgggaaacaaagttaactattattacaactggatactaaaatgcaggtaataactgagaatttctctaatgtaaactcttaccactagtagtagtaataattattatgggatgcatggagcggagtgcctgagtgtgtggatttctaaatcaatgaggcctgggttcgaatcctgagatccaccacttttactatatgatcctgataggtcatttaaacccctcccaattgtcttatttgtgaaatggggatgggtgggaggagcaaataggataacaatggtaatatattaagaatacacttagcacagcttttcacatgtgggcaacattaacaacttttggctataataatgattattttataacaatgtgaattcaaatagtactacacactcagtattcacatctctttgagtataaagacaggtgcatctacactgtgtgagcactgtttaaaggaattttgaatcacaattggagctttggttcttacattgtgctaagccagaagactcttattcattgtagtgattttagcacaatgcagttacctgagctttgggaatacacagaagttgggtgctttcttttgaactagggtagtaaaccttcttttagcagcactttggaatagatttaccctgcattatgcttacagatttaattcctcacatttgttgttttactaaggaagcattttggcttacccctcagtttataatctcatatgaatgcatgggaatttatatacattattcatatggtctgtcttcaatggaaaaaaataccctatcttgagtttttagcatggaggaatacctccaactaggaaaactcactgtataagaataccttacttaaacaattaacagatttttcacccttaatcaatggcattcctgagtaaatatttaaaataaatgctgtaaaaatattaaaaatgctctctaaaatgttgcttgaatgtaggtctaatgtggacttacagcacagaacagctgacataatgctgacattttcacacaaaattagaagtgatagaaagttaaaaatttttctaatattttaaaaatacagacatcacagctctacacctttgctgagatcaaaggtgtaataaaaatactcaaaaaataatccaatgtgtaataaaaatttctaactatcaataccaagttttagctcacagcgtatatacatacttccataataccgcttatatgtcaaattatctacatttaactcatgagaaaatcaagtgcatggaacaaagacctgtgttttgttggtgaaactctagtaagttggatatattttccatagcatttatgaaaattttctaaaagataaaatcctaccagaattttatttatacttaagctggaaatgacttaaaaaggatttgggtaaccctgagaattagtccttaattgtttttccttcaaatttgaaagtaagagacttttgcctttattatagcaggcattgctaaacctttcacaccacatggcatgaaaagtgggcaaagtgtttctgtttacctttttggattcttggttcaagaccaaggctggtcctgggcccctgcctctaccctgaccccaaagaggcaactccttggcttttagtttctgtttttattcctttagggaagaattgatggctaacttgggagaaatttagtcactttatcttcttttttcctttctttgctctctccttcttctcattacaggagacagaaatatgagagccccagtggggaattttcccagaagagagaaatgaggcatccgttggtctataatgccagtcatttccggagaggagtgatttttcttgtctggcccttagggctctctcctgctggatgaacccagccctttgtgccatctgcctcagggatactgggagggagacctggagaggagtggtacagataggaggtggacactgcttcatatgagcctcctctacatgactgctccttcttagagagccttcctgtcagggtgcagtcaacttctctaactttaaatgggtggctgcatataagtatctaatttactcataggctctgaggtgttacagacaaaacggtaaccctgggtgaggcagaaagcacatttagaaaggaagaggatgctgcgttggcagcacagtcattggtaaattttgaacaccccctgttattttcccttcagcatgatgttacaatatgttttgttcaagcctaaatgaaccttttcatcttgtaattaacatttttacagtgtttctcctaccaccatatatttttgtttagaaaattaagacccagagccaaagtcaatgagtaaaagtgtttgttttgcaaagagtatgtatttaagcctgtaagagatgattagagaaaatcaacaataatttaatctaaactttcttgatttcctcatatatcaatatttagattctactgtatttctttttattttattttattttgaggcagagtctcgctttgttgctcaggctggagtgcagtggcacaatcttgactcactgcaaactctgccttccgggttgaagggatccttctgcctcagcctctggagcagatgggactacaggcacccaccaccatgcccagttaattttcttttcttgtatttttagtagagacggggtttcaccaggttggccaggctggtctcaaactcttgacctcaagtaatccacctgcctcggccttccaaagtgccgggaagtgctcagcccttccaaagtgcccagcctgctgtttatttcatacttaaagttttaaatatattgatgaaatagtctttttctaacattaagtgatagataccacggagtgtgtttagtggcatacctttcatgacatgcattttgacatatatgaagagttgactctctgaattctgtggggcaaattgacatccaaatcacaagttagctgaggaattccttgattctaatcttgattctgctgtctctaatctaaccctctagggtctctgagttttcaagaatgttttattcattttaattaattaattacttaattaaaataatgttttggcgctggcttgcattagaaaatacagaggtatactaaaattaacaataattatgtgattctgtaacttactgccaagcctattaaactctcaggaagctctattttttatgtatatgtcagagctagtttttaatttatctgaagtggtttgtaattattgataatgctgataataaaatttatattgtttggatcagaaaaaaaatttaaagtagactctgccttttattaaatacagtttggattctaaaatttgcttgctggcacaacaatctgcgtattgttggtgtgatcctgtctgccctcctctcatagaacacaaaaaagcagcccggatgaggagtcaactcacctctttctaaacgctaattatttgctgtaagttaaatggtcagaggatgtcagtgtgactgtctaggtctttgttcaaagatctaaaaggtagcagggaaaagttaactcaggtgtggcaaataacttttcagtagtaagaacctctggaaggctgtgaaaatcagaaagagagagaggtacttatctgcacacacttttctcctggtcaggagaaaattaaaaatgactacccatttaacgtaatgtctgttagataagctgacaaccttaggtttaagtagaaatacaaaaactctgcattttaaaaatatattattttaggaggaaagaacacaaagtaaaacaaaggtttcagtgtatttgtctgactctggaagctttggaacacagcaaaatattgtgcattcttggactggacatattttagtcaatatgctgactatgggatccctgggctgaaaagaggatctggcccaggcagtggtagccagttggtatacaatgtcccgtccatgcgtacacactaggccacattatgaatactgtccaaattttatgacttgaacatactcattcctactcactttctaggtcttatcaaagcacctactcccttcactgtgttctgtatccctcattatccaggattgattttagagatacttcatatatgttttttggtgatgtgtagcacacataatgttgtttgtggagaacctttgcatacgtactgtgtgcctctggcagagtgcacacacagggaacaaaggaagctggttggggtaatttctaagtgagtttgaatattccaaggaaagcatgtaaaaggtgccctctgataatttgagcatttaccctgagccaaagtttaattaatttttcactaccttttggcctagtaaacagtggagaagaacttggggagagttggcagctctggaggatgagatgatcaatctggctccaataggaagattagattgaaggaagataaagggatatcagggtgattaaagctgtgccagggtgaaggttatagaggagtcaaatctaatttaggcattaggttctaaaggtagaacagtatagaaggtgccacttgagtattgttgaaaacctctttggaagaagccatattgaagacaaacatcatagtacgtcccacacaggcagtttacccttcgacattgaattatgcagttctgttgagctccagattccattgttggcttatgttttaagggccatgttgcattaaaaaatgtgtccatgtgtcattgaactcattgaataccatagtcttactcaacttggagagttcatctgtggatgagagccacacaagaactgagttggccccttgggtagaagatctttaggctgatttagggtaaatacttatggagagaattagaatggtaaatggacttctgcccactatttaaaacaattttcttatctatctctctgtctcatgcatatggttaaattcttataagttagatgcttgtatgatgcagatggattgtccttgtggtcacttggcaatagtaaaggaaagaagcttcccttagatccccatactctggcccttggtggatttagcactggaaatataaacattcatttaaatgaagtatttctcttttctccatggatcaactctatggaaataggctactgttgttctcacaaaatctcattcaccaaagctttgaacatgcaaaagttttgagatctttgcttaacacatatcagtctaaaggtgaagtactgaagggtgtttatttgttaaacatctgttggtgctttcaaattataagacattggtcctgatgagtcagtatatagcaagaaacacatatttcaggtcttgaagggatttccatttttggccttgctattgtttacatttgatatttcttaaatttgacctccctttaccttggtttaagacccctgggagtgaactcctatcaatggtacttgtgctgaaaggagaaaatgctttcccctcaccaatgtcaaaacttttgtattcagtatcaaaaacaatgttctgaaatttttactgcttttctgtggatataagatttttattaagtcttcaggttcatatcttgaacctagtcagttgagtcaagagaagaatttggaattaggtatagaagaaaactgaagatgaagaagttagcttaaaatatggaacttaaccctgcctcttctgtggtctataaacctacatcagaaggaaatacacgtttcaaagaggcaaagacaattctcttgtttaagataacacatttttgagttagtcataatttgttttgttactgaaacatttgaatacaaatctctgatacccaaattaattatttctcaccattcctcccttccctgggctatttatttcttgctttgttgtgtctccaataaagcaaacataaaatacagatgtaaaatgctacagtagaatttatgtaatctaccttgttattgctgttattataactgctattaaattgtaatagtttataaagcctgagtgtctttaatgacttttttcatatgattacatatttatttaaaatgtcattgcgttattcttaaggatagttccataagcttctcagagcagtgactcgttgcaatgaccaagaacatcttaaatggtaaagaaggtgttcaagaggtctcgatgaaacatttggcaaatattagaccttagaaatgaacacaagcttaaacatttaatttaattgaacaaatatttattaagtattatgtgtcaggtactgaatcatattgcccaatagaaaaatctattagcaaaataaatagaatttaaaggagaaaagtatttgctgtctactgtgaacccagtggcatgggaaagaaggatttgatgtttcagtattattttgcaaacaaaagaccaatacctttatttcaaaattctaagtaaaaacaaatgtgaaaaatgagcttcatggaagcttcttaaatttcacgcaccatcctttgttctgaaaacaattgaatctaatcaggtgtggtttgaactttttaaggcaaatggactcagactctctttttctttattcaaccaaaagctcctttgattgaattactaaatctatgtatgtgctaatgccttaatatagcccaaagtttctatattgtctgtttttattaaaagatgtctatttacttgaatatgtgaaatattttatcattaaaattagtaatataattgtatgttgtaaaatatttaaatgtgggtcttattaaaaaagttccagggagataattaggcttggcacctcaatccatagacaaatagatgaattgacatgatgcgaaaaggaggggcttgaagggacggttacttggtagagcaccaaatgtattttgacagacactaaatgctttttatagacaataatgttgttttgggaaaatcagtttatctttttataagttttgcaatctacttgaatgtgcttaaagaatatattttatatttctcctgcccccgccccatctctttgtctatactgggaattccataatgtaacacccttaaatagaaaacagttacagctaatcctatttaaaatggttgctaagggactattcataggagcttagaaatgactcaagatctccctttaaggagtaaagcaggaaaagtaaagaaaagaacacttctaggaagaattttaacatatgggtttgtgtcatgtggtttctggtatgtaggatgtaggaatcatttcccaatctgtgagttccaggccttccattgagccctgaacctaatgccagcacacttctctctcctcaactcctgaggacacccctgggcaaatggggctacacagctggggttagggtaagaaggacacttcctttctctacaactcaggtatggtagaaagtgaccttatgatagctaaaagagtatctatagcactactaaccaactccttcagaagaagagccaaagtagtcattggggtgtggtggggaataaggatagctgaccagctgtactccactctttactgcccattttaggaaaggcagagtcctatttcattgtgctctgaatgtatgacttctgcttttcctgtttcaggatgaatgtgcaatatatagttttcccttcatctatgagagtgacttgtatatttctttgtgaataggaaaatatgatcccagggtttgccatgtaccaggcagattatgcttctactataaacaatgttttctctctttttttttggccagttgcaaatattcataagcttataagagaaaacttagaatgccaaaccagatattccttctgacaaacaggaagttagagatttcttttttccacaaaaaatttaagagtggatacaaggacttctttaaaaattaaaacttggccatagagtttagaacaaataacacagtcagaaatttctaattctaactaacaaaaaggttaggttgaattagtcctcaaaactaaaagtagaattagggtgtgattaaatatctaattttaatgataaatgcctcaagttattcttagatgtttatgttaagagtaatttagatattttagaatttatatttagagtaattcagatatgtttataaacctatgttagctaacacttactgattacaaaacacagacttcttattctataaaaccaccgaatcgagaaatcattgtagtctccattgcactttgccaaaaggctttgagatctatctgaggcaccataattttatttgttctttacagggcaaagttaactcttcagggataaatggcctctgattacaagcttctcaaatccaaacaaatcaaatgttaagaaacaaaacatgctacaaatttagggcctcttttgctggctttaggttgcatgagggtcatagtcatcctaagttaacaagcgttgtgctgcctacatcactatcagagtaccttaaatacagtggacactcagcaaatatttgaatgagtttaagtataaaaggaaatgtactattttgatttaattctatttgaggagcttgtttttttataatgatgacatcaatttccacatggcgaaagtatccctaaatgttgcatacagacccaaggccttctattcttatttgtgggtattattcaatgttttcctatctgtctaaatcctgtacccttatatattgacaacttttctatttacagttatactgactaatgatatgtatgtatatgttttctttattttccatatattactttttatccttccccaattctgtcacatatacttttcacttttatctccactttccaactatggtcaggctgatccagaagaaatcagtctagtgacatatgagataacctgcctttctttaaataatagttctgaatgtaaaaggccagcatcatggaatgtgtttgctctgtgtaggtggtccaagctattttctgattgttcacatgccttctttccacacacctgtgaatctttttcacttgagaacacctagtatcccttgctccacaaactctgtttcttctccctcacatataacaaatatggctactaagaatgtcagggagatagcagagcttaggcaagtcacttagctgctctctgactcagtttcctcttctcacaggattgtttggaggattacatgagttagtatttataactcatgttatatatataaagcatttaaaacagtgacagacacatagtgagtacttgtattagtctgttcttacaccgccaataaagacatacctgagactgggtgatttataaaggaaagaggtttgatggactcacaattccacatggctgggaaggcctcacaatcatggcagaaggcaaaggaggggcaaagtcatgtcttatatggcagcagtcaagagagtgtgtgcaggggaactctcctttataaaaccatcagatctcatgagacttattcattatcatgagaccagccagggaaagaccctcccccatgattcaattacctcccaccgggtccatcccacaacacataggaattgtgggagctacaattcaagatgagatttgggtggggacacagccaaaccatatcagcactctcaaattctttgataaataaaatgggtatggaggaaaattagtggtgagaaaaatggcaatatttagaaagcagaataggaatttctcacttccaatgtgaagagtttaagagttttgtgggttaatgcttgaaaaagctggaatgagctcccaggataggttttcactcaatagtcaagttgtttctagcaaaagccaattagagtaactagcattcaaaaagatcatttcattgatgagagtgtttgtaggctgtttccaatgttacagagtattttctcacagactccatagctgaaatcattgtcctacgaagcggtaataaaattttacttttctctatctcttctaaaaatgtactgcctgctctccttccagtggttaatgagtcacctgaaccaactggtatttgtattctaagaattcactctatctttgagtaattctaagctgattttaaaattacccttataaaattattattgctctggatttctgagtatataattaattttgtaatgtggagatcattcctttctagaattatagcgaaccggaatacttttttgaaagatgccttgagaattcaaaagggatattgctcagttagtaaattttatcttaaagacttgattcataggcagacttgcaggctcacactgagctcgtttattctaacttgtctaggttgtgatgtaattaagtaagtcagttaattagttagttattgccagttaggatgggaagtgggacaaccagaggctttatttcttcatttaatatttattaattgagtgcctgtggttcagaagatattacagtaatgacagccaatgttcctaccctcacagagcttgcattctgggaagtaaatgtagtattatggaattggaggtgtttatattccagtgtttgaaaaaagacttacattaccattctgctgcctactgtgtgaccatgacagatttttaacctctctgtgcttgtttctctatatgtaaaatggtaataataaaattacttacttcgtagggttgttttaagattaaatgagttaaatacacataaggagcttaaaacagtgcctgtcacataagggctatgtaaacactggctattaccattaattagttatgtatcattatatgaggtaagtgtataaagggaggcagaataaagggatagagaaaaataggagctgctgtttcaggtaggattgtcaggaaagccttccctgagaacaggataatttgagccaaaacctgaatgaaacagagaaatgaacagtgctaacatctagtggagaagaattccaggcatagggaacaagtagtgaaaatggcatgaggtagcagagtgcttacatgttgagagtagctggtaagtctgtgtgatagaagttccatgagccagggagaaaggattaagctaagagactaaagaagagggaagaaggtcacctagggcttggttggacaaaattttcagcaaggaattataaattctaaataacgaaaagccagcagaggctgaatcaggggagtgacaggattctgtctgaagaatatactgtgaggagacaagtgtggaccttaagagaccattcagtagtttattgcagatattcaggtgagagacggttatagcttgaaccaaccaaagcagtaatgaggatgggctggtgtttgagcgattgactacaaaacatatttcaaaagtgaagcgaaaagattttcttataggtttgatttagtgttagtagaacaaaggagtctatgatgtttccactttggggcctgggcatctggatgactaaggtaccatttgctgtgatggtgttcacttggagaggaggtccaattgatgggtggcattttgggacatgtaaactttgagatgatgattagctatgcagttggagatgctaagtacgtagtcgaatattcaagttggggagtttagggaagtatttggggctggggatataaatttggagtggtcagattgtagatgttttaggaagccacggaacttgaattagatcaccaagactaaaggagatgaagaagagaggagaggtgaagattagctgtgggagtgctaattattaaatggagagaagaggatgcagagccagtagaggagatagagagaggtgatcaatgagacagaagatgaccaggaaagtgtagagttctggtagccaaatggagaatcatttttaagaagggtagaattaactaatcctgccagatgcttctgaggaagggagtaaagatgaaggttgacagttgcctgctgaattagacactgtggaggtcactagtacccttgtcaagagcaagacccttgcaatggtgaagacaaaaacataattggagtggattcaagaaagaatgtgaaattgcaaagatggacaatccttttaaagagtttggatgtagaggggacagcagtatggggataatttgacagggtcatgaggtttaagtttttcttttaaatgagaaatatcacagtgcatgtgctgttgagaacaggccaattaagagtttaaaagaaaaatcttgatggtgtacagaagaaagggcataataatgggatcaaagtctttgcataagccattgtggatgagcttgagcagaaaagaggaagaaaagactatagagccaggacagttcatgcattgaaactgataagaggtaaattaaatgggtacagaccaggagggtagtagatgttagagtgaaaggcgtttgcttggcattagcatccttctatctgactagggccagagagaaggctgggcaagaaagagagaaggctgtagtcagatagaaggatactaatgccaaggaaacgcctttcactcttaggcagcaaagattaaagcaaatcttaaaggcataccttaagtttttaaacaaaagaacaacgtagttagatgtgggtttcaggaatataaattatgcatcccagtgtccattattggaggaggaagagtttggggaaaagagtcaagttaggaggtattaaaatagcacaggcaaagggcactttatatttgttttataacttataagtgcccactatggttggtgctactagtgatagtgtcagtggggagagataggtgggaaaaattaatgaaactaatagagattcagtcaataaatgtggacgactgattagatgtggtattgaggaaaagataaatgggggtcaggaaaatggcaaaattttgaccgtggctaacctgggagagcatggtataataaatataaacagaggacacgggaaggaaaaaaaaacaattatgggtgggaagattatcagttcggttttggcatattgaaatgccagctggcagtttgaaatgccagctagcatctaggtaaagttgtctagtaggcaatttaaaatttaagactggcacttgggagtcatcaggatactgcttatggtgaaagtcatgagaatggataagcaagccatggaaagggtgagtagaagagagaagtaaataatgtcagtgatgcaacttcatagcctatttacattatggaaggagaatgacgtggagtagccagagattgaggtagatacggggcggtgagagccagctaaagagtaagccctgaagactgtaatgttactgaatccaagagaaaaatgagaatgttttaaagaatgaaaggctgttcaatggtatcagaaaatccaaagaggttaagaacgagaactcaaaatatgttgctggattttgatcctttgcaattgatggatgatagccaaacaacataagtaacaacaagcaccacaactctgacttcaactccaagcttcaactctgactatcatgaccaacaaaacaacaatattttgccaccaggggaagaaacagacaataaaaacaccataaacatgagaatatactcaaatgtacaactgtctggggccagttaatataagattcaaagagtgcaactcatttcaacaaaccctaaaggaatcagtaaattatggtttagtataattgatgcttataatgttgaaacatgagtctttcagagaagattcattcacattagaaattcttggtttaaaaatcagttgcactaaaatgcaatgtagtatcctgaattggattctggaactgtgaaaggacattagtagtaaaactggtgaaatccaaataaagtctgtagtttagttaatagtcatatagcatggttgatttcatagtacaatatgtctggtaatatataacattaagggacacagaatgaagagttatgtgaactctctttactatctttataactttttcgtaaacctaaaattattacaaaataaaaagtttaatttttaaaaatgaccaaaaaaaatccagtgacaaatgtaatttagaaagattttctacccaaataattaaatgaacaaactcttggtgcttatgtaggtaaaatttaattagtgggtactctgtttatgagaattaactcattccatcaatgtttttatacaaatgaggtattatgtcctgagactaaataacactatcaataaattttcctataagtcacctgctttctccagttgacttttagatctgtagcttaactagccagcattaaatgagcctatttacacaacaaaatgaactgcagttctgcttttgtatttggtctttccttacaaaaaatagtcaatcatattccttgctaagaacaagaaagagaaaggtacccactgttaattaaacaaaccaacaaataaggtgttgtaatatttttaaaaagtacttattacttatttgcccttcctgagacatatatcagatacttctaatgggtgattatttgcacatgtaattcatattaataataaccaaagccattcttctagaagtcctggataggaggacatctgtgcagcggaggcagacatgcctctccctggtctcattgaagtcagtgaggttgttaactaaaactctggtcttcaatacaagccattattttattttattttattttttgagacagagtcttgctctgtcacccaggctggagtgcagtctcagctcactgcaacctctgcctcccaggttcaagcaattctcctgcctcagcctcctgagtagctgggattagaggcacccgccaccatgcccagctaatttttgtatttttagtagagacggcatttcaccatgttggtcaggctggtctcgaacccctgacctcgtgatccacccgccttggcctcccaaagtgctgggattacaggcatgagccaccgcacccacaagccattatttagctactttcttgtcaaagggaagctaaagttccaaactcccattttccaatgcaagtattaaactttacagacaattgttctgagcatagtgattcacaaacacagacttgatttggcctcttgcacaatcatacttactgaattgcattttggccttacaggaagtttgcctactgaattagcaagcattaaaacaaatttgcttatgaaaaagagatgacaagtttttgaaggcttttttcataagtagtgaatcattcaaaatctaaactttgtatatatagcatacttcctctagtgggaaccataagtgtaaaaaaaagtagtcatttaatacagatagcaaccataaagaaacctatttttgtctttattacgcaaatgcagttgaggaaactggccaccacatcttgaggtatttcctttatgggaatttctgatgacatttctctctggtttctttaccagcacttatctcaagtgattgttctggttgtcattttgtggatattgtaaatttttgttttggttgccaagaaaaccagaactaaatttgcatcttacctttaatcactatatagaatccagtggcatacatatgtatactcacccagcttcggtctatttccctgttcttatttccacatagttccacttctcacatatacataatgctgtttttacatttcttagttcttcctcaagtcatttttcattgtgctaatatatatataacataatacttatcattttaagcatttgtaaagtgtacaattcaatggcattaatacactcacagtgttatgtgatcatcatcagtatctatactcaactatatcttggtcctcaagaaaaacccagtacccaataaacaataacttgctcttcccctctcctctcatctcctggtaactctattatactttctgtctctatgaatttgcctattttaggtacctcatataaatgcactcatgccatatttgtctttctgtgtgtggcttatttttgaggcaggtggatcgattgagccttggaggtttaggctgcagtgagacatgaccccatcactgcactgcagcctggacgatagagcgagatcctgtctcaaagacaaaacaaaacaaaaaccagaatgttttcaaggtccatctactttctagcatatgtcaaagtttcattcctttttatggctgaataacattctcccaaaatcctttttgaatgaagtaaggtataaaaaaggaggaggaagaagaggaagagaagaaaaaggaggagaaggaaagctcgtatagtttattcctatgagaggagtatttaggttatgtgttagcagaaatggagtaggatgttagtagatgttagcagaaatggatattgctgcctgctaattatgaccttggaaaagtcatcttattttctcagcagtaatttcttgtgctcaataggagcagtgaccagactccatggaggaataaataaaataaaatatgagaatatgcctaaggtgtacatgctccataaaaacgatagcttaaaaaaaattagtgtttaattggctggcacccaagatctgcctgtgggctaacttgtgagataagtgaaattgatatttaggacttttctcctgtccactgtcagggcctctctctcctcccacaacttccatcctactcttccagatctcaaggcactcatgttccatttgtaatgttctacagtttccgcagataggtttctatatttaaaacagtttctaaacagttcacaacttctttagagttcaactcctaattaaccttaataggctagcatgtgatagattcatgaggggcattaatatttaataacaagcaaaaaatcatgcagtgctctttgtttgattgaaaggcgttagaattctcatttagaattctgatcctacaactgtcttatgtagtgcggattttcttcaggatacaaggtggttagatgggagcactgtctttctcagtctccttaagccatattaaatggaaaggggcatgcgtcactgtcatctccaccctgtggtaaagacatgcctgttgataatggttacagggcaagttccacacctcagcatgctgcctaatactatacctctttttgtgacttttcttttttttttttgagacagagtttcgctcttgtttcccagctggagtgcagtggcgtgatcttggctcaccgcaatcacagcctctcaggttcaagcgattctcctgcctcagcctcccgagtagctgggattactcatgtgccaccatgcccagctaattttgtatttttagtagagacggggtgtcttcatgttgatcaggctggtcttgaactgctgacctcaggtgatccacccacctcagcctcccaaagtgctgggattacagatgtgagccactgcgcctggcctttgtgacttcttaaaatggcatttgaggaatcacactacctagatatattttgatgctttttctgcttagaaaagagggactgattctactcttgttttggtaattagctaatcatgttatacattttccctgaaagatcttagtaaactatctttccttgccattgtattctttttgccctcactttctgctaaattgtttgtttgattgtagttttgtcttattaggcacttgcatgtttcacacttgaagtagttttattttgctattggataaattctaccatcaaaatatctggtaattgggacctaggttagagtttataatatgaggaagaatacaaaacacatataatgtcctcagctctctacaaaacgtttggtagacaggctgaaagaagattcactatttaaaaaagaacaagtttctatttttgcctctaagggaaatgagctttgcccacccagtaaccagcttggtaatatcatctgcagggacttaccctcaggttagttccagtaaaggaatttagggacgtaaagaggacgtaaagattgtgaactaataatttatcacaagtcaataaagatttgttcctgtctctgcatttttatctttctttatttgttttaaacataagaaaatagactgggcgtggtggctcacgcttgtaatcccagcattttgggaggcaaagaccgactgattgcttaagtccaggaatttgagaccggactggccaacacagcaaaaccccatctctgcaaaaaaaaaaaaaaaaaatgcagaaaattagctgagtatggtggtgtgtgcctatagtcccagctactcaggaggctcaggttggaggatggttttagcccaggaggaggaggttgcagtgagccgagatcgtgccaccacactgcagcctgagcaacagagcaagaccctgtctccaaaaaaaaaaaaaaaaaaaaaagatttaagtgtaagaaaatattgctaaaaaatctctttgagggtgttgccttcaccaacagcatgctacttcgaatattaagatgttacatttcttcctttacaagaatgttctgtaacagagtctgggttcctcagtggtagggactgtgcagtgctgtcttggcatgtgaattgcctagtacctagtaggtggtgaatgagcactcaagtgcatacatcaatgtttaaataactgcttattggaaattggtatatataatattttcctttcaatgataatgggttaatgaggaataatttggaaagaatactaatttcacttttgaggttttctgccctcttttattttggtactattacaccttttgaacaattggatttgtcagtttggatgattaaatgtgactccgtctgaccttatccatccgttgcctgccctccctccctagctgcaatatagtgaaatcagtgtgataaaggctatgacagagctccatttattatttgtaaaatgatggagttgatgagacttcatagagatctcatgagaaaagaaatcaggaaatggtcaggcatacgttaagttaaatgttattttccttttttgtttgaaacaggaattatagaggtaaggctgatgggaaaaatgattgctaaagagcaggtaattaggtataaatgcaattgagaacaatgatttaatagacaattggtgttctactaagttggaatatctatttgatgtggtatataaaatttgactagttagatgaaatttctaaccaccatgttggttgatattacaaattataatgtcatagagcagaatttgtgggaaaggcaaaggtgcaaaatggtccagctgtttaagttagtgactggattactgcagaatctaatttgaataaagaaagaaaaattgagacattaaaataggactttgtaaaaactttcaaaactaaggattggctttagtccaagtgattatgtctttggacaaccatgttgttgtcttaccaattacattattttacaggtattatccctgtggatttttttacaagaaatgtttttactgaaatatacatgaagaaaagttaacatatcatgaatagacaacttgatacattttcataaagtgaatacatccttgtaaccacccagcatatcaaaaaacagaacatttctgctctctccccatttcaaccgttactctcaaaagtcaatacactctttttattgttgttgttgttgagacccagtctcactctgtcaccaggctggagtgcaggggtttcaccatgtcggccaggatggtctccatctcttgaccttgtgatccacctgccttggcctcccaaagtgctgggattacaggtttgagccactgcgcccagcccttctggtgctttttaaaatatcaccaaagattctattatatgtttaatctattagatagagaattggtgaagtgcccaattaattcagtaactttagatatgaactttgaattgctaaactaaaaatatttttctcctctagaaaactttcccatgtttagctgtacaaaagtcttccatctcaggtcacattaataatgacacagatttaaagacccaatattttcaagtatgaaagaatataacacacattaaaatactgctataaagtcatctatataaagctgatttaatttttacatgtccacatagatctctgctcagcattgtacaaacaaacccaaacttgtctctcatttcttcactataatgaaagaccaaatattcctattacttactttggggatatggttgatacccgtcaattaagttaatgaacaaacctattatagaattcaagatataacagcagcccaaacacttctaagtgtttaacttctaagttaacaccagcctagtaacttttgtattagtcatgatgtgaattttaactacataggtacgattcatgatatcattttacaaaatcaggatataatatttgttaaataccacctagaccagcagagataataggcattgtgcggggtgtagaatagaaggatgaataggtgttattaaattcctttcaaatattagaaaacagagtgaagcttatacacccaataaatggcaaaccaagctatatcctgagtctggatccaaagtgagtgttcttttcactttgccatattgccattccaaagtactgccattccaaagtgaactttatctgaactgattagaggtacagaaagaaggcagaaaaaaatttagaagaaatgaatggcaattaataatttatccacatatatattcactctaagacaggaaaatggagagaatagaagaatctttctcaatacctgtgtaccactctactctcttcagcaaccttctattttagattaacagaacatggctacttaatataaacttaacagagttactctgaaggataaagacattcggactgattcacaattttcttacttggtactgcacaattttgtgcaatggtttgtaaaattattacagttaactgcataacataataaactcaaacaatgttgaatatgtataagtgtatcctgtgatgaataaaaaaaagtcacagtgagttagaattaaaaggctagtcttgggtgaataaaggcagatgttattaattgactgattagacaaaattcgttgaaattctcaagggcatacagtatgaaatacatgactgtgaacttgactgtgtgaaaatatgttaggattatttttgattacatagtagggaaatatattattgaattataccgaagattattgtttaatttctagggaaatctatactccttaatattctggccacataccaactaatggttagctcttcttttttgaactttatcattactttgaaaaaagaggaatgtattagcatcagtatcctaaaaccacatatgttaaaataaaaaattaaagacaaatttataatatttgaaaaatagaattcaattgccaggtaggcagaaagcatttataaattgccacttgccaattttatttttgaaactacacaatcttttacagaattctacagttattttatggttgaaatcatggaagagtcttcatatttttcataagctagaaagttagtatggtctgcagaaattgtagaaatcggaatcttacatttttcaaataatagaatgcatgcgcatttttgtaacagatgagcaatatgttagtgtacgaatgaaaagacaaactctttgccctgccccaatcacattctgcagaaaagtatgtgatgattccagacattcattctttgcatatataaacaaatttataagtatttatacgtacatctttgtatacacatataggtacaacagataaataatttcattaaactcttgaaatccgatttttaaaagatttaacagtataccccgatcatccttttattcagaatgtgtagaatgacattactattttaaatgttactgtattcatgtaacaatgtttatttaaccaattctttattgatagtttttccttgtcattatttgaaataatgctcaaagtccatctttctacatatatcctctaaactgattaaatttgaatttattttttccatcttttatctgattatcctatggagggtatattaaaatcagtattaattactgagttttggaaaattttagtttatacctattcttatagaaaagaacatgtacaaactgaaatttcactcaaataacatttatatctatatattctttactaatctatcattttgactaaaaattagctaatactttttttcttcatcaagtccttgaatttctagagagcactgcatacagctgtgtttctcaatcttgactgcatattagattttaaaagtctagattcccaggctgcatcaattgaatttgaatctacaggggtggaacctgggcttagtagagtcatccagatgattttaacatgcagccagtgttgaaaatcattgacacagaatagcttattttgaatgagatgtttcctggggaaaaatagagaggaagcaagaaaaagtttaataaatctcaaaagaaaaattttgccaagttaatgtgtcatcaggaatttactatatgtcaaaaacatgctcacattgtgctattttttggtaagagactgaaaggcttcattttcaggctgaatttggttagtgaaagtaaagagagaaattgcagcatcttgcacctctccttagcacttgtctgggttgcactgtctattttctgtttttctacatcattatttaattcatgtttctcttccctggtagagggtactctccatgagagcagagcttcaggctatttcagttcatgctgtgttcctagggtcaggtatagagccgacacagttggtggtcagtattggctccatgagttaatgactaacactttggtaattcaaaagaaggtagaaggtaatcagagcatagaggtgacagcatgggagcagatagcttttattttgtatttttaaaaactcttatatgccacatttagaacaaagtacattttatttggagaagtcaaatgggggaaagtgtgagaaaatgataataaagaaaattattggagagaaaaaagactatttaacaagttggtgagcacatattttagtaagggagaaaaccagtatatactattctgaaaagcctgtcttgtatttaggcaggaaactattcaaagaggacttggttcccataaagtccattttaatcagaagggagaagatttggaatggaatgaagatacagtataaaagatctgggtcagttcagcactagagggaggttttgaaaaccctaaattataaaaaaacatttttctaaaagttcagttgaggccgcgaaagatatgaaagttatcatgtttaacatctaatattaaaattaatgggactggcatcatgtgagaaagaataagaatgattctaatgtgctccaggactctgtaaaacttggtgtgaaatgtctattccaattgctgagaaaaaaaaaaccagaatatttcagtctagttttgagaacttttatttgtatatttgaggaaataatgagtaatattttaatggtcaatgacattatgcagatgatgacaagtattgccagattaagatagacttggttttattgtgtaaatcctgaaagtcccaagtgaatgggaataagggtgtgaatacatgaaaatatgtatgtgtaaaaaagaaaataaactaggtggcctattgaaatgtttatagttcattatgttgttgtattctcgtttctaccaatactatttctcactctttgccaactgagaaaaggacagaagagtattgtaataacgctaaatggtggcattaagaaaagctctaattaacatttagagacatatttcaagactatttaaatatgatatcttccatcttaatttattttagaatatttttaaaattgacataacagacatgataaacaataaggttattataataaaacctgaaattcaataaaacttggtatcatttttgttatgctagtctttcagattttagaaggtctgaacatttcgtagaatcagatttctgttgctgatggaaagaccctagagattagtcagtctattaccttgttttatagatgaaaactgaagcccagcaggtagttactttgaaggctatgagccatgatcagaatccaggctcctttaatttcttttcttctgctcttctgtataatattttactggtttttgagtgaatcgggtccaagtatatgtcccctatgatttcccttgtctttgacaaactcgaaattccttttcataacgaaaatcaaaactatcttttctctatgctctgaagcttgcctgaagatttacaaatggaaataatgttagcacaacccaaatctgaagatatctggtataagtgtttagattctttaaggtaaaggtcaggactggaaaaatcagaatggattaaaagcagaaccagtgtaagcacaaagaccagcatctactcaatatgcaaagcagagattggcctcatattgacccttttatattatgaagccactaaaaatagaaataaatcctgatataactaaatgcatattattgacactagtgtttttgacacttggaatagatttttgtgttcatagtttcatgtattcctgtataactgctatttaaaacaccgaattcaaatacattgacccttaaggaacttaatgctttccagttcaaaaatagtaagccctaaataatttcatcaaattattttgcatttaaagcggtcatgtaagacctcaggagaaatacttgcttaatgtcatatatttaaatacagggcatttacatccaaactctaatttacatatgcttatgaaatataaaagagaacagcaagaaaatctgacagtaatataagatttgacccgaagaaacacaatcttattttcagtgagtaagctctaccatgtatagaggaatttaaaaatagccatttgcagatatattgaattatctgtcatctaataataataataacaacaaattcatcattagtgatgactagtgagtgtcattcaaggaaagatagcttgacattcaaatgttctacaacatgccacggattttttcttttaagagacaaggtcttttgaaaagtgtctgttcgtgtcctttgcccactttttaatagggttcttttttttttcttgtaaatttgtttaagttccttatagaccctggatattagacccttgttggatgcatagtttgcagaaattttctcccattctgtagtttgtctgtttactctattgatagtttcttttgctgtgaagaagctctttagttttattagatcccatttgtcaatttttgcttttgttgtaaatgcttttggcatctttgtcatgaaatatttgcctgtgcctatgtcccggaatggtatacatgcagccagcaattgtattaaaaaaagctttaacatcactgatcattagagaaacacaaaaatcaaaaccacagtgagataccatcttacaccagtcagaatggctattattaagaagtccaaaaaatagcagatgcaggcaaggttgtggataaaaaggaatgcttatacactgttggtggaagtgtaaattagttcaaccattgtggaagacagagtggcaattcctcaaagacctaaagacagaaataccatttgactcagcaaccccattactgtgtatatacccaaaggaatataaatcatactattataaagacacatgcacacgtatgttcattgcagctattcacaatagcaaagacatataatcaacttaaatgcccatcagtgatagactggctaaagaaaatgtgatgcatataaccacggaataccatgcagccataaaaaagaatgagattgtgttatttgcagggagatggatagagctggaggccattattcttagcatactaaggcatgaacagaaaactaaatactgcatgttctcacttataagtaggagctaaatgatgagattacatgaacacatagaggggaacaacacacaatggggcttttcagagggttgagggtgggaggagggagaagatcaggaaaaataactaatggatgctagacttaaaatccgggtgatgaaataatctgtaaaacaaacccctgtgacacaagtttagctgtgtaacaaacctacacttgtacccctgaacttcaaataaaaagtaataataataaaaagagatggggttttactgtgcactatgttgctcactcaggctagtctctaactcctgggcttaagcaatccttctcctttagcctccagagcagctggaactataggcatgtattatcatgatcccatggtaaaattttgtggagtgagattgggaagtaagttaatttgagaaaagaaacttcataaaagtgacatgtttggaaaaaaattataaaaaaagatagaggagcaaaaggaacataaatttaaaattcttcattgggctcctaatattcctttttgaaatacattttactgagcacatacttttatgtgcaaggtgctgttctaggcattaaaggatataatagcgacccaaactgacaataatccatcccatcaaggaatttgcattctagtgatttgtacttcctattatcaaaggcatatcatcagtgcttcagatatgtataaagaatgggagagtggggagtaaggtggaagataaagagaaagaggatagaacaggaagcagtgaagggtggaaaaattgtgaaacagaagtagattaatttctggggctatgtctgttgtgaaacctcctctgactccacttctacctgaggtatcctctcatgtaccctagtaggtttgtctgttttcacctcggcattcatcatcccactcttttccccgtgtgttttcttgtctttctccccagttgactctgatctactgagtcgttgatctttgtatcacagagtcaatcatggtgcctggcacacagtagatgctctaatctatattatttgttcaacaaatagtaattgcaattatctgacaaagtattcagttattatggagaaatatgcatctatgtatttgaccatctgcattacactggaaacggaaatggacttttttattgatacataatttccctttgaatttttgaagaccaaaataccagtggcagagagaagagatggtgtgagggagaggattttagctgccctacttccctcatataaatgtctatcagctcttcctcaatcacacacacacacacacacacacacacacacacacaagttgtattaaaatacaatatgaaattagcttcaaaagagtttcataggactttcttccaatcagatttccattctaacacagtcgttccagagctgataccatccaattactatccatttgaaataatttcaaatcttaggaacaccttaatatatcttttaattatttaataattttataaaaacacaatatgcaaaacaaaagtccaacctgaacctcttactttgtgggccttactggactaagggaaatccataactttgatgattgcaggtaaaggtatacttgaattagtgtctggagaactctcccacctcctcaagtttccatggcagtacagttttaagttctctctcaaccctgtgcagaagatccgggatgtgggagtaaaagggtgagcatcagtgtgtgcttagttcagttaaaattaaattccaagagttccctagagcacttttatatcagcttgacccaacattacctctggtatttgcttcagcaaatcatttaaaacacataactgttgtctttgttttcaagtttatagtcagagtggtttgaaaactcttggcgcctaacataaaagccagaaataaatacggaacatattaacactgaatataggttgcgatgaatcacagtttgtcagctttcaagtattacaattatctacctaaaaataccctactgtactcagtcaccctccctagctgtttaccctgctcgtcactgtaacttctaatgctgttacacgtttgtttttaggttgtaatgttagcagccctcaatattttatacttaacagttatcttttaattaccatatgtttatcttttgagataaatacagtagttcactaatcacactaattgtaggtgggcattgctagcattactgagatttatagattagtcattgtgggaaggaaggggaatcaatattagcgggattatattagtgctggctaattgaagaggaaaaaaggttaatgcagactttgatcttggactcagtctcctaggaataactctcaaatgacaccaaattcctgctgtttaatattaaatatctgaagcacacctgtgcgattattggagcgctctgccattattatgtttatttataaatgcccctgaattgtatttgtagaaaaaccaccttttcttctagaattaatgtgtatttgtgttcatgtgtgcatgtatgttcacctgtaacaatagaggtgagataaaattcagaattaaaaccctaaaattgaactatttttaacattgagaccagtgataaagtaagcaagttgaataaaaagacaaattaagtaagtgcagtttgagtggggaaaaaatatacagagagaaagcatcatcctaaggtagccagatggatcggtttccttggagctttccttgcagttctgagtgagacaaaaattaacctaaagaattaaccctttcctctcacttctcagaatactaagttaggtgttatattgaaaactcttgaattcaaacagagatgaagagtcaatattttatcaagtcatatggattgatgaggcaaaaggatttcctttccaccccatatctcattctgtaagcaagacaagataatttatgtatcaattaatagtatgtcagacacaatcttacctgatttaagtgttatgaagaatttttctgatgccatatattttcacatatgtgttgttttcattttgataagaaaaaaacaaaaaatttataatcacataattaaaatctgttaaaaatgttttaaaaagcatagggttttcttaagcaaatgtggtttggtgtagatgtggtagctgggcaaattaaaggaacaaaatagcttgttcttgcttttataaatattttccctctggcccgtttgctgttggcctctcttcctatttattgctctgtctgtcctgtctggactcagacccatcctgatatgctcttaaaaatatgtacaaatacgagttgtaactgagggctgcaggaactggctggactttctcctgtgctgtcaaagccatgactaaaagtttaaagtagattctgcgaacacaatttcaaaatctccctctcatgatttctgctgttctctctaaaatattatggacatagaaattttcctgaagtaatctttcaccgggagcaccaaagaatcacaactgaaagtatgaactattgaaaaattaatcatggctgtttatgctggaagctgaccaggtaacttctccagttcatatctcagaaagaaaatactgagaaatcccagtgactgtcctttgggcgctgatagaacacagttttaagcttgaagaaaaggaaggtgtgggccgggcgcggtggctcacgcctgtaatcccagcactttgggaagccgaggcgggcggatcacgaggtcaggagatcgagaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaagaaaagaaaaggaaggtgtgagggatggttataagggactgatgactgtaaagtacgagtaaaagggttctgcacctgtggattagttaaccagctgcctccctacaccacctaaagcaaaactaatcaacaaaaaaccaataaaatgcccacacaaagcagaatgtttagttcagttcttccctttggaaatagtaatttagaacaatgaacagtgttatcttgagaaagaaaataaagcttcctctatggaacatgccctagatttttgtgtttttatgttggaattaagcacacaaatagctgagtttagagaatgatctggtagatgagaggagtcttagaagattgtttttggctttggggaataaaatgccttctggtgactactctttatccagtgccgcatccgttttgtaaaactgattctgaataaggaatctctgtaaagcccacttttgctaaagggggttgtgtgtacagtagaattagaagtcactccccacgtccttttacagttctcttaaccatcagctgaacagtggtgtagtcaaatggctgacagtcagggaagactaaagtattagctttctatcactgtccagttctgctgtaaaactctgggaatctggaggagcttgagaagaggcatcactctctggcttacctctttggtctcaccagctgatggtcggtgctttccttttagccagtgtaactattggcttttctgcttcaacttacctgtgtaggcttaacagaggcaagcacttttcagagtcaaactaatggggaacagtgtcttagtccattttctgctgttatgccagattgccacagaataggtaatttataaagaatagaaatgtatttggcttatagttctgtagatggaaattttttttaatttaattaattgattttttgaggtagagtcttactgtgtcacccaggctagagtgcactggtgcaatcacagctcactgtggcctcaacctcccaggctcaagcgattctcccaccttagaatcctgagtaactgaaaccacaggtgcacgcccagctaatttttgtattttttatagagacagggttttgcaacgtttcccaggctggtttcaaactcctgggctcaagcagtctgccttcctgggcctcccaaagtgctgggattacagtgatgaaccaccacacctggccagaggtgggaattttaagattaagggccacagctggtgagggtctttttgctgcatcataacatgacagaaggcatcacatggtgagagagggtgagagtacatgagacagagagggaaaatgggggctgaactcctgtgataatggcatcagtccattcatgaggacagagcctaatcacctcttaaaggtcccacctcttaatattgtttcaatgtcagttatatttcaacataaattatgaagaggacagttaaatcatagaattctaccctgggtcccctaaactcatgtacttctcacatacaaaatatattcattccattccattagcctctagaatcttaactcattccagcttcaactctaaagtccaaaatccggagtctcatctgaataaaataggggtgagactcaaggcatgattcgtcctgaggcaaatttcctctagctgtgaaatcagacatgttgtctacttccaaaatacaatggtgagacagccacaggataaacattctcattccaaaagggagatacaggcaagaataaaggagtaactggtcccaagtaagtcgaaaacccaagagtgtaaacaaaatttagtcttaaagctggagaataatctcctttgactccatgtcccacatccaggtcacactgagggggtaggttggagttgtgcctgcagtcttcccatgctagagttgcatgctggtggtggatgtactgttctagggtctctgaggtggccttgctttcatggctccactaaacattgcccttgtggggactctgtggcagctctgacttcacatgtgcacttggcattgccctagtaggggctctctgtcatggcctcaccccacaatagtttctgtccatgacattctttgacgtctatgtagacaacactatgcctacacaactgttgcattctgcatgcctgaaaaattagcaccacatggattccgttcatgtttatggcttgtatcttccagagtggcaggtcaagccacacctggacatgcatgagctgtggctggagtggccacagagcactgtgccagaattcagggagcagaaacctgaggtggctctggggagtgaacatggtgggtacgctgggcccaccccctgaaacattcctgccttcctacagctctggacctgtgatgggaggggcaaccttgaatgtctctgaaatgcttttagggtctttctcctattgtcttttgaaggcatagtacctggcttccttttatctatacttatctctatatcaaacagtcctttgatcacaccctcggtttgctctcctaaaaaacatcttttcactctttacatggtcaggctgtgaattttccaaatcttttcattctacttccttttaagttataaattctgtctttaagtcatttctttcctctcacatctcactgtatgcagttaaaagaagccacccagcagcctgaatgctgaatgttttgctgtttaggtatttcttctatcagatatcctaatttatctctcttaaattatgcactccataaattcctaggatgtggacacagttatgccaaattctttgcaactatataacaaagatggcctttactccagtttccaatatcttgttccttagtaccatctgcgatgtcataagaatggcctttgctttccatacttctatcaacattctgatcactcaagtaatctttaagaagttctagacttttcctacagctctcctctcctaagctctaaccaggatcaatcttcatgctctactcctggcaatacaggcttttggtagcccacttctccagtttcttccaatctgtacacatgaccctgttccaaagctgcttccacattttcagatatttgttatagcaacaagccctcttccagtaccaattttctcttttactctgttttctgcagctattacagactatcacagactagataatttattaaaaatagaggtatatttgcctcacaattctggaggctgggaatttcaagatggaggggctgcatctggttaagggccttcctgctgcaacttaacactgtggaaggcaacaaatggtagagaaagtgagagtgcaagagacaaagagggataaaggggaccaaactccattataattgatctaatttattcatgaaggcagagctttcatgacctaataaccgcttaaagtttccacctcttaatactgttacaatggcagttaagttaccatatgagttttggaggagacattcaaacagtggttaatattactaactctaatttggcctcctgagataaataactcaatttgaaataaccaaatagtggtaaatggagctactgggcctggagttaaatacctgctctgttactaagtatctgtgtgaacttagacaaattaataaagttctctgatttttaatttccttatctgaatgatgataatcaccatattcacctcactgtgttgctatgaacattaaataagaccattgtcatgaaggatggtgtctgttccttaataactactcaagttataatgatcattcttattaggaattacagtggtgtttggggctatgggatggcattttaactgagattctggaattctttcttccaatcacatccatatttctgttcttgctcctttcacaagcattactatagtagcatatatccaaagatgaaataaaatattactgtactatcagctggcagaatttttcaaaatcacactggaaattctgctaaacacagggttcacacatggagtccagcaaaaatctaaactctctgcaaaaatttaaaccttaggatattactatatcaatatggttgcatggatggaagagtgaagaagaatgctgaactaccaatctcatggaatgggtcaaagagagtgcttttaaaagcacagtaaacttgcccacaagtaaagtgtggtctgtcaaagaaaaatgtactgtgcagagttaaatgggcaaggaagactttattcaagactattgcaataagggttaaaactattgcaataggggagagagattgaactgaattctgctaaaacaaaatgcagaaggattttcaagtgctagggtgagctcatggaaaagtaatggaagatttggcgaggtaagttggccaatgggattaggccatctgtgtttgataattggcacttaatggaagttaggtttccccattccacagagaagggagttaggggcactatcttctgttaagattacatttcaaagggatggctcccaggtccttgaaaaaagacatgttagggttgtgaaactggcaagaggctcagaagatttatgtctcaaaagggctgagaaaaagtttataattgcaaggtttttttttaagtaaatgctttgagaaatgggaagtcagggtctcatagtcaggaagaaacttgtcgaaaatttagtcaagttgaggagaaccttaaggctggcttgttcaggtctatgattttgacaaatataattcctttttccttatatcatgatgtatcaatgtagttttttttcacccgggcatatttagttcagtactcaccgaataaacctatgtaattgtccatttatcctttttatgaataaatatgtttttctaattataaaaataatttttattgtataaaagtattgtacctaaactaagagaaagaaaataaaatttacccactacttaaagataattactgtttgcattctgttggatttatctatcccatcttttgctagttatacacatttgttttacaaaagtggcaatcataattggaatatccattatcacctgcctttttacatagaagtgtgttataaatattgttctgttattgtttcacattccatgttttatttacatttctttacttgtccctcatttttgatgattgatgtagcaatttgattttattttttgctgtggtctaatatgcagggttttcttccccttcttatgccatcttctgagttctctcatcctttcttctgtttcttgctgcacagaagtcagccctttcctccacaatatctccagctggtggagctagccttttgctccatattatgtctgctttgaatctacttgtcacattcctacttactgcttctctgcccagattcttctgagtaaaacttggcttgaattgtctgcttggttttcgtgggacattatctttcagaactcatacattacagcttttgaccaggtgctacaccaatccagggcaagcctaggcttcgtgatctggaatagggggtccaggaccatacaggaaattaacagtcacttcccatcagtactcttctaatttgatgccagttttacaagactgtcttttctgccagttgacagcttgcctttgaaagaacaaatccttggtagatgtaggtgtaggcactgattggtcaaattatcttctttccctttctttctgggttttctagtactatgctttagaatgttgaggagtgacagtatgcaccaccatggtgccagagtggagactgagagcactttcttttattctgcagatcttcatggaattccttgtcacggccttaaacatagcatatggcaatcattgactccgtgtgtaaggccagtataggtaactccataactgctaaaactgagtcaggcaactaattctatgttcattgctgtgccattaatataagaattaaaaatgaactgcttaaatcctcccttgactagactccatagagaggaatcatttaggttgtaaatgacacctaaaattgatcactctaaatttagttaaatatttttagtagaggtcattttccttggtttatatagatattatacatatattctggcaattggaattttttatttggatgtcaaaatattcaaacatgtatagtaaaatactttgttatttttccacagcatattttatgtacattatatattatggttatagttttatgctacgtttaattgtaacatttgttaagcaacacagagatacaggtagctcttttagattcctggagggttttttgtttgttttttaaaaatgtataacctgttactatattatcagaagttacctggtattttgtaaagagatatcaaaagtgacaaaaaaattagctttgaatcaagaataaaaaaagaatatcacatataaaaattagatgcttataaattataattttttctgaatctctgaatatatgtgtttatccatggacaatttatctaaacatgcactaattttgagcactacttttaagtgaaaaatgtgtacaaatattaaatgtaaatttatataaatattaaaactaaccataagtatttaacgacttgtgctttaaaaagggaaaatgagtactaaaagggaaagacatgtattaagataagatgtaagtcaaaatatattataacttgtattttaaagagtcaagataccgtccagtttatttgaatatgttctcacataccatggttactactaaaatagtactggcatgtctttatgaaaagaaagaaaaaatatttttacctaccactgagttgtaaataattaattttcatttgtagcttgaactatttttaggtgacattgtaccctcaaattttaactataattttctaatttggttaccataatttctgactatgcttagctatttgaaacccattatactggtgatcaatcagaacaagattcctttgggaacaatttgttgatttctgttaattttaaggttgtctaggagggatgactttatatataatttcccactggattatcccaaacactttttgcccaaagactcatcattctgagtgggttagaatttgtgatttctgtgaaaaaatgttcaacatggatgaggaaccagtcactctttgagaaggacaaactttcctctttaatttgttgaatttttacctgtgcttaaatttagcactgctttaataatcagtaattctaatgatgcagtgattctgtacacatcaaaggaccggctgttagtgtgaatgcagcataatgcaagctggttactaaagggcagttaatatataataatataggcaataagcattttttcctttcaaaagcagcagttaattattataaatgtcaaaattgtagctgtcatagttattttgcttccaaatcatttcagcgtatcagctttccgatggcgtattcgaacactaaagttatgatccattctttgagtggaagccctcacatgtaaaattgccaatccaaagtctttaatggcttcagtctattaagtgataggaacttacaaactgataaacttaagttattctaatattattcaacagatacaaattgtttagttagaaattttaacgtgtaatataggaaatcaaattcctttaaaactttttaattaatcatttttacttaattttcttgaaacatatcatgcctacataaaatataatgcctaaaatagatgatgcctgtcaaactctttaaacattacatctattacttggtaaaatactattatggttaatgtaaaatctaagatgaattaggtattattttcatcttcataatgcgtcttattacaaaaattaactaatgagatgtttagtatttaaaaataggctacatacatgtatgtgattctgtattgcttaagacttgtaagtgaatgctgtgtgcataattttgagaagattgttagaaaatagatgtataagcatagaattgtgtagagaagaagaggcacccctttctcttgaggttgtagcctcctacctggggcacagtgttgggagtggaggacaagccggcacttgtcggggcataacgtgcaaccattctgggaagctttgcttaactctgatgtgagagagggattgaaggctatgttgaggaagatggagtaatattagaaaatgtacagttggtgtgaagtgggtgttagagagaagagaaagggaagttgccatcctggtgtgaggcagaaaagtagtgagaccattgagaagtgagagaaaataatgggaaataaggctggagaatttttatgaaaaacaggctaaagatttcataacattatcaataaaatccatttgtaacattggtgtgtggactttatctcgtgatctacatagaaatcatgtgagatgtcggccgaagagtactcaactaaaatattacaatgtatgcactggcattcagatcatacattgatatttatctagattatagaaaaagctcttttttgacaatgtaccactgactttcaatgaattatttagacattgcgttgttatcttaaaggtagtaacaggggtctagatagtaacagaggtggtaaagggaagggtcctgcagatttggccccatacagaaaagtataacatctatgttttcctgagttactatgtgcaaactttcaagacctctatctaaattatctcctgtactagtagggttctagtaggaaagagatggcatggaaaaagtggtaatttggacagagtttaataaaaagactagctacaaaaatgtgggcagcacttacgacaagcagcaaaagatggtgaagtaattcagagccagtaacagcagaggactgtgcctccccagtcctgaaagaataaggagaaagaattctgaaagacagaaagacagctatggggaaaaaaagagatattgagggttgcagctctcagtaaagggacacagcactggagggacatacacatggatatgatctaaaaggcagggtgctgtggggataaatacctcatccagctcactcttcaccttctagtttgcctgtgtgtccctttcattggcaagaccaatccagagctagagggaaggaattctattgacagtacaaataaataagcctcccaggcctcagagtattgaatacatgaacacaataaagatcatgtatgacaagcccatagctaacatcatactcaccagtgaaaagttgaaaccttttttcctaagatcagaaacaagacaaggatgcccactcacaccacttctattcaacataatactggatgccctagccagagcaattaagcaaaagaaagaaagaaaaggtatccaaattggaaaggaagaagttaaattgtctttgtttgcagatgatgtaatcttttttttttttttggagatggagtttcactcttgtcgcccaggctggagtgcagtggcatgatctcaactcactgcaacctccgcttcctgggttcaagcgattctcctgcctcagcctcccaagtagctgagattacaggtacctgccactacgctcagctaatttttgtattttttagtggagatggggtttcagaaaaccttaaatattccaccaaaaaactgtttgaactgatgaatgaattgagtagagttacctgatacaaaagcaaaatccaaaagagaaatcaagaaaataatccgatctacacttgcttcaaaaaataaaataaaatactgtggaataaatttaaccaagaaggtgaaagatctatacacttaaaattataaagcattaatctatgaaattgaagaaaacacaaataaatggaaagatacctgtgttcatgggttggaatgatttacagattcaatgcaatccctatcaaaattccaatgacattttttaagtaaacagaaaaatacaattctaaaatccatatgaaaccacaaaagaccctgactagccaaagcaatcttgaacaagaagaacaaagctggggccatcacactatctaatttgaaaatttaccacaaaactgtagtaatcaaaacagcatagtgctggcataaaaacaaacatgtagatcaatggaacagaataaagagcatggaaataaattcatgcatttatggtcaatttgtctttgacaaagatgctaagaacacacaatggggaaaaggcagtttcttcaataaatggtgctgggaaacctagatatccacttgaagaagaaagaaattaaaccctcatttcacaccatatacaaaaatcaactcaaaatgaattaaacacttaaatgtaagacctgaaactctaaaactattacaagaaaaacttagaggaaaagctctgtgacattggcctgggaaaataatttttgggtatgaccccaaaagtataggcaacgaaagcaaaaaaaaaatagacaagtgggatgatatcaagctaaaaatcttctgcacagccaagagaacaataaacagaatgaggagacaacctagggttttagagaatatatttgcaaaatgtacatctgataagaggttagtatccaaaacacaaaaggaactcaaacaactcagtagcaaaaagataaataacctgattaaaaaatggacaaaagacctaaacaaacatttctcaaaagaagacataccactggccatcggatatgtgaaaaagtgctcaacatcactaattctcagaaaaatgcaaattaaaaccacagtgagatatcactttacaccgttaaaatggctaatataaaaaagatgaatggtaacaagtgttggcaaggatatagagaaaagggaacccttttctctccagcaatgccactattggatatatatatccaaaaaatatgaaatcagtttggtgaatatatatctgtactcccatgttcattgaaacattattcacaatagccaagatatagaatcaacctctgtacatgaacagatcaatggataaagaaaaagtggtatatatacataatggaatactgttcaaccttataaaagaaaatcctgtcatttttgacaacatagttcaacctaaagaacattatgctaattgaaataagccaggtacaaaaagacaaataccgcatgatttcacttatatgtggagtgtaaaagtcaaactcagaaacaaagaataaaatggtgattatcagaagttggggtgagtgagaggattggggagatgttggtcaaatgacataacatttcatttagataggagcaataagtttaagagatttatattacatcatgatggctgccgttaataacaatatattgtataatttaatattgctaaaagtagattttaaatgttcttgccacaagaaaacaataagtattttaggaaaggcatatagtttagccactgcatagtgtatacatatatgaaatatgttacaaaccataaacatgtacaatttatacttgtcaattaaaaataaaattaacaaaatacaaacatatacatacacatatatattatatatgaatgtactatatatcatagtagatatgtttgtacaggcactctaaatttcttagcagacaggcattatatttcataactagttttagtttaacaagtacctagcacactaatctctcattaaattcttactaaataattataggtgaatatattcaaggtggataaatgaatgtgttcaagatactgaagtaatgggattaatttcatgagacatcaattgaaatcaatattattagcaaagagtcacaggttgtgtatcttatacaccatacagtgaaaatattcatttagttcatttctccagcatccatcaaacaggcctcatacatattactaaatgctgaggatatcagatgagttgttctgatcattagtgttgttcatcagatatttttggttttctttcttctgtgcacttgctaggattatgcttctccaatctcttaaattaggcatgatcatgcaacttactctgaccaacaaaatataaaaataagtaacattgaatatttcttaatagaagcacttaggaggcagtgttcagtttgccacctttctctcccttttgccctggcaatttatgatgacactaattgtaaagccttcttgaatgtgaacagtatagaacagagcccctgcctacctgacatggcacatgctacatggctttctgatgatacacaatttctcctctgtaaattagagacaataagaccaacctcataaagatgttgtgaagatttaatgctcttaacaaagtgattggcacataatgagtgtgaaaaacatgatttttataattattactagtaatactacataggccataataatttcattgatggagaggataataggttgggcactggggatgggcacagctaacctagaggagaaggcaggaaagaacactacaggctgaagtgacctgcgaactcctctgggctgtcagaacagggatgccctggggaagtgtaaagattctgtaatgctgacctttccaattcatatccccttatgttttcagtctttaaagattaaggagaatctaagtttactcatcaaacctataaatagagtgagggcataagctaattcaggcctgcaaagcagaggcaagggacaattagcagggcttcaagtacaaccatcatatgtaaaggctgccttgtccctggtgattaaagtacatttcaaactctgctgaatacctttttgtagtatgagaatttgtccatctaagtgcttatgggtgtatttttatgcctttcaatgcaatatgctagtgcagattcaggatatattgaaataggaatgaaagaatgaacataacttgcaactctgatctcagtaccctatattaggatgtataatttttggggacatcacctcctaaattcctggttctgggcatagcaagttaacaagaaaggtcctctaaattatatgattatctttttctcttctttctccaacaatggggagaaaaaagagtgagagagaacaactgctctattcgccatgcatcattaaatacattttttgcaagcaaccaccaattttcttttacacactgaagtaggctatgactgaggctatagaccacctcagataatgtttcaaatttgtcacttgttttgtgggcaaagtcgcccctctaaacttcagttttctcacctgaaaatgaagaataagtataccctcttcacagacatataggaaaaatgaaatgagctagccatgctgataatctccgtaaatgttaaacttacttaactcaaatggctatgagttgtcaagtcatcatgtggtattacatacagtgtttaattataagatctccatttaacagtcaaggacagagtaactggaattcttttacactgctggcaaaaatctaaaatgttatagccattttggagaacagtttgacagtttcttataaattaacatacacttgccatatgatccaacagttccactcctaggtatttactagggagaaatgaaaatatatgccttcacaaagacatggcttcaatattcataacaggtttattcataatagacaaaagctagacacaataaaatggccatcacctggtaaatgaataaacaagtcatggtaaatccataaggtagagcactactcacaaagaaaaaggaaccaactactgatacatgcaaatgcaaataaatctcaaaaaattatgctaagtgaaagaagtcagacaaaaaactacatattagattatttcatttacttgacactctagaaagggcaacattatagagatgaaacagacatcattgattatcatggggtctaatgaggaaaggggaaggaggttgactacaagagatagtagagaagtcttttgggtgatacaagtgttcttgtttttactatggtgatggctacaggactgtgtatatttgttaaagcatctctaaccgtacacttaaaacaggtgaattttattgtatagattttaccttaatctgaaaaaaaaagcagttataatggaaacctctaggtagtaagaacaccagaaactagtcaagaattgcaacccagaaaataattccagaaaggagaaaaccagaacttggatattgagtgtttagcctccctgttcacagtagtagacactggacatttgagcctatcattaggatttggtgatagcaaactaagtcaagatgtgaattaaaagaacaacctttaggaaaccttcagttgcaaagctattagaataattttggaagtttcttctctaatttctgtatgtgtgtctgagaactaagatttgtccaaacatttcaagatttatttttaaaatagcttgtttccctccagaaacatttttttccgactgaggcagcttctacctttacagctagtttttaagtattatggtctgatgcatttttttccaaagtgaagaaataacatgactttctttttaaattgaaaaaaaggaaaactcaaaaggaagaatgcctgaagcatggcttttgtgcatgctggtttttcttatttacgtattttattgggctgccttgacaaagaaagccagcattttaagatgttataacattttagatgagaagacatatactgttaaatagctgtaaatcttggcatttaaattctttcttaaaatcagcatgcaaacatcaaatacactaatggtcagtccaaagttgtaaaattggaagacgtgataaatcaaaataagcacatatggaggttaagatgctgtttttatacttttttcccttttcttacctatgatggactgttcagattatgtttcctttagtggatggataacatggtaaatgaagacttgttttctttaattatttttctacctaaagcttgtatcaacttcaacttggttagctctttattgcgggaggttttgttttgttttttcttgttttcagaatcacctgatgctgacaacattgccatcactgtattaataatgacgacattcactcaactacattcttacattcaaccaaaaattttggagtgcctttctaatgtaacatttcaagtagagtaaaagaccattttttccacttttctttttctttttttttttttttgtgtgtgtgtgtgtgtgacagagtctccactctgtcacccaggcaggagtgcagtgatgcagtcatggctcactgcagccttgaccttctgggctcaaaggatcctcctgcctcagcctcctaagtagctaggtaggaccacagttgtgcaccaccacgcttagctaatttttttttttttttttaatagtgacagggtctttctgtgttgcccaagctggtctcgaactgttgggctcaagccatcccctgcctcaaatcccagcactctcccaaagtgctgggattataggcgtgagccaccatgcttggcctgtttacctaaagttttctactcagtcatgtggtaaaccaagcctcgaactcaagtcttttgactccttgccctgttgccctaccacacttgcctttctttataagataatatccctgctccctagtaaggtgaaaattggacaattgaatgtggatgtgaggttgtcatgctttctccacccaggtctcatggaatgaagtcagatgaagtgttaaaagacagtccagattggtggccctatgacagttccatcatgcatgggcaggcctgaccctgacttacaatgtctaatgtacagtgttatgtactcttaggtggagttgttgggaaacctacgtgggattatttatggaaccctaggaaaagccttgtgaatctccagcttacctcccactgctcccacttcccaccatcactctatgccaaaattctctagtaactctgtcatttgggtgaatgtatcaaagtgacctgctaaatatagtcattatctatattgaaaaaaaagttccagtatgtttattcagttgttcagcaaatatatattgagcacctattatgtgccagacaattttctaggaactagagatatagtaatgaataaaacaaagtcctgtctatcacagagactctaatcattctcattgatactactacaaattcacttctgaaatcgggaaattcgtgaggcccttgggaatctatattgaatgaggtaagtagctgatggaggaaggtggtgtcccctcagagagcagccctagggcaggttcctactgcgaaacaccaggaaaactggaacttgggcatcatgagaatatgctaggaagtttggatctgcaatgggaggaaacgtcttttttgaaatcacatagctggatatccccacagggctaagtaatgattctggagcagagaggagaaatatgaatctcagggcacagcgtttatttctcaggtggtctgtgggacagctggagggtccctgctgatctcagctggggttactcatgcttcctcaggttggctgggtggaagtcacctatgctaggcttggcaagtcctggccttcaagctgcagattgggctcagatttgttccatgtgtttcaggtttgtctcacagtaatggcagtcaagaaggcaagctccaatgcagaagcgcatctttttttttttttttcattttattttttgagacagagtctcactttgtcacccaggctggactgcattggtgcgatctcggctcacttcaacctctgcctcctgggttcaagcgattatccttcctcagcctcccaaggagctggaattaacaggtgcacaccaccacacccagctaatgttttatatttttagtagagactggttttccctatgttagccaggctggtcttgaactcctgacctcaagccatccacccgcgttaacttcccaaagttctggaattacaggtgtgagccacctcgcccggtcaaggagcacatcttaagccctttcttgtgttatttgctaacatcccattgtccaaggcaagtcacatggcaaggcccagttcacatggtgggaaataaatacaccttggctactgtgagtttaaagcaaatggcatagctaaacttggtaacaaagaagtgggacggtggggtggaggtaaaaatgagtcaatatttttgaacaatactttaagcaggggggaaaaagcattaagtgtagagaagtagatccattgatgtaaattgtttttgaaagcatgttaacattctgacttatttctcattatttttccattatttcatatcctcccattaccactgtactttccctttcagaattagtttctttcctaaatataaaaacatacttacctattagaataacagtacattgaaatagcttaatttagtgacttccagctgactctccaggattctcaaaccacttagggctgagttttcaatgaggaagaaagccaaagcaaatgcacctgctcttctgttgagaccactgagttgcaacagctctaataaggatgcgagaattacagctctgagactattttcatgcttctccccagccaaacagactgaattaaaggactgttgctttttacctttagggtcttaaactatctatgcctttagaagagttaaacagggttagaacatagtgatggacaacttccacttatttatctaatttttaaagtaataggagtagatgagactttcatgacttttttttgcctttttaggtatgtttctaattaaaataatttttaaagcctttggtatgagatgttgctgttagaaactgcagctaatgcccatgatttgttagaaaataaatgtccttttccttatcgtaagatatatgatataagacatattttggttctacagagaatgtagataaagcctttcaaaatatcaattttaggattttcccagcaataaatcttagtataatcttaagtaatattttctgagaaatactgaatgcaaatttacctctcaaatcatctacataacaggtaatgcttttttaagatacagtagcatggtttggacttttcctgaactctgctttaaagctcctttaagattttcatgtatatgaaacaattcatcttgatgcaaaattttcctacataaacctgtttcttagctttaactgtatttacatttatccttctgattccaacatggtaaaaagaagtaaattattttctttgaaaaagtgtattaattatttgacttccgtagttgtttattggagtgattgctttccaaagcacattaaattatattctactggcatgaaggatgacatatccttaaattagtagaattttgacgttttttagtctattagtaatttttcttttttttttttacttctttattgagatataacttacgtaaagtaaaatccacagatctgaagttcttagtctgatgagtgttcacagttgcatcagctgtgttaccacaactcaaaccaagctataaaacatcacaataccactcctcagcacacacacacacacacacacactccacacacacacacacacacacacctagaggtgactactttctgattcttgtcatcattgattactttttacctattcttaggctttataaaaattgaattatatagtaagaactcttgtgtctggcttctttgctctaaaaatatttgaaatacatccatatcattgcatgtgttaaaaatatattttattctatgaatatgccatgattttttttagttagttattctattgatggacacctagattatcactaattttaagctattatgaataagactactatgaatattctatggacattttttttttgtgagacagagtctcgctctgtcatccaggctggagtgcggtggcatgatctcagctcactgcaacctctgcctcccaggttcaagcgattctcctgcctcagcctcctgggtagctgggattacaggtgccagccatcatgcctggctaacttttgtatttttagtagaaacggggtttcaccatcttggccagggtggtctcgaactcctgacctcaggtgatcctcccatctcagcctcccaaactgctgggattacaggcatgagccaccgtgcccaacttatgaacattctggtacaaatcattttgtagacctatatttttatttctcttgggtaaatattgagaaatcaattcctaagtcataggataggttgctttgttactgatttatagtaattctttatgtattctggattcaagtcctatctgtgtacatatatgtaatgtatatgtatatgtacatatgcacctaattatatgtaatgtatatttaagatatgtaatgcaaatatttcctctgagtctaggagtgcatatttttaattttaatagtgtctttggggaaaattgttaagattttgataaagtttagtatttaaatttttattgttagggaaagatcagtaattcttaactacttagtgtcaaaactaaaagattacttctaaagtaagggggttattttgagttacatagcaacaaactatgggtgatttgaattgataaagacagtgtcacgtttactgtttcttgccaatgttttaattggctaatttactacttaatgttatatataagaggaaaaggtagaaaagtttttcaatgaggtaattatgtagtattagagacaatgtctcacaaaatttctctataggtaaaagaagatatagttatttgcctaaaaaatatatatatatatgaaatgtatgtatgaacagtagaaatgtttaatctgtaatatttccactctactgttactatgacatatgtagtcttcttactgcaaggattaaattttcccacgtatctaatttagaaaatgcaaaagtactttaggattttaagattgttgtattgttaggttttaatctttctctttctttctttctttccacaattctattttgcttctctcgacaggatttcacataaagccttaacataatataagttgaaacttacaaccaagaaaaaattgatattattaacatgtttactatgtaaacagagttattatagtaaactttaagttttgctctgagcttcctttgatccctgaccaaaacaaatcatgataaacatttgtaatataagaggaatatcacttttcttggtgttagattttgaaaaaattaatgtggagtttattagaatggaatcaaactgatgcagtagtcagtgacttcaccactattttacagtaaagacaggaaccgacttcatacagctatttcttgtatcgacctctcataaaagctgagggtataacattaaaatggagttcatggaaagctcttttatgaccgactatgataacgtggtccaagttatggagtcctcttgtggtttagcttcctctaaggaaaggactcgtttcatctcgttgcgcgaatgaatggctcattcttcaacagcagttcccaaacacctgcttgaacacattagagtcacccaggagagctaataatgtgaaaatttctgagcccaaatcccagctctgtaggtctgagctgggacccaaagaagtctttgctttaaaagcttctttagatatttctgatatatagccaggtttggaagccattcatagataatttgccctgaatttcatttctgtccgttggcctttgtatatggcctggttattagagaagtttgtaaaatctgcatttgtattggacctagagtaaaaatattgcacaacaaagggagtcaacttttaagaaagttattaaccaaaaacttctctagagtaattaggtctctggaatatatgcctagtgagagatagttgatggactggtgaaaaacagaagtgaagagaggataaaggggaaacaggaccactgaatttaaatttatgcagagatggtcttttagaaaagcagcaaacttactctatgcagcttttcaagagcaaagttataggagtgatgtgtgaaagttacataaaggcagatttcagtaaacatttttaaaataatattccaatagtaaggaatttttaacaatagagttgctatcccaaggctgatgaattctctgtagttttaggtttgcctgcagtagaagcatgaatgctaatgaacaagttaatgactttgacaaaagtggtgacaaatttcagtcttagagtttgaaaccctctgatgtttttctatgtacatgaatctataaataagtacatgcaaagtaaataccagggttaattagaactctggaagtgacacactgaagagcaaggtgaatattagttatatgtgataatataattaaaattattttacaaccctcaagaacactaaatgacatgacagtgtatagacatattaaaagtataataaactaaatttttagccgataaaataaatatattttaaatgacattttaggagaaaaagagtcagcctttattatagtattaattcaagattcctatgcttgatcttgttgtttttatctgtatttggatataattaaattttaattaaaaattaatttaagcaacttcaaggaaataaaatggtttagtaataaaataagagttgagcttgtgaatctaatgctatggcaacttatacagggcagagctgtataaaggctttatcaagatgttgttatttaaccttcttaccacatagagttgctttgaggatcaaatgagttaatgcatataaagagcttaaacgagtccctatcatagtgcttaataaatctaagttattattattgctactattattgatgaatagagtgacttgtttttggttggtgatcataacatttgtcatggtacgtggcacagagcaggtttcctgtatttgttcattgattacatccaatcactatgtaaagattcgatgtcataatcatcagggtttcccagtgaagctgtggaacacactaccatttcatatatttccaatgtagacatttcttgaactttttcccagtagttggattgttgctattaaacaaattctcttatgcctatataagaacgtgtgcttcctgaagaagttggtggtggataaatgagagtactcagtctgaaattatttctggagttcattacatttgagttttgaaaggactaaaaattaaaggaatgggagaagtggtcaggtaatttgaggtaagaaaagtaggatacggaatggagatcaaagtgacaaaatgatgttctaaaactgtgatgtagatttacctgacttaggaaataagatataataggaattgtgaatttttggtagatacagatttaatacatgacaggtaatgggaggtgaagtctggaaatgacagttcaggaataattagctcaggtgaggccataaaaatgacagccctatcaggtcaagggggaagcagatgtcttagagcatgttcacctttgtcagtgaggagtaagaaatcctgtttgctagattatcttttcaaatgccatactattcatccatttttccctaaatgtttgttcatatttccatcaatttggatgaaggggatgaaaaagttatttacaagatttatttgcttttctcattctacatgcaaaagatagacaaagaagcaatcatattccagtattaaagttgccatgtaagtgtcaaattgatttgatttcctttttttggtcatattttaggaaaaagaggcctgtgacctcttgacaaaataaagaaatattcattcacaatagaaaatgaaaggtgtatatttctcatgtggcactttaatatttttacaaaagtaaaagcccaggtaataacacattttcatatctcattggctccagtttttctctaactttctaggcaggtgaatcagttgaaaaaatagttacaattaattgaaagtagtgcctgaaatagttcattaatgcttttccaagttccattttcccattttattttagctatttaaaatccacttaaatcccaccaaggaaccattgtgggacctctcagtagatatttattcagctattgggctcccagatgagggaggaaaatgaatgctttgtggggaaaagacatacttacatacatagaagtatctaaaaacattattcaaagagctgtggttttgtgatacaaatagaaaacagaaaactcatagttgtaaaatagctctggcaattatccttacaaatggcatcaatttccccctctgctaccaaatttcatttttttatcctttttttttttaaagtgtggacaaccattatctgataactatctcttactgttttacaacgttgcaatatgggaaggggatgtgaattaaagactaatgcttacaactcgaaatattctattgtaattttgtggctcctgctacatcttgaatgataatgaaataatttatttgctcaacacaaaatacttcacagatatcaggtaattttgaaatgatgaactgtgcttctaagaagaaactatggtatttcacaaataaattttgtaatttgggtgacattatcctttttaaactcacaaagcaccagtcataatatatgatatgtgactatgtgacatgaccaaaagcatgtgggattcggagcatggttccaggcccactgtaggtgccagaaatcttagctggtattattaactgttgttttcctgttttgttgtttattgcttttcatatctaaataggtttacatttcttgacattcatcttgttttactgaatttattttttaagttaatcaagaccatttttagttatttgcttctctttgagagagttaatatacctgtttaagttgatgttattgcctactaaacaatctctcacctctctctcaatgaagtcggtgattgtttcttatgatggagagactacacacagcctggcttgggacaaagccagcaggtgagactagtggttttcaatggggcacataagttagctgtgaggggtgctggaattttttactagtagaaatggaaatactaaaagctataaacaattttatctttaagataacctatgttagttccaagattattcctgtaatactgtcattttcactttttgatcaatatgctttctttagtggaaaataaaatgactgggacttttgtttatacaactaaagcccatgatgatgtttcacacagaagcaccttctgtcatgggtcgtggaacaaaacaggctgaatctgtggatccagactatgtttcctaccttgctggaaatattagatgtccttgtagtttttctcatgtcctctctaattactgtagattgtcattcccaaattagttttctttttttaaaaaaactcactctaaatctaaaagactaacccttctaagcaggcttcagatgtgtttacctaaatattcaagtagacatgggttagtgagaaagaaagagagttagctagagttagaagcctggcagagtctgccctacccaggcctacccaagagcgcttcctgtagagaagctgggtactcaagaagaagtgaaaaaaaaattttttttttgcacccaacaagccaaagaggaaactgccaatttcttcctgcagaagacatagtgaccccactaaatagtgaaaacataactattagtgaatgataggtggaaagagagagccctctcagatgtctcccttcttccccacctctggcacaggtacaggtgggaaagaagtattgaggcaaagtttctgcctctaggaactgagttagaaatacgtgaagaggtagagaaataattttcattctctaaacctttccaaaatgaatctaatgcaggattgtcctgcatggatctttctggaagaaaatggagatggccattatggtcaaatgaaaggtgacattttgagaaataatcccttatgtgtttatttcatgtaatctgcctttacctcctcagcaactttgtttcgtcactaaactcttctcctcttctctccgtcttccccttcctcaccctaccgcttgcttccacttccccttctctcctctctttctgtatctttaacttctccctttcccatgggtaattactcacctagatttgtacccataagtaaaaaagaccatcttcccttcattataccctcttttctcagtacagctttcatctatgtttgtagcaattatcttcattttctctttattttcacatcaccctatttctcttcagcccactgcagttccacttgagcttcacctctttctccttctggagagttcaaagcatgatttcagacctcatcttatttgatacctccctctgatacactgactattgcttcctcttctagaaattccttacttctcagtggataggttttgttttgttttgttttgttttgttatgttatcatatggaatgaacaggttttcctttgcaggtttagtggcagaaaatttctggcattctaagtttttcaaaagttgtgttggatttgcaggcagcacacggtttttggagaatgaatgcaggttagtaagtagaaaataaaagcaaatgggagaatgaatatgtagggaatgatggcagatataaatccataagtaagtaaagtaagtattacattttaagaattgctgaatggagaaataaactgattgtgttaacagaaaataatagcttgagtaaaaagaggttaattggacatgttgccaaaatcttggagacaatatgagaaacttatagaatcaagcctgtttttattctggagatctaaaggatgataaatggggtagacttcaatgattaagaagaccagagactttactttttacctattattttcttttcttatcagtctttgaaaaaatggatttccaaaacttaaaatctcttattaatctttgtagtgaatctttagtttattatcacttttattttagactcctagacttttcatattgttttgtgaataatttcctggcctcttcaggggaaggtcaacatttctcatcactcactgttaaaaatggccagctggtttcccttgccttataactaggaacctactgcacctatcttccatgccttttgaaagtaaaaattactctgataaactcccgaagcttccctgaatgcacactggtggtgtaacaggacctgatggtttgtgattagtacatctggctttttgaaatgtcaacattcacttttcccttatggtgtagaattttcactgttccatcttcatcttatggataacagtcatcacgttcatttgttcactgataattgacatgaatatacaaatttttatataaaatgagttttaaaataatattcttcagcttttcttcatttagaatttgtgaatggaaatgaggttgcttttaaagacctcctttaaaatatatatttgaagatatttttatcaattgcattctacttgtcttgcaaatgaatcttttgtcttttcacctttatttttttgtattatagaaaccctttctctacgtaccagataatttgtcttgcatttcacatttcatagtattccagtattgccattggtcttaaggtcactttacacttctagtttagccagctcaatattctgatgtcaccattgttctgcttttatgtaatatttcgtgaatatggtctggtaatactagaataatgtttaaagaacattgaattatgtaggatgatttgaatactttcatcaatatacctatatcaggaaatcaatgatattgaaacacgtctgaggttgctggactctgtaacttcacagttgatgtttatcagtttccattcatcttttaagtattaaagacagagggctgcctggaatggtggaaaggacattagttttaataccaaaccaaccttgattaaaatcctgacttcttaaggtatgaacatttgccatttatcattggaaaaataatttaacctcttagatccatactttcttcatcggccaagtaggagaatcatatgccccggcagggtggtaagaagaatacgtgagatatgctgtgagtattttggtacatgataggtattaaatatgtagaagttcttcttattttcctgctctctttagaaaaaatcagaaaaagaggattaattttctctttactattaagaaatttccccatatttaattactttaatgtcttatttgataaaatattgatacatcagatgttaaatagtatttcactggttcaaagcagtaattggatattaaagagtcctttccactaaataggtcatattctgtgaaatactctttttcttgtgcagaaagagagtgaacgttactcaaaccatatgaacacaaatttagtgaagttaatcaaatcataaaactttttggttatttatttttattttataaatattttatagaaacttgctataatatgacaaaaactattacctagaatctgttttaaatcactgtgttttaccatgttaaattagttactgaagcttgaaatctatagattttcattctttttatcttctttattcatttaacaaatatgtggtgagttgctattacatgtaagacactgttctaggctcttagcatatgtcagtgatccaaacagacaaagatctctgatcttgagtagttcgtatttcagcagtaggagacagtatatctcagaaaacagtagagcaacgtgaagggtgcatggaaatatctggatgtggtgaggggagcagattgtagtagtaagtaggataattagggtaggaaccatcaaaaactcgacaattgagcaaagactttaaagaagtaaggggtttagtcataccagtattgggaagagcattccacacagcaggaaaggttggtgcagagatttcaaggcaggaaggtagatggagggattagtgatgggagtcctgatgctatcctaaggactctggcacttccttgtgagtaaagtagggaactattgggtagaggtggcaggacctgatttatctttcaaaagagtcactctggctgttgtgttgagaatagactccaggaggagaacaatagtaaatgctgggtgaccagttaaaaatctatggtgagaattcaaatgaaagacaatattggctcaggacagggtggcaatagtggaggggctgataagtggtcaaattctacataaatttagaaaatacgtccagtctggtattaggacacaggatgtgagagaaaacaaggagtcaagtctaaagattttcacttgaactgctggagaaatgtagttatgatcagccacggtggagatggttgctggagaatcaggtttaggggaaaaaaaaaatgaaaagttctattttggaaatgctgattttgagaggtctgttaaatacccaagtaaaaatgttgaggaggcagttagatgttagagttaagaagaaagaatcaggtaggaaataggaatgttgcatgtatttggggtactttatggttaatgtcatgttgaagaatggcatgaagcactgaatggggggtgtagaaggaaaggtggccagctacagagcccctgaagtctcttcttgtctgtttctggttacttttaatcagtgatcagcaaatcagaaaattgtatatttgaaaaacatttcattttgtcaacctcatattatcttaactgctcctaaggtctcttaggaccaatgtggaccctacaataacacttgggaagtagacacaaacacatgtatttccccaacactatttggagataattgtctccatttatgataggaaaattcaaaaaccgtaacattaagaacagaaatgtaaatgtcctatagtctactatttggccgcttcctgcacagtaactagtttcctgacattaaagataaaaccatttaaagttcaaattcagataaagtttcacataaaatagtggtggtttttttttgggagggagggtagaaggtagtgattgcaggcaccaaaatggaaagtcaaaagagagaaagtaattatgtaaattgtgtttcttgaaggcatttagaatttttaattcacatactcttaagtatctgaaagcacatttagttcctgtttggagagatgaaagccttgccatagcttcatctgcaggcttgtggcaatgttagtttctcccgtgtgtacgtgcactgaagagtggaagtggctgagtgggcagttggcaaccattcatcgcattgattgcagtcattcataaaacccagcagcgctgagggcggagtcaggaggagcattcccctgaggcggttgcagaatgtcttatttgcataaatcttcagtgatgcttcagtgatgagggaatgctcacatgcagttagaagactgtcgaagagccccaatctgataaatctgagtaattaaagactttgcaaaaaataagaggtcaaactctttgaattcctagtccttcaatccgtggtaattctgggaagtcagcattgtggcagcttttgtggtctccttatgtcgggctgaaggagtgaattacagagacagaccccttaaaagctgcaacatactgaaatatcattgttgtgtctcttaaagtattaggggtttatattattataccaagtctaatgcataggagatagtggaaattgctgaggttacacagtttccatatgttaaaacggtcaaaactattaaggttttatccttccaaactatgatccaattcaattataattttaaagaaatggtaatccacacaagcaaacaaaaatcttgtgattagaagcccccgaaattgggtaaatgattagcaacctgaaacaattagtttcctcccttcaaaatgcagattcaatagctagctacattgctctattcttgaatatttgtcctgtggccaggatatatcttattatggaaaatgtgttgttttcctgttatattcagattaattctaaatatattgcttttgaatattaatgtgtttatttttattattcaataaaactttaaaattcaaaaaattgaatgaagtttttatcagaaagattctataacatacatagacagaaacagtatattaacttgaaattttaaaccaaaaccactgggacttgagattagacaagaattttcttacaaagatagggccctttttaaattgttattttgttttatttttttatttgagttggagtctaactctgtcgcccaggctggagtgcagtggcacgatctcagctcattgcaacctctgcctcccagtttaagcagttctcctgcctcagccttctgaatagctgggactacaggcataccccacacacccggctaaattttgtatttttttagtagagatggggtttcaccatgttggccagtctggtctcaaactcttgacctcaactgatccactggcctcagccttccgaagtgctggattacaggcgtgagccaccatgcccagcagatagggccttttagtcagaaaaaaaaatgtttgcttacaaacctatctttagtgttgcttaataccttatatttgttagaaaatagttacttcagcacatatttttaaaaactcttaagtagtagatttgttttatttgaaagctttgtatgaatacctaagacttgaggggaaaaaaagagatgaattaagatttctcatagatttaattctttagaatttttccaagttggtgatattccagatattttcacaaatcagtgcatgtagattaaaaatgctgcggccaggcgcagtggctcacgcctgtagtcccagcactttgggaggccaaggcgggtggatcacgaggtcaggagatcgagaccatcctggctaacatggtgaaaccccgtctctactaaaaatacaaaaaattaaccaggcgtggtggtgggcgcctgtagtcccagctactcaggaggctgaggcaggagaatgacgtgaacctgggagatggagcttgcagtgagtagagattgcaccactgcactccatcctgggcaacagagcgagactccatctcaaaaaaagaaaaaaaaaatgctgcatctgctatttttagttaagtgagaattgctaaagattttcgaatgctttgaagtttaacttgctggacattttagcttgtgtaagttatattaaaatttcagagctcagaaatcctaggacattacacttccctagcaactgcattcctgaatgttttgaaggctgatgcatgattggccttctcccaccacaccggggaaagaacacaaggctttgtggtttctgtggatgttgttgactcacatctcttgaccaattcatcgaaagtttagcatcaactcttgatgaacaccactttttaaaacttttatgcaaagggaaggtgtgttgaggttttgaaatagcaccgttttcttttcttgtcatgtaacatattgatttcggcatcttactgaccttgtttggaatgagcagtgtgtgtgtgcacgtttctgtgtgttgtgtccatgttttcctgtattatttctttcagaagtggagaaatttgccatgcagccttaagctctgggaaaacagtttatctaccactgcctcaccagtgatccacttctggaataatatgactggccttaaatatgagcagggtagtcaaatctccaagaagcctccatgaaagctcttaagaaccagattcatatttgaagccttctggatcctaaggggcattctgtttagcaaagactaagatgtgaggtctaagttttataaccaagccttctctattcaaagccatgtttattttaaagcttttgagaagaaggaatatctgggccatccatgttcatcctcagatggaggtgttttctgatttctgccaataaatgtcaccagtgctctgtaagccctgttttcatgaaagtaggagtatctcctcctgctgccctttggagctttgttatattgtctaccatctgcatttattttgtgatgcatgacttaaggcacaaagacatttaattactttttttcacattttggaggtatcttttcttcttttacacacacacacacactctttatatatgaacatttctttgatcttttcctcccctcctagcatgaggaaattttgaacaagggggatgccttgaggcctctcagatctttttgcataaacagaaagacctgtgtggtgattgatggtgtgaaagaaaagtctgtattttttagtaaaatagcaaaagtcacagaatatcctgctcaaaatttaacatatcaacgcaacagctgttcctatttttaagctttcagacatcttcatatggtcatgccaaagctttcagtagcttttctgctatgggaaaagctgctgacaatcatgttattgatgctaaaaggaaagtcaaatacagaggctagcacagattttattcgggtataattgagcttttggaagcctgagtcaaaggtttccaactccaagggctttgctggggccccaaggttaatgttgaaggggctttcaaagactttcccttagagtgtttttcagtaccgtgtttaatttctagatgtgttctaccctttttataattaatagtgcgttgtgctgtctatcatgcgccccaggtgtgttgtcagggacatggcgaagcctgctgcctgcaaaacaccaagaaatgctgaaaaccagccccaccaaccttcaccgtgagtatggcattggttttattgactgaaaatgtcgtctcttacacagatcatggttacagatttattcacattgcatgtgagagtagatactctggctgctcttgtatatgtaacaaaaaggctactgttgaattagataaaattagctgagctctggatttaatatttttgttaagtgatgtttctaataccatattgaaaggattaaactagttgaagaaaagggacagttttcttagggctctaaaatgacagcaattcttttttgtttgtttgattgttttagatttggaatgtgtatgagctggaatataacacctcagagaagtatggaggcaagatacagacagggtgctgagtgggggccagtgtgtttaagggaaatgcataggtagtccattatctaaccctcaacatatattatttaaaggtaactgacaatttttaaaagttgattgtcggctgggcacggtggctcatgcccgtaatcccagcacttttgaaggctgaggcgggtggatcacctgaggtatggagtttgggaccagcctggccaatatggtgaaaccccgtctctactaaaaatacaaaaattagctgggcgtggtagtgggcatctgtaatcccagctacttgggaggctgaggcaggaaaatcacctgaacctgtgaggtggaggctgccgtaagccaagatcgtgccactgtactccagcctgggtgacagagtgagaccctgtctcaaaacaaaaacaaaaacaaaaacaaaagtggattgtccatctagtttcatttttattattgaattcttaagtgtagatcctaatgattaattaaatgaccaacagaaagagtttcattcacatttgaaactcagagttgactgatttgatttcttctctactccctgctttaccctttatttggtcattgaaatgcttatattttgtatattacatacagtaacatatcatttaaaattatttatgttttaggatatgaaatgtggtaaatttcaggaggcttaataggtgttataggttttaccccaataagtatacttgaatatcatcttccacatttaatcagtattttccaagaaataaaaatagttttgaattagcaatagtaaaaatgattgataattacattttaaaaagtacaaacttggaagaagtactttaaatgatgttgtcatttttcttttgcctatagatattctgactgtatgtaaagccatttttgtatgatggaactttttggataattcatagaaaacttacatccccagttttcatcttatattctaggaattagaaaacattttatttattttagaattcaaattctttgaggaattaacattgattttaaaatctctttatattccacgtatcgaggtttcattttaattggtctcacctattccaaagttcattttaaattacacattattagatatgaactagcatttgccatcctccaaaacaagacattagataatttttctcttactttgttttcactttcacagttgtagaaatctgtcgtcactttaattgcaccttgtggaaacttccctgtggctctttgagtttagtggccgagaagaagcaactatagattctttggatcctgctttttgacagtctctttgctcactcaattcttttctgtttaaaataatgaacttctctgccagtgacttgaagaatttaaagtttgctttcattccttatgatagctgattctctgtagagagtaatgtttgtgaatggaactctccatagccacataaatccctttttaggttaacatggaaaggacaaaaataaattgggagggggtaattgaggacaggctttagcttatagatcagtatttttaaatttgtaatttatgattttcagtgggtctgaaaatcaatagaggctagtgaccagacctcttttaatattttttttaaaaataaaagataatagaaaatatgagtgccccccaggttagtattttaggacagaacttagatttctctatatggtaactgtgtcaaaatataaaatttaataaacattgcagttatgaggattgcattaatgggttttaattagaggaatggcataatcagatttgctttatcagtggatgtgtgtgtatagataatatgtattatttgctttgagagaagtagggaaaatggactatgaatgtgaagtgggcaaaactagagacaagtaaatcaattaacaaactattgcaataggtcagggaaagataataaggtctcaacttagaggaaggagtagtagaggttatgagaaggagacatttcaagagctaagtgagaagtaaaatgggcaatgcttgattgccaattgaatatgggttttaaggaaagagtttagggggattaccatattaatggcttgggtgactaagagccactaccaagaagttgaattaaagctgtaaaccaaatctaggcatagatggtgtattagcctgttttcatgctactgataaagacatacctgagactgggcattttacaaaataaagaggtttattggacttacagttccacatggctggggaggtctcacaatcatgctggaaggtgaaaggcacatctcacatggcagcagacaagagaagagcttgtgcagggaaactccccctcatgttatcatcagatctcatgaaacttattcactatcatgagaacagcatgggaaagacctgccctcatgattcaattacctcccactgggtccctccgccaatacatgggaattcaagatgagatttgggttgggaacacacccaaaccatatcagatggacagtggtgagttcagattttcatatagtgattttgtaatacctgtaagttatccaagcatatatatctaacaagaggttggctctgttaacctttagcactcagttaactggggaaatagatgacatcaccacaggatacatagaaaaaaaaataagagcgagccctaggtaaaagcaatgtttaaggaatgagtaaagtatgagggtcccccaactcagccaagaagtagtaaagaaccagaagccaaggtagtagagggattcaaggggaatgcccaacagtgttaaatgcagcagaaaatcaagaaataagggatgaaaagtgtgctttggttttcgtcatatagaggccattggtggcatttaccatagcattttcaatatataagtgggtggaaatgctgtacttctgtaggcttgaggaggaaatgagaagtcaggaaaaggagagggtaaatgtacatgactttctctaaaagctcaaccgagtagggaaaaagaaaaagagtagttggtagagagacaggaagcagggtgatagtactcatatcacttggtgtattctattatgcaagtctagactgatggatacacatgtcaatatactttatatttttgataactatgtacataaactatccaaatgttccttttaagttattgttaaaatgtcactcagtcatattttaagcatgctgcctgagttgtcatcacttaatcaaagtaataaatatatcaagatattactggagttcaatgaattgagtcatatgcctgctattccttgggtataagatagaaaaatgagatatataaatgagatagaatctttttcttaagagtttcttctcaagttgggggaggagaagatagataatcaaataaattataatactgaataataaatacaatactaaaatgcgtttaaaaagagaaaatgatttattctgtttgggcttgatgtggtcagggaaggatttacagagctgcaacagtaatacggattttttgtttgtttgttttttgagacggagtcttgctctgccacccaggctggagtgcagtggcataatctcagctcactgcaacctctgcctcccgggttcaagtgattcttctgcctcccaagtagctgggattacaggcatgcgccaccacacccagctactttttgtatttttagtagagacagggtttcaccatgttggtcaggctggtcttgaactcctgacttcgtgatccgcccaccttggcctcccaaagtgctgggattacaggtgtgagccactgcgcccggacagtaatatggattttaaagactgaatagtttagtaggtatgtaaatttaggtaccatcttccagaagcagaaaacaattaccctgagacccagaacatcaggttgtgctggggtaatttaaaccatatactgactactggaatctgtatgcattgtatttttcttatttggtcttaaggtctctctcaacagtggctataaactctagccctgtgtcaatggggctccgggtgggtggtcatggatgtttacagtgtgcctttcatggaatagttcttcatctttgtgaacggcctaatgctaaagtgactgacctgtgaccaaatgcccctctcaaaggaaacttgttcataatggcagatacccctgtggctcttaactgacctgtgtccagtttattcctaccaagatgtcaggagagttgtccaggagagccctggctaggaggagagttaggttcaggtgtgtcagtcaagtgagacacagaggaggcaacacaataaaacacatgaaataacagaagcagtgtgtcactgatagatcctagcgagaaggggccggcatacctccaagggccaataggaagctgggagctgtcttagaaatacacgtgcaactagctagtggagagcaagagagagagagtgagggactcataggccagagcctttactggtgtccaggctcttacccacgcaggttttcctcatggagttctaattggtcagtgtagatagagcaagggggcactagctcagtggagtcatgctgtactgagaggtggtccctgtggcatatctggggaggtgttgggggtcagtgggcaaatcacatatcttgtaactagctgtcccatgggaagttgtttcaccaggaggcagttgtatgaggtagatctggattgatcaccttaaggaacagggaggaggcagagaactggcagctgtgccaatggttgctaaactctgcttctggtatgagaacgttcaatttatatttaaaatggatgccaaggtaacataaaattataggaattcactgcagtgtgtgtgtatgtgtgtatgtggtttcgtgggtgggtgggaatttgtgtgtgggcatgcgtataggtgtaagtgtgttaaagagggagaaagatcagaggcaggaagtgctgcatcagaagaataggacagttatctaatttggagaaaataagcaactcgtaccttggctttggttttacttttaatactgcgttttattttgaaatttgatttaaaataatcttttttgtgtgtttttcagagttatcatggatttaaaaagtccgagaaagacttggctactcttcagtctcaggcacatatgttagggggaccaggtaggagaggcaggaggtagagaagatttgagaaaatttcatgtgtggtataattagaatatagtgattcattagatgtgataagaaaacaaaggaggcaagataagtcattttagctcaagagattaaatggatatgataaaatcaagaagagagctaatttaggcactaaggcaggtttacacacagcattagattcgagtattagtagccaaggaaatctccaattgcaacactcagaaaacagttggctattctatttcaaactcaggagagacttagaaaagatacattaatttgtaagcaattaccttataacataaaccattaaaacaagtgaaatagcattgggaggaggtgtagagataaaaggaaggaatataaacgggtgatgggtgcaccaggttctcacaaatctccacctaaagaacttactcatgtaacccaaataccacctgtaccccaataacttatggaaaaataaaattttttaaaaagccagacaccagtgatatcgagacataagtgttatgtcattgttttgcatagactaggtgataaacatcatgttattaaaaattctgtcaatatataaacatttcatatatacaaaaaataaacaatctatagtgggtataaccagtacttaaacgaggattggaggacttaagaaaattatgcaatgtcatgcaaaaacaaacttgtcccggtttttctggaactttccgtattttagcactaaaactcccatgtcctgagaacttctgttagacctgggcagactgaatggttggtcaccctagaactaataaagttagaatttgaaggtgaaaatccagaaagagaatatgatagccaaggaaaaactatgcttagccaaattatgtttgcttttctgtggaaggtgacattatcaggagtaaattgaatcatggtacatgaatcagtaaattctgatgttttgttttgtttgtagtttttgctggtgattacctgtttttaaaaaattgagatacaatgcacataccatacaattcacctttttaaagagtacaatttagtggttttcaaaaagctgtgcagccatcatcactatgtaattcaggaatgttttcatcaccctgaaaaagaaatttcataccttttagctttcattaccccattctcctcaaaatacagcatctgaaaccattactttctatatttatgagtgtgcctattctgaacatttcctataaatggaatcatattatatgtgtctgtttatatctggcttttttcatttagcataatgttttctagactcagagcttgtatctgtactttatcccttttattgcccagtgattgtatcgacatatcaggttttgtttattcatccatcagttaatggacatttggattgtttctactttttgactatattattaataatattgctattagcatttaggtacaagtttttggggatatggatgttctcaattctcttgagtatatacctaggaataaaattgctgggtcatatggtaactgtatgtttaactttttgaggacctgctaagctgtatttcaaagtagctgcattattttacattcctatcaataagagaattccaatttccctaaattcttgttaacacttgttattgtctgtcttttatattatggacatcccagtgggtataaagtagtgtcttactgtggttttcatttgtgtttccctagtgaataatgatattgatgaacttttcatgggcttattggctatttctatatcttctttggagaaatatctatcaaaatattttcttccgttttaagaataaaattgggttttctctaaggatgatctttcaaaatatgtgttatttgtcttttttatttttgagttataagtgttcttcacatgtaatggatagaagatctttgtcacagaaatgatttgcaatattgtctcccatttagtgaatagtcttttcattttcttgatagtacttttgaagcacaagtttttaattttgatgaagtctaattgatctattttttctttggttatttgtggttttggtcttgcatccaggaaatcattctcatatcaaatgccattaagatttccccctgtgttttcttctgagagttttatacttttagatcttacatttaggtctttgattcattttgagatagtttttatatatgatgtatgtgtttttatacatgtgtttgtgtgtatacttttcccatagcagattaggaaatatatatttttatgcttgaaaatatgatttcttatttataatcacatctcagatttatgtcttacatcaattaaaagattaaacaaaagtgtgaatgggtctttgatattgtgaatagttggataaaagctcttgtcattatttctctatgactttaagctctgcatactagacatgatcttcagactgcgtggtctagtgttcacaactctgtgtcctacaatagcggatggcagaaatgtcagggacaacacaaaagaatggataatccacttgtagactgttaccacctcagacacatccccatcatgaatataatttctctcaatgtctgggaaagaccctataaacattggaaactggcccacctttctctgttttgggagctcttgcacccttgctgctgctgagccatgtggtctttccttcactgctaaaacagctttggctgagaagatagcgttaaaaggaagagaaatgaatttcttcaacaggtggaagagtatgcagtagaggaaacaattcactgcttttatgcaatgaattggcctatttattctctcttcaacaaatatttagtttgtactgtgtgcataacatattgccaggccctggatattatcatgaacaaagcagagtctttgtccttgtaaagcttggagtatgggaggagacaatctaaacaacaaacaaaaatagatgataaaacccttctcttttaacaaaggcctaacctgaatgcaatgaaagagagctacactgggaaaactatttagaaagactgctcaaggaaggctctaagaggaggtgacatttaaaaagagacttgaaagatagaaatcagccctgtaaagagccaggaaaagggaattccaggcagaaaggatgatggtatgtgaaatggtccttatgtggaaaacagagtatcatgtttagggaagtaaagaagcccagagaaagcaagtgagtagaaagagggcaatggctgagacaagcaagggttccatcctagagctcttgtgggtctttggattttatctaagacttatattgagaaacccttaaagcactttaaagaagggggaatcatgatccagtgttgcgtagcaaacgggttgtaaggaaagagaacttttaggagacagttgtggcagttaaggcaaaatataatggtggtctggactctactggtggcagctgagatgaagcatgtggaatttggccacatgccaaaagtcatgaagttttgaaagcagtgagggagaacagagaagaggaacttctgtgcactaaggggaggaggctctaatcgtatgtctaatctctaatatgcttaagagggtcactgttctttgaatgcggaatgcatatgtacatattttctcatgaaatcctaagcatcctactatggatgcaattgtatcttaaatggtatctattgttgaatactttagaaatctcacttgtattactgtaggtatacttatatagcacttcaaatattgaagacaaaaattatgtaaaattgaataaaaattgaaagactgctagatttttccacttatttaaacttatttaaaattttttattgtgattttttttactctgatagtctgttgggacagaagattcaataattttctaggtgtttggatacccgtgaagaaactgatttttaaaatatatgctagatacaaatattgcaccttttaaaaatatagctcatttactgagtaaaatccagtcaagaagaaaaagaatatgtcatatgcaaaggatcttttagtcatatattttatcatgaatgaagttatttttctgagacaggccttctctgtactatttttagccatgtttataacaaaattgcattgagtcttaatttcttgcttcgttaaaagttgttttcacataaaataagagatgtttaatgtcacaggctatagttgtattaccacctgcagtagggatcaatatcaattttctattgatattagaaaaaatgtccaactaggaaaaaaaatgttttcgcattttagaataaagtcagtagagccagtaatttgaaaatagagaattctaggaacactgacatttccaattcatagttataattaggaagtgacagaattttaaaaaattgtgtggcttttatagtcttcattctttttatatgatttgctggcttatgcaaatcgttctatgccaattcacaaagtcttacaaagccccttgttctgccatagctattttaatgataatattgtgtttttctctttctgaatgctcagagaagatggtgccctcttcaatttcttgactattaaaagcatttagttctggaagagtagaacttaagtagttctactatgtatatgtgtgtgtgtatgtgtatgtgtatgtaactaaggtcatgcaagcccaagcagacttttgattgagtgtatttaatggcagctttacattaagccacatgatgtggcaacagctgagatttgatgatgcttgtacttggctggcatatggaagacaaaacatgacctatgttagtggcttgccccagggtcacccagcaggacaggggaagataactgaactctagacctgaaaatccgtgaaattttagtcatatacatgacagcattgtgtattccataaagtagtatataaatattgtccatatattctactcaagtagcagtgaaaaatctctacattattcatttattttgttaatttaacaaatatttaccatgatcttacagtgtacttgacacaatttgagaataatttttttggtcaatcctctcaaaacatagactgtatctttatctctgtatgtttcttattcaggggaatgatgtaaaaatgcatagaatcactttttagaagtttatattccatgacatactaccccattatgtatcaaatgctccttactatgcatgagtagggtagccaggaaacgtgtatttggaaaattttcctaagtgattttggcatattctcttgatttagaatcactgatatgtaccactaatatgctcagtaaaaatgaagattagatgggatgggtgataattttataagtcaaaattaatgtgaatatcactgaattggacctctctttcaaaactcatgtacagatattgcaaggataaataaatattggcaatattattattagaaagttgctgtgcctcagggctcagcctggttactctgtgaatcactgctatttcctctgctcttctacagagtcatttgtccaggatgagaacagtctgcccgtgccaagaaaatagttggttgttgtgaaaaaacaggaagcttatagccaaaggaggcaaaatataatggtggtgtggactctactggtggcaactgagatcggtacccactggctactgcactagtgtgagaaggaagatattaaataaaagaaaaagataatgcctaggaccttgggcaaagcatgcagtgaattaatgtgtatttagtggaaaatgataatggtgaataaatgaatgcactcatgtattatatgtataacaaatcttaaacattattaatgtgggtaaaagttcaggagtcagaatgaagccatcaggcaagggggacattgaatatatagtctgatttgaaaagcatatttggccaatgagttggaggaatacaaacctgtgaaaggcagttgaggccagtttatgaatgtccttgaagtccagctttgataaatggattttactctgaagggagacaccaaagtatctgaacatggagctatctagttgaaaggaaagtttcaggataatgaatttttcaggaatatgcatgatggatgagcgtacggcattcctggagaaaaagggaccaattagtagatgattaaaatagatgagacatggctaataatagtaagaataatggcaatgactccagaaaaaatggatgagagagacatttgaaagaagaaactggtacgccttaatgacaagtggatgtagttatgaaagggacaagtaagagataagacaaaaattttctgagattttgggactgggaattaccaaaggagagttaataaaaaataaggatagaaaaggcaagtacttctagggaattacattcctaaagtatgcatttcttttctgattcctgagagaaatccacagaaaagaagattctgtggcacagtggagagaatcattccatatgggaacatcaaaaagaaaaagagcacacatctaaattttcaaaactgctcaccagtctaagttctgcataagattaaagcagaagagtgtctaattttagctttttgctgattttctatcaactctggtaacaataactgcaattatatgctgttgtgttttaggcactttatgtgcatttaaccctcatgaaactttataaagtattgttactgtctccattttacatatgaggaaactgaggcacataaaagaaaatcatttgctcatgttcatttacccactaataatcacattcatttacccactaacttctggttattcattttaactattcaggtcaggattcattggcagcattcttcttgctcaatcttgggctaggatctagtggggttagaagacaagaataccataggattcttaattcaaataattcattctaatatggtagacataatatataatcagtgagtaggtcacactctttgtggtattcaccccacattagaaaaaattcatagaaaagatgaaagttgacagagaatgtacaaaattgccattggtaatgttttcatctaagtttccttatttataaaccatgaaggctcttctttattttgcttgcagaaagggggtttaatctctaatccggcaatacttttaaagagcactagtcatttggcagtaagtcgtatgctatcttgggatatgttttctctggttgccttagtttatttttttttaaatcattcactttttcatttcttttgccttgtctccccacctgcagtgttcacctcttgaagaaagagactgtattgcagggaagtcattggtgtactataatgcatactactaagctatgccattggaacttgatataaattgcttttttttttggtttgaactatgatttgatttgatttgaatactgaatgccaattgacaaatgatttcaagatggattatattatctcccttattgataatggcaaaccaagccgctaaacattatggagtagaggatatggaggatcagggaggagaataaaggcatctttcattttatcactttgatttttctaactctgcatttccatgcaattccagggagccatttccaccatctattatcctttgaagcattaaaagtgttaaaatacttggactggttctttgcagtcttattttactatgagaccttgttagtatgatacctcagctgataatcttgggccacatttatgagaaatgttcaggcttggaaaacgtgtgactttgagttctatttcagggtgtgtgtgactgtaggtattaacacaaaatttaaagttcttgccttctacagtgcatgctactttacacataagagtgctcaaatattatgttgtttgttccaagtttaaatggaactgaactcagtatttccttccacatcacaccccaacaaacccaagcacagtcacactcatgcatccttcttcaccttctctcatctatttatgacatttccattctcacagtcacacagatgggaaacccctgagtcatcttcagctccccacttccttgtgtgctccctaagtgtaatcagtcactatgtcctgtcaggtctaattctgaatctctgaatcgtctcacatctgttccttctgtcagttctcactcccatcctcatatttcaggctctcctttttgcatggggttggataccccttggccttttgtcttctattcctttactagtctaattcatcccacccagctttgctcagagcacctgccctctctgaaggcctttaggtccaatagtccatgtataaattaagtcctgcctgcacagtgcctgattgtcttctcttcaacactaacttctctggtctaaatgttttacaaaaccacaatattccctactcattgaagatgtccttcccttctatttctaccccgagcttttgccactgcttgttttaatatctcacccactcctctttttccaccaatgataatcctgcctgtgactcaagtctctgctccaaaacaatttcctccaaaacgtacttgaccacccccttcaccaaaattttttcttccctgagctttggttatacctgccttcctagagcacacattatgttctatttgtgtgtttcttggatctgctgtaagtttatgagctctattttagttctctattattttcctaattgttgtaaaaaagggtcaataggttcttaagtgggattgcataccagaatgaaaccaccaagagcgtgcttatgctctcactctcacacttggtctctctttctatttctcatttaaatattaagtttagagattaagttatacagggaaaggcccagtcagtattgtataatcagaaaaaaagggttttttttattattgacataaacttgatttttttttcttttctttcaacattggcatagggactatgacttttttcttttgagaaaatttgagattgtacagccagcctaagtaaattctcagttaaaagtaaataagtcatcagatgtggttaccagaagagggatgttgcagaatacacaacaagagaaatgactacttgccatcttctttgtgttttctttccagactgtcctgaatgctcagatgtggagcacagggactgatttatgttttttctgcacagattttatgtctactaactacacaaaacttgggggaaataaatcgtggataaattttaagtacaaatatgaagaagctacttacatagcaaaccatcttgtatatttaaaagatgttctttcttaaattccatttttatcatattactgtctgattaaaaaacgtattttggtttgctgttgcctattatgtgaagcctaaattccaatgtctggatttcatggcatttatcttatctttgctaattgctattatgtgtttatcataggtttccacatgctttcagtaacattctgtaacttatgaaatatgttaatttttacttattgattgatttatgtataatcaattgtaagtatagttggttatttcaatagctataaccagaatgtattagagacaaggaaactgtatttttaattgaacattggatttctctaatatgtttctatcagcctgagaagaatgcaaaaaggcttaaaaaacatctctctattctgaaatgctaaataattcttagatgaaatagaaggaggcacagaaagggaaatgggaagtaaaggttgtggacatgcctagagggactcaaagctaatgttaagaggatgatctttgaaggaaaagaaaaaaaaaaactgtactgctggagctacactgtgacaaatagggctgtgtctctaccttttacagaagcagcaaatgcacaatcttatgaaaaaaatgtagaaaccacagtgttactaaaattttttatctggcaatttataatttacaagccctcaacacgttaaaccttagttaatttttttcccagagaagaaggcattattatattatactttgtgctttgagaaaattaatgctcaaactggttgccagtacttgatggagctattactcagacgtctgtttccaggtgctctttttatttcattgcatagaaacaagcagaacattgtaagttgagtcctgtaagttgagattgtaaaccttcatatctatgtatccatctgtgtatgtatgtatgtatgtatgtatgtacatatctatctatctatctatctatctatctatctatctatctatctattatgtttgtatctatcatcattattgcctatccatctatctataagctgatgagggtggtataaaaggaaagtccaacatcctccccttccctattccttagcactcctacactcttcctccttcacacaagcactttgtactccaccaatacagattgtagttcaccagcacacagcaatgtacatgagacagcccatactagcttgggagagtcaactgttagatattcaaaaagtttgcaatctagtttaaatagggctattattaaaactgaattatgactgggcatcatggctcatgctcgtaatcccaactctttgggaggccatggcaagagaattgcttgagcccagaaatttgagactagcctgggcaacatagtgagacttctgtctccaaaaaaattaaaaaataaaacattagccaggcatggtggcgtgtgcctgtagtcccagctactcgggaggctgcggtgggagggccacttgagcccaggagttcaaggttatagtgggctgtgatacaccactgcactgcagcctgggtaacagagtgacaccctgtctaaaataaaataaaataaaatagataaattatattaaaataaaggtaaatgctcaactcaccaacttcctaattattttgatacatgtcacggtccatgctcttgagttatgtacgtccattatatattatatcttcatgatggaaatactgcactaaacatcttttaccaattccatgttaaagtgacatcctatttaaagtttgaaatatgtcttgggtgggagtatttacaccatggaaattgacaaaccctataattcagtaattggtactttcttttttcttttctgtttttatttagttagtttttgagaaacagccgttaaacatttatcagcagaccactgcaaacacactctgttgagtctctccttcttgcctttgtaaatgttctttcctctgcctggagtgcccctcgctatgtctgagacatacatgtatatgtatggacacacacacacaccagtaaacttcttttaatcactttaactagtgtcatttctttccaaaagctgcttatgcctcctaggcagggttagtctctctactttgtagtagttctatactttgaatatctttactttaacatatgtcatcctttattacacttagaattgctagatttagcaaataaaaataccaaccctcatgaaatttaagtttcagatacagttaatatttttttcataaaagtatgtcttattcaatacttgggcatacgtatactgaaaaattatttgttgtacgtcagaaattcaaacttaacttgatgtcaagaaaccatcacaactttgggttttgttttttttttttttttttaatgtttcaccctcttagtagagagatactaggtcttttctcatggtgtccataatgtctagcacaaagaatggctcataataggaagcttgtttgtttgttttaataatatgcataccatgatttttcttattcctcgtctgactgaatcatttctaaatatttctggtggacaaaatcaggaaaatggagatggtggaattaggacaaccagatagaaggctaaggcaataggccagatgagtgatggcaatgtgtgatcaagaaactgatgatgccttgtcgtggggagaagagcatggattataaataagaatctagtgcagaaacaactagacatcatgactggatatagatgttgaatgaggagaaaatagaaatgactctgaagtttcttatttgggcaatggagttgatggcaccattaactgagagagaaacaaaagatgtgtagttgataagaagcagtagaaataattgagggattccatttgggatattctaaattggatgtgttgtgaccaggcatgatatgaaaaatatttttccaccagtccagtgtgggcattgccattagaatgaatatcaatcagttggaatgggcaatagcccaagggtgctgctgtgtgagagtgcttttgactcagtaaaaatgtccaatagggaatcataactaagggtctgaaactctgggcagaatttgtgtctaaaaattttggggctcctgacttaaggtgacactgatgctcagggtgtagatggtagcgtttacagagtatttggagaagaggataaatgatggagccatagagaatatttatatttacatgacatacagaagaagtaaaaatagtcaaggagaaatatgcagagtggttagattttatatatggtagaggtgatggattatcttgctttcatgtcaagctcctccacatttttttggtagagcaattgttacgttataaatgatactgtataaacctaggggcttctgtaaaatgtcatcttagttccaggctgctattaaaaaatgcttttgactaggtagctttaaaagcagacatttatttctcatagttctggaggctgaaagtctgagatcagcgtgctagaattgatcaagttctgttgaggaccctcttcttggtttacagacagctattttcatatggtgtcctcacaggcggagagcagagatagaagaagcaaactctcttgtgtctcctcttgtacagggcactaatcccatttatgagggctctgcctcatgacttaactctcaaaggtcccacttcccaataccatcccattgggtattagactacaacatatgaattttgggacggtacaaacattcagttcacaacaaatatcaaacaccacagatacctaggggcttgaccttttgtgctacaataagactacacttggctggatctagtggttgatgagagatacacaatatcattatcaatccagaagggtcggctacaatagaaaacaaagatatgtagactgggaggaaggtggacttattagtcaagggtttgaagttgattggctgagtagcctttctggtttcattttgtgaagagaagaaagggctgggaatagagagttgcctgtggtgtgtcattgattgtgtccttagagggcttttgctgttgtcatatttctcaaacttgataataggagcaattttgagttgatgagaaggcatttgcatttgaacagtgagtgttgttctagttctgttactcaaggagtttctaaggaaagtaagactgccaaagtccatatggtctggaaaagaacaccatgctcaaatatgtgtgggtcagcagactgctggagtttttttttttcttccaattctgaaaggatgcttaatcatttgtcccattattgaaaatgtcacaataataattataaatggttctttgcttcctgtagcagcaaatctaaattctttcagttgacatcaagattcatgctagcctgctttcagtaaccaatttttcatatctaattgccccaaaattataccaccagctttactgagtctgaatcctgattgccacatgggctcatcttgttgtttcctattgccatttccttgtctatcttattcttttcattcaaaattccatccagtttctgctttgcctatccaagttctttggggtccatgagaactaaattcaaaatccgaaattctttacttaggaattaaaaaaaaaaacttgtgtgttctcattgagctagtaatcccatttctgggaatatttcaggcagaaatccgatgtcagtatgtaataatatatatacaaaacgtgtttactgtgataaattggaaaaacatgaatgtctacccataggaaaatggctgaataaattatggtattgccctgctgtgaaattcttgttattcttaggagctcctgaaaagaattgagcatcttcaactaaacaatgggtgaacctagagagttgttggaataattaattaaactatacaattgtgactggcccatagcaaactgtaatacagagtaactgttattacaactattggtaacattatttttttattttttattagaaaacataggaatgggatatttttatgtgaataaagtaatttgtatgttaccatctacatgtgggggccatttgttaatacaacagcatcatatatacatgcctaagtgggactgattcagattattaaacaatttttaaacaacttgtaaggaaaaggcacagcttaataaaaggtacgctagctctgagcagctggattgccaacaccagtttgtagctagctctttaaaaatccaacaccaaagactaatgtataaacaatggaagaagtatggaagtatatgcataccattgtcaatagtggtgcattatacacatgggaagggagaggaggagatcattctactagaacactgctcttgcctgaattgctacaataagcatatattactttctaattaaactgactcaaattaaaaataatgcttctttagtacagtgactagcacataacaggtgctcaatatttgctaactgttattttcattataggcagtcattattactgcctcaagttccataaactccagaaatcttcactaacaacatctcccctatcctttggaatgaaacactgatatgtgcagcttatttacaaagcacttaatttcatgggtgaagcttcactcaccagggggtagcctgcattgaagttttgttttgctctaagggcataattttatttaagatgaattcacattttgtacttaatttgtctcatctcaaagcatgagaaaaattacaattacaattagttacaaacaaaatattggcaaacagttgcaatcaatttattccaaatggataagaatgtaggtgctacagtttcttgattacatttggtcgtaatcattgatcgattcattaattcagtagatatatgttgagcatctgctacgtaccaggtaccgtgctagcaaccaggaatagaacagttagttagaaagataaggccctccctatcatggaataggagctattccactgtcaaactcgaaataagatgcacagtctttgctgtgtcctgcatgacctggcctaagcctgctcctccaaccccacctcaggccacactaaccctcactcaaagtgttccagggacatatggcttctgatctcagagcatgctgtccatcgtgtcagggacacccacgtcccagcttctcccagactgtgtctcctcactgttcagcccccaggtctctcatggaagccatctctgatttctgtattaaagtaggcccctctgctattctctaccattgcccctattcatttaattcctacctcctatcacagcctctatttattttatgtagttatatatttacaaatatagatttacacagttttatttgaatgtcacccagaatgacataaactccacaaactccagagatgttccataagctccagaaatcttcactaacaacatcttccctatcctttggaatgaaacactgatacgtgcagctcatttacaatgcacttaattgcacggtgaggcttcactcactacagggttacaggcattgaagttttgttttgctccaagggcataattttatttaagataaagtcacattttatacttaatttgtttcattaaacaaattgaattaaagataattaaataaatacatttaatgaagccttgtaagactgtggtcagctattattaacaggtgatattatttgagaatgccactatcaaacttgaaataaaacctgcagtctctgtgtgccctgcatgacctggcctaagcctgctcctccagcctgcagaggcccagaggggcctaatttaataaagaaatcggagatggcttccatgagagacctgggggctgaaaagtgaggagaagcagtctgggaaaagctgggatgtgggtgtccctgacaggatgggcagtaagctccgagatcagaaggaacgtgtccctggaacactctgagcgacagttagtgtggcctggggtgaggctggaggagcaggcttaggccaggtcatgcaggacatggttgagactgtgggtttcatttcgagtttgatagtggtattctcaaataatatcatctattgataatagcagaccagtcttataaggcttcataaaatatattttaaaacaattaagataacagaattctgtcacatctaagaaggcatatctaacaatgctctaaaatatgtttatgtacattagattttggtctcaaactatatttgaggaaacaaaatgaatacagaaagatcaatggtttttttataaggtcaaaattaccagcctcagctatattctatttattttatctaggacttgcttcactaagccatactgaaaggaatatagtaaccactttatttttataaatgccttcctttaaattgcagactttatttttgaaattgcctctggactatatgaatcacttgtctttttaattaaaaaaaaaaactttagttttttaacagcattttatgtcgatttccccagaacatctgaacatgtcttttaaaaatgcctaattctatactgtttactttatcatttacttggccatattcttttttggtagcacatcctgaaacccagattctttccgtatttttaggtcatacaaatgactgtgatcaacaaatattccccaaactgagtgtagtttatttagtattcatttagtcattgaacacaagcacatgctgtatacaaatcactaggttaaatattatgaaagatatcagaccggattcctgctctaaggatattctatttcataacagagtttcagtctagtgctcaaatgaaatgcagagtcctttatatgttacattaacaagggagaaataaagtactgtagtttagagacttcatatatctagtgggaagtacaaatgtattgttatgagaacttacttatttaaaaaattacttgtatgttaacccttaaaattatataaaataggccgggcccagtggctcacgcctgcaatcccaacactttgggaggccaaggtgggtggatcacctgagatcaggagtttgagaccagcctggctaacatggtgaaaccctgtctctaataaaaatacaaaaagttagccaggcttgttggcaggtgcctgtaatcccagctacttgggaggctgaggcaggagaatcactttaacggggaggcaaaggttgcagtgagctgagatcacgccactgcactccagcctcagcaacaagagtgaaactccgtctcaaaaaagaaaaagaaaaaaaaaagaaattgtatgaaatagagaagtcaggattttagagctaaaagaggttgaaaggatcatctaattcagctcccttgcatgacctgtaatgccactgaggttcagagacgtcacattagaatatcctgcccagtggtacacggggagtttgggtggggttttcctgactgtcagaggtacttgcctccactgcagtggaatcattggtgccaatttgcaccaggaatgttatgcatgacagccaaggcctatctggagaatatagtttaatcttttttcctttttctttctttgcttgcttctttctttctctctctctctttctttctttctttctttctttctttctttctttctttctttctctttctctttctttctcctttcttccttccttccttcccttctttttcttcttctcctcctcctcctcttcctcctcccctcctcctcttcttcttctccttcttcctcttcttcttcttcttcttcctcttctccttctcctcctccttctccttctccttcttcttcttcttcttcctcttcttcctcttcctcttcttttttccttttatttttttgaggctcagttttactctgttgcccagtagggagtgcagtagcgtgatcacagctcatggctcactgcagcttcaacctcctgggctcaggtgatcctcccatctcagtgtcccaggtagctgggactacaggtgcacaccaccacacctggctaagtttttgtatcttttgtagagatggggtttcaccatgtttcctagatttatctggaactcctaggctccagcactccactggtcttggccttccaaagtgcagggattacaggtgtgagccaccatgtctggcctttgtcttttttaattttcaaataatcacatttcactttcagaggactgctaattggaatttaaatgagcaagtgcacttcaatcaggttctttttatctaaacacacacaagattgttaaggaaaaattggatttaataaaatcagttgagatgttgattagttataggtaaagctgcttcttgatgttcaggtagttataacaccagaatgatctgttaagagaggtttttaagactcagtccccatcattttaaaagagagaaaagaagactgttttgtctacaggtcccagacagtaactggccacaaagtctctcaaggcccctctgttccgtgactttatttaaattttcttttgttttgttttcaacactatgtagagaggaaaagcttcaggtggaatctatgctcatttctgtttgttctcatgcccaaagttcatgacatgcaaagcagaaacataaacaggaacattgctattttggtgtgattggcattttgacttggcatatttttggtgtgattggcatcttaaattggcctaatttttaaatgggaagacttccttggtagaaattaaccatggagtgaaaggtctctgtttcttctttctgtcttcggtacataaggacaaaacaaccagaaacctgaggacaaagcaacagcaatccaggtgaacatgtccactcacagcatacagacagtgacagctctgtgtgagtttcaagttgaacctacatcaaccgtttttattcttttctaggtttacaattattttcaaattgcaaagtttatagagtttggtatataggagattctatctagatttcatatagtggtagggggctatttccttatgattttaaaaactggagttctttcagaaattatggctcagatatgcacacaatatatttttatttctattaaatggtcacaaattgaagattttttaatactattgttggttaaatgaacaatgtttaagcaatttcgatagtcaatattctcactgtgattttttgcagtgctttattttctaaaaatgtatctttgtgtgactacaattcaagagcattgtactcttaagtcagtgagagtggagaatgatcagtgatggttatagtttgttttatcaagacagctcgtgggagatggtaatgggaattcccctagctacttttgtttatttttatctcccttgtcattttcaatatggaggatttatgtggggaatttagtgttattactttaaaattgatcttcagaaagataaagcaaaaatcatttggggtttggcaaaacattttattagaaaagaagagaaaatatttccagcaaatacgtgtagtagaaaccctcttggcttctttaccttaccatatgttgataggctagctgttgttcaaataatggcatgaaactactagataattgtcattggaaggataaatgtgccaatagaaagtagctgccctcaagaagcataaaacataagacacagcatggtattggtataaggcattttaagagcactctttagacaagtcattttgataatataatggggacattttgtcacatcttaaatatagttttttaattgcccaaggagtctcaatctattcctgagccttatccaaatggtatttttctacttagctgcctcagaatgcttcaccttgtcatcatagctacccaaaagaatgtgtcaatctcaccagctattcttttgaataaaggaaaataaactgaagtggcagtccagttttgctagtggaatgaagattgtattttatacatattaaaaagatgagttataatttctcccttaaattatgtttgttgccttgcatgcttctttctctaaagctgaaccatgatactaagtgcctggggaagggaagggcgggtatactgcccagaacacaaaggccttgttttgcttttgcatctcaaagccaactcttttgttctagtcttcagcaaagaaattattttgaaatattgcctttgttagaaagaaatagatgttctgaattatgtgagatctattaacatatcaagaagtaagctagcatcacagaattcttcatagtgtagatctaacactctttctatcatgaagggtgagccatgtttctctgggaagaaaagacatgtgatgtaggggaggtccattgagccactcctcaggaattatttataaaaaacagagagaagttgaagcagaactttaaaagctgagcttatgtctgaaatgcactgttcaaaactaaaaggaaattaatttagaaatgactgtttccaaattgaatttccaaatgttaagctagttcctcaatcatttctgcctcagactatattttctttgtactcttgaggataagtaaattgtaaatcactatccccttttacagtgatgcagtatgaactgaggcaagctgttctgtctctggtttctgattattttaatctgtaatatgacgtgtgtgtgtgtgtgtgtgtgtgtgtgtgtgtatgtttgtgtctgggtctgtctgcttgtttgtgtttgtttgtgtgtgtgtgtttactggatgtgttctagattatcttctttgtattagttttcttgggctgccataacaaaagctcatagactcagtggcttagacaacataaatatactttctggaagtccaacatcagtttcttctgggttttctggtaagagctctgttactggcttataaatggctgccatcttatgtcctcacatggccttcccttggtgccttactgcacgcaaaagaagagagcttgagctctctggtatctatctattcacatatttttttttagacagagtcttgctttgccgctcaggctggagtgcagtggcgtgatcttggcacactgcaccctctgccttcccagttcaagcgattctccttcctcagcctccagattaactgggagtacaggtgagtgccaccatgcctggctaatttttgttattttaatagagacggaatttcatcatgttggccaggctggtctcaaactcctgacttcagtgatccacccacctcccaaagtgttgagattacaggcatgagccaccactcccagacatctattcttttaaggataccagtcctatcagaccaaggcatcatttaaccataatttaaccatctcttccttagaggcaccatctcccaagtatagccacgcaagaggttcggacttcaacatacaaaatttggagagcctcaaacattttgtctataacaccttcaaacctaaaattttgtattcaacatataacatgacgttaagtcaatcccatttttatatgatcaaattggctataaatagcatctatgtctaagttcaaaaccttattaaaaccttgcctgcctactaatgctaagtgcttgtgttttatacctttacactctatactttcactattatgtttttcaaatttataactagcagaatcaaacttacaattgctaaaggaaagataatttaatggagagattcaggggtatatcaagacctaaagctctctttcctaatttgtactttattcctttctctttgaacggatattttctctgcactacttataaagatggcagaaaatgacaagctcgtccatgagcctacattatctcccagtcatagtgcctgtgatcacgtcactgatgtctattgtctttgtacagagggactgtgaaggtacacaccaggggttcttcctggcacaacctctgtgtagatagaggtgacaaaaacaaggcaacacaaccttggagatccatcatgctgctggaggagcatttcctggggaaaaaaaggagtcttactgcaaagatactttatactctgcccattaaaattgcactggatttgattaatgatgcaagtttcaaattaaaaatgaaattaatttgtagattttataattgataggtaataactaatcagatgtagtaactgctctataatcataaagtgtgcatatggaatgacagatcaattttcatcagtgtggtcttattgatattttaaatttattttgataaatctctaaagcaataaaaacattttgtctgaaacatttcttaatgactactctgcacagaatgtataatatgaagtaacttaattacttttgaagaaaggcaaagttcactttcatgtaattttagaatagggataaaataaactttttcatattaatgaagaactccattacctgcccctaaaatgattaaaccttgacataagttttcaaatttagcttcattttagaataataagaactagaaataaatatatttataaactagatgataactatatgcagcaaggtttctttgaatacagtatcaaaattcctggttatagaaagcaagccagctaaaattcaaaaggaatgcaaaagccataaaataaaatagccatttaaaatatttaatgaagtgtgaacaaagctcatgtgctttaaattgctgtccctttcattaatttcttctctaaagcctaaacaattaagctgaaatgttagaaatcatcacaaaatttaaatagcactttggggaatgatgtgttttgaaggaggtgttattgcataagaactgcaaacatgaaaataattttatctcatcacagcaagttagatgcgtgttctatatagaatggtaaaaagagaaaaaggaaatgttaatgcaattacaggcaacaggaaccattacaaatatgcatgttcttataagagaagctggctaatacaggctcctattttagaatctcagagtttttaaaatgctaaatgaagttgataggaaaacaaaataggtacaacatatccaggtgacttttttaaacctatctctgtggttactactgtgccactctattctagagaaaaacaagtaaattagcttgctcttcttaaaaacttttaatggtggaataatataaaaatgtataaaaattgaaggaagttgtccagcatgaacaaatgctggacatttgttcatgtccagcattgccagtaaaaaatattggcatctaaaatgtttaatgattactggcaaagattagagaagcttctctcaggatgggatctgtgggtctcctgccactgccttctccctttcaatatggtattatgcttagaatgtttctcagcactttattatttaggaacatttatctactttatgtggattttcaatatttttgtttctaaaatttagaatattattgtaatcagcctcagtggtcgactcacttatttactgctctcctggacatgtgcatgggtggctgtcccctccactcttcagtttcctgtttcctttgttcagaaggagctttcctggtgccttcatctagagcagcgctagagcagcactgtttctcgcgcctcttccttgtgctgtgctattattccttatgttgctcatcactactttagctgagttgtgaatctgtttgtttatggcatgtctcctccattagaatgtaaactccaagagaacagggaactttaatctctttcccactccctgttcaatatttagaataatgcctagtaagttgttgttgctcaataaatctttgctgaataaaaggctaaataagtaaatccatatcatcgatttgaaattgcacatttgtcatatgtctatctgcatgccgatagtttttagagtctctttttctttcagatctatttttgaatactatattgtgttcatcaatattactttaaaatacactttcatacttaaaaaagcaaagagcaaggagctcctcatttccttgccacttcaaatacattctgactattctatatttattttccaggaggagctttagaataaatctgtcagattccaatgaacctctcattcattaaactaaatttataaatgaatttgcctctttcaatattgtcttctaattccagatcaagactagcattaccctttttctcatttatttttatgtctattggattagttctgtagttttctatgtaggtcttttgcaattcaagttaggatattgttatgatgttttttctactttttaatatgatcccttttacaatatttttctctgactatagaaatatctttattttaagatagattataactgatcacctaatcaaaatctaatttaaatacataattttatttgtctgttattctttcaagatagactatcataccaaatgttggtaatcttgctttctcttttctaatttttagatttttaattttatgtccatattgaaatacattggaaaggactcccagaagaatactaaatactaatgatgatgacgatgatccttgttttgttcctgacttgaatgagaatgctactagtgttatcaatacacataacatacatagtcctggctattagttggtgggatgaacaaaaaaatacacaaagattcagtcaaagataaggatatgaaatgattatcttttgttctacaaattatgtatttgtgctatctttgttaagttttcctttcagaattctgttgattctgcaaaataaattggcaagaatcctaaccttggatggttttaatagtatataaacattgacagcttgaaatttggtctcaatctggccttttgaggtaagaaggtgtaattctttggtaattaaaatcgtccacctttaataatatttaatgcacacctcttttaaattaaacgatgtttactagtgtggcattaagcaggcaggacaattacctgaattttctaattactttttgttggttgtggggtaagatgtctttagtgaagtattttcatcttttgtagtcagcacatatttccagcctatcgttctcataattggatgttgattttttcataatttcttccagttcctgtgtcattgtactgttctgaagaaggatagttgaatgtcagattccaccatcttattacactttagattgaaatactctctaccagatagttctcaaaatttaagatattaatctgttgttcatatttttagcattgatgaacttttcttctctaatttgttctttttagtcattttaatcagtttctgagaatggatcaaatgagggaaaaaaaacagtgtaaacttacaatttaccctatccttcttggatatcagtatatgatatgatatattaataacataaatcttatatgatattaatacatcttataaatcaagtggaaaaacatatcctgattcacaagtgatgcaaaaagttcttgggatatagtataaaataacaacccaaattttctcctgtaggtaatttatttttcatcaactgagttcaagatatgacaacatttcaagttacataaatatattcctcaagcatatctagcagatttataacactgtttttggaaaataaatgactaataagtttatcacctctgagacttagtgtaatgattgctactacattctttcattttctgtttctcttctctacaatcttttctacaacccataatcacacttaaatactcttaccatttgcaaataaacaagtggatgagcctttccctaatgcatctaccccacttctactgctgttctatcttccttctcttttctaccacacctcatcaaagggagggctgcttctaaagtcctaaagtttgactgctgctcttgccattgcattcaagtctgccccatctagccacaaatacatttccagttaccaactctgttttatgtttattgtcatcagacttcctcagctttagacatttgccattgtttatagtcctatcttttatgaaattctctcttctcattacttttacagctattaaccttcccacatcctcctcaataatccttccctcaaagtctttttctgtcaaacctcttctgcccacttctcaaatttttttttaactactattatgttgcacatacagagatacattatgttgtacattctgtcaactaaatattgctgtctttgtagtctgtggtcatcctaaatttaaaacacctgtaaaaaaattcataaattcatattctctgcttctagtcactgtttctcagttcaattaaggtcatcaatttcactcattatctgaagctgaaaatatcagaattacctaaaggaggaaacttgatctccttagcatactatatatgaccctctagagcctgaccacacactacatttccaggctttctgtcaccccagcctcactgcacattcttatcatgctcttccagtcttcatcctcatgcattcttacacatcgatatattttactttgttcttctcttgtcctgaaacgaattttccattcttctatatatgaaaaaacgttactcagacattagattgcagttcacatataatctcatcctcataattggcattttgttctctatgatccaccattcttggacatgttaccattttagaactaattatattagtatttattgttactgatgcctttttctctcttctccctactcaccccctgccccatatacacctgaatgtgctctttgttagggaaggaataatatctaatgtgatcgtattatataaacaacaaagttttgctaaataataagcataaagaaggatgggggaaaggcaagcatttattcctataggttactatagactaaaactttgactaatctaatactgattttgattgtatattgtatcaaacacgacatattatggttgtctgcagcagtataaatagttttctagggctaagttttaatgaatttgtattctttgaggtttcatgactgtcagtaaccagggacatccctgtgatattttggatagtagaaggatcttattctgcttaaaatgtggtacagaacattccacaaaatagataagtaaatgaatgaattatgaggatgaggatatggaaatcctcaaaagagcttaaaatgttcattttatcttcatatctctataatgtaagctgttcaaatgactttaaaaagtcattaagttaaaactaaggacatggtaggggagaagtttgttaaagtttgccactgtgttggtaagaaagccaaagatgagatctcacactccattttctggctctcatcagtccgtcttgctgctaaatgcatgctgagttattacttataaaaaagttacaaatggcagtaggttaaggaacataaaggaaaaaaatgtcaaaaaataggaagtatcagaacgtttttaaaagttgcttgaactctgtcctgggagcagctgttactaaggctccaacaggaggaaaagatgttattagcaaaaaaaaaaaaattacaaagttctaaaatgtatagaatatgaaaggtgatgtagcagccgtggcactattattgtcagacttggcaacaataccccagaagtctggaaaaggggaaaaaaaaggttcaaaatagcatcctaaagataaaatgtttaaaaatacctcagtgggactggagagaacaaaagaccaaagatgcatggggtaggagtgtgcagacgctgccacagtgctcctataagcacatcatcccagtcagggaagcatgcgtggcagcctgaggaggtggcagtgacaaagttggatttcactgagcaaaggcaaaaagcttgtgcattcagaaacaagatcaccagtgatgcctgtggaacccgcagagctgtgtgaacggggaactcagggcaggatcaggcaggatgtaacaaaaataggattgggtaggatgagtgatgagtagatgaagttgaaagtcagaagtacaggaaaaaaatagaactcacctggagtgttgtttaccctttcatccaatgaaagaaaatggctacatcccatgtcagaaatcccataaaggaataaagactcagtggagtaattgtccttttacatagcagaatctgtgggtctgaagctgctagtctccttacttctgtctctatctcctgcaccagtggggtcacaggtatgctttctagccactaatgaaatatccatttttatcttttctccagagcagtcagcttacagggtggccagattataagagaattaccagaactccgtggctgaagtaggggaagagatgagggaggactcaaaataacacttagggtgattatgggggtgactgtgataggttgggtatagagggaatgatctcatcgacaccctgatgtgcttagagatctcttcattgtcagatcttatggctcttttcttgccttagttctccttaatatttctgtagcactggacacccttacctaaacttttccttcttgaaatgctctccttttctatatttcttggtatccgattttaagttccatagggcagtgatcatgactgtcttactcaccacagtacttcacagaatgccttcctgcttgcctgagtggatgaatacatgaatgaatgaatgaatgaatgaatgacagttgagccatcttcctcactattcctttctattttctctgacacctaattttcagcttactcaagttaacagatttagctagcaatgggtttctgggaaagaaaaaataataaagttatcgatatacaattttgcttgcaggtgtgtgtctgtgtgtgtgtgtgtgtgtctgtgtgtctgtgtgtgtgataagaatttacgtagactctctacctaaagtatccctgctatatgactgtgtccaaaatgtatgtctccaacaaaagtggtcaagtcacctactgaatatagctatgtacttttaattaactgttcacagtggtcgttctttttcttcaattcaattttaagcaatttgaggaatgaggctaaagatcatttttctttttttttcgattttcctttcttttttttaattattattatactttaagttttagggtacatgtgcacaatctgcaggttagttacatatgtatacatgtgccatgctggtgtgctgcacccattaactcgtcatttagcattaggtgtatctcctaatgctatccctcccccctccccccaccccaaaacagtccccagagtgtgacattacccttcctgtgtccatgtgttctcattgttcaattcccacctctgagtgagaacatgaggtgtttggttttttgtccttgtgatagtttactgagaatgatgatttcccatttcatccatgtccctacaaaggacatgaactcatcattttttatggctgcatagtattccatggtgtatatgtgccacattttcttaatccagtctatcattgttggacatttgggttggctccaagtctttgctattgtgaatagtgccgcaataaacatatatgtgcatgtgtctttatagcagcatgatttatagtcctttgggtatatacccagtaatgggatggctgggtcaaatggtatttctagttctagatccctgaggaatcgccacactgacttccacaatggttgaagtagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggtcagtgatggtgagcattttttcatgtgtcttttggctgcataaatgtcttcttttgagaagtgtctgttcatatcctttgcccactttttgatggggttgtttgtttttttcttgtaaatttgtttgagttctttgtagattctggatattagccctttgtcagatgagtaggttgtgaaaattttctcccattctgtaggttgcctgttcactctgatggtagtttcttttgctgtgcagaagctctttagtttaattagatcccatttgtcaattttggcttttgttgtcattgcttttggtgttttagacatgaagtccttgcccatgcctatgtcctgaatggtaatgcctaggttttcttctagggtttttatggttttaggtctaacatttaagtctttaatccatcttgaattaatttttgtataaggtgtaaggaagggatccagtttcagctttctacatatggctagccagttttcccagcaccatttattaaatagggaatcctttccccattgcttgtttttctcagctgtgtcaaagatcagatagttttagatatgcggcgttatttctgagggctctgttctgttccattggtctatatctctgttttggcaacagtagcatgctgttttggttactgtagccttgtagtataatttgaagtcaggtagcgtgatgcctccagctttgttcttttggcttaggattgacttggcgatgcgggctcttttttggttccatatgaacattaaagtagttttttccaattctgtgaagaaagtcattggtagcttcaaagtgatttttcttttctttaccccttaggaactaatacagagctgatcagtaagtatttgctgattaatcaattgctgggaaacaggttacttattttagcttaaaaattatttactgtttgagaaaattgtatttgctttcccttaaattcaggcaaataaatagactaaaaccataatcaggtaccaggaaagacactgacttgcctctattacagtacttctggaattcaaaggcctgttgtgctggtaaagaaggctgtttttaacagtatttgcttattcaactaaaaaacatgctggatggctcttctgagcttcatactagagataaagtaaggaattcgatagtttgatctctcctgacatgggacatgtagattagtgggaggcaaaatatggttcagaaaccaagtaaatgagatatttacgaaactggagttctatcaatgtaacacaacatatagtaaatggaaagactgaagtcttagtcaattcaagttgccatggcaaattacgatagagtggttggctactaaactacagaaatttatttttcacagttttggaggttggaagtccaagataatggtgacagcatggttgggttctggaagtgggggcttgcttcctggtttaccgatggccttcttgctttgctctcaagtggtggagagcagagagcggaagcaaactctcatgtccattcttatcacagcaccaattccattcataagggctctgccctcatgatctaattacctcccaggggatccacctcataataccatcctattggggattaatatttcaacatatgaatgttgcaggggtcccaaacattcattccgttgcaacttagttagggttttcaagaagcacctatttaggaagataacattaaagttgagacttggagggcggttccaagatggccaaataggaacagctccagtctacagctcccagcgtgagcaacgcagaagatgaaggatttctgcatttccagctgaggtactgggttcatctactggggagtgttggaaagtgggtgcaggacagtgggtgcagtgcaccgagtgtgatccgaggcaaggcgaggcattgcctcacctggggcaaggggtaagggaattccctttcctagccaaggaaaggggtgacagatggcacctggaaaatcgggtcactcccaccctaacactgcgcttttccaatggtcttagcaaacggcacaccaggatattatatcccgtgcctggctcggagggtcctatgcccatggagccttgctcattgctagcacagcagtctgaaatcaagctgcaaggcagcagtgaggctgggggaggggcgcctgccattgctgaggtttgagtaggtaaacaaagcggccgggaagctcgaacttggtggagcccaccacagatgaaggaggtctgcctgcctttgtagactccacctctgggggcagggcatagccaaacaaaagacagaagaaacctctgcagacttaaatgtccctgtctgacagcttggaagacagtagtcattctcccagcacgcagctggagatctgagaacggacagactggcttttcaagtgggtccctgacacccaagtagcctaactgggaggcccccccaagtaggggcagactgacacctcacatggctgggtactcctctgagacaaaacttccagaggaacgatcacgcagcaacatttactgttcactgatattcgctgttctgcagcctccgctgctgatacccaggcaaacagggtctggagtggacctccagcaaactccaacagacctgcacctgagggttctgactgttagaaggaaaactaaaaaacagaaaggacatccacaccaaaatcccatctgtacatcaccatcatcaaagaccaaaggtaggtaaaaccgcaaagatggggaaaaaacagagcagaaaaactgaaaattctaaaactcagagtgtctctcctcctccaaaggaatgcagctcctcaccaacaatggaagaaagctggacggataatgactttgacgagctgagagaagaaggcttcagacaatcaaacttctctgagctaaaggaggaagtttgaacccatggcaaagaagttaaaaaccttgaaaacagattagacgaatggataactagaataaccaatgcaaagaagtccttaaaggacctgatggagctgaaaaccatggcatgagaactacgtgacgaatgcacaagcttcagtagctgatttgatcaactggaagaaaaggtatcggtgatggaagatcaaatgaacgaaatgaagcgagaagagaagtttagagaaaaagaataaaaagaaacaaacaaagcctccaagaaatacgggactatgtgaaaagaccaaatctatgtctgattggtgtacctgaaagtgacggggagaatggaaccaagttggaaaacactctgcaggatgttatccaggagagcttccccaatctagcaaggcaggccaacattcaaattcaggaaatacagagaactccacaaagatactgttcgagaagagcaactccaagacacataattgtcagattcaccaaagttgaaatgaaggaaaaaatgttaagggttgccagagagaaaggtcgggttacccacaaagggaagcccatcagactagcagctgatctctcggcagaaactctacaagccagaagagagtggggaccaatattcaacattcttaaagaaaagaattttcaagccagaatttcatatccagccaaactaagcttcataagtgaaggagaaataaaatactttacagacaagcaaatgctgagagattttgtcaccaccaggcctgccttaaaagagctcctgaaggaagcactaaacacggaaagaaacaactggtaccagccactgcaaaaacatgtcaaattgtaaagaccgtcgaggctaggaagaaactgcatcaactaacgagcaaaataaccagctaacatcataatgacaggatcaaattcacacataacaatattaacgttcaatgtaaatgggctaaatgctccaattaaaagacacaaactggcaaattggataaagagtcaagacccatcagtgtgctctattcaggagacccatctcacatacagagacacatataggctcaaaataaaaggatggaggaagatctaccaagcaaatggaaaacaaaaaaaggcaggggttgcaatcctagcctctaataaaacagactgtaaaccaacaaacatcgaaagagacaaagaaggccattacataatagtaaagggatcaattcaacaagaagagctaactatcctaaatatatatgcatgcaatacaggagcacccagattcataaagcaagtccttagagacctacaaagagacttagactcccacacaataataatgggagactttaacaccccactgtcaacattagacagatcaacgagacagaaagttaacaaggatacccaggaattgaactcagctctgcaccaagcgggcctaaaagacacctacagaactctccaccccaaatcaacagaatatacattcttctcagcaccacaccacattcattccaaaattgaccacatagttggaagtaaagctctcctcagcaaatgtaaaagaacagaaattataacaaactgtctctcagaccacagtgcaatcaaactagaactcaggattaagaaactcactcaaaacagctcaactacatggaaactgaacaacctgctcctgaatgactactggatacataacgaaatgaaggcagaaataaagatgttctttgaaaccaacaagaacaaagacacaacataccagaatctctgggacacatttaaagcagtgtgtagagggaaatttatagcagtaaatgcccacaagagaaagcaggaaagatctaaaattgacaccctaacatcacaattaaaagagctagagaagcaaaagcaaacacattcaaaagctagcagaaggcaagaaataactaagatcagagcagaactgaaggaaatagagacacaaaaaacctttcaaaaaatcaattaatccaggagctggttttttgaaaagatcaacaaaattgatagaccgctagcaagactaataaagaaaaaaagagagaagaatcaaatagactcaataaaaaaatgataaaggggatatcaccactgatcccacagaaatacaaactactatcagagaatactataaacaccactacgcaaataaactagaaaatctagaagaaatggataaattcctcgacacatacaccctcccaagactaaaccaggaagaagttgaatctctgaatagaccaataacaggctctgaaattgaggcaataattaatagcttcccaaccaaaaaaatccaggaccagacagattcacagccgaattctaccagaggtacaaggaagagctggtaccattccttctgaaactattccaatcaatagaaaaagagggaatcctccctaactcattttatgagggcagcatcatcctcataccaaaacctggcagagacacaacaacaacaaaaaagagaattttagaccaatatccctgatgaacatcgatgcaaaaatcctcaataaaatactggcaaactgaatccagcaacacatcaaaaagcttatccaccatgatcaagtgggcttcatcctgggatgcaaggcttgttcaacatatgcaaatcaataaacgtaatccagcatataaacagaagcgaagaaaaaaaacacatgattatctcaatagatgcagaaaagtccattgacaaaattcaacagcccttcatgctaaaaactcttaataaattaggtatcgatgggacatatctcaaaataataagagctatctatgacaaacccacagccaatatcatactgaatgggcaaaaactggaagcattccctttgaaaactggcacaagacagggatgccctctctcacagctcctattcaacataatgttggaagttctggccagggcaatcaggcaggagaaggaaataaagggtattcaattaggaaaagaggaagtcaaattgtccctgtttgcagatgttataattgtatatctagaaaaccctattgtttcagcccaaaatctctttaagctgataagcaacttcagcaaagtctcaggatacaaaatcaatgtgcaaaaatcaagcattcttatacaccaataacagacaaacagagagccaaatcatgagtgaactcccattcacaattgcttcaaagagaataaaatacctaggaatccaacttacaagggatgtgaaggacctcttcaaggagaactacaaaccactgctcaatgaaataaaagaggatacaaacaaatggaagaacattccatattcatgggtaggaagaatcaatatcctgaaaatggccatactgcccaaggtaatttatagattcaatgccatccccatcaagctaccaatgactttcttcacagaattggaaaaaactactttaaagttcatatggaaccaaaaaagagcctgcattgccaagtcaatccttagccaaaagaacaaagctggagtcttcacacttcctgatttcagactatacttcaaggctgcagtaaccaaaacagcatggtactggtaccaaaacagagatatagaccaatggaatagaacagagccctcaggaataaagccacacatctacaactatctgatctttgacaaacctgacaaaaacaagaaatgaagaaaggattccctatttaataaatggtgctgggaaaactggctagccatatgtagaaagctgaaactggatcccttccttacaccttacacaaaaattaattcaagatagattaaagacttaaatgttggacctaaaaccataaaaactcgagaagaaaacctaggcaataccattcaagacataggcatgagcaaggacatcatgtctaaaacaccaaaagcaatgacaacaaaagttaaaattgacaaatgggatctaatcaaactaaagagcttctgcacagcaaaagaaactaccatcagagtgaacaggcaacctacaaaatcggagaaaatttttgcaatctactcatctgacaaagggctaatatccagaatctaaaaagaactcaaacaaatttacaagaaaaaaacaaacaaccccatgaaaaagtgggcaaaggacatgaacagacacttctcaaaagaagacatttatgcagccaaaagacacatgaaaaaatgctcaccatcactgaccatcagagaaatgcaaatcaaaaccacaatgagataccatctcttaccagttagaatggcaatcattaaaaagtcaggaaacaacaggtgctggagaagatctggagaaataggaacagttttacactgttggtgggacggtaaactagctcaaccattgtggaagtcagtgtggcaattcctcagggatctagaactagaaatatcatttgacccagccatcccattactgggtatatacccaaaggattataaatcatgctgctataaagacacatgcacacatatgtttattgcggcactattcacaatagcaaagacttggatccaacccaaatgtccaacaatgatagactgcataaagaaaatgtggcacatatacaccatggaatactatgcagccataaaaactgatgagttcgtgtcctttgtacggacatggaggaagctggaaaccatcattctcagcaaactatcacaaggacaaaaaaccaaacaccgcatgttgtcactcataggtgggaattgaacaatgagaacacgtggacacaggaaggggaacatgacacactgggccctgttgtagggtgggggaaagagggtgggatagcattaggagatatacctaatgtaaatgacgagttaatgggtgcagcacactaacatggcacatgtatacatatgtaacaaacctgcatgttgtgcacatgtactctgaaacttaaagtataataaaaaaaactgaaaaaattatgaagttgaaacttgaaggattaataactagtcattaaaaacaaataacagaagtggagcttgtgggaaaaaaaagcaacctgggtatatgttttgaggcatagaagagaacttgatgtatgctgggacctaagaggacctgagaatgctcaagggaatgatgccacaaggtaagggtggagagatgtacacagcaaggttataataaagctgcttggcattggtaaagaatctagattggatttggaatgtgatgtgaagcctttgagacctttaagctagagaatcacatgacttaaattatgtcttagaaaagaccactctgttatatttctggtattatgggctcaggcagtaaattagaggtgtttgggttaaattgtatgttgagaccattcattttgtgaaagcatgcattctagggttatttggtcttagagcatgttttgcaaaggcatcactgcatttggaatcaagacacctgtgtttaaattatgcctgtctctatgtctatgtaggtgacgctgtgcaaaccactactttagtttttggtttcttaaacactgctagggtggattttatcccaatgactcttaaagtcccttcaagcaccataactatataaacctattcacatatttgtgtgccaatcacacatatattgtgccaattagacctatttagagaatgcccagaaaataaccccaatattgcctacgcctgtctggagacagctaacaaatctctgaacattggtctttgcccatgaaaaaaacagcaatataatttataaatattatgtcataataagtacaggatttataattgagaatgttttactctaattctgattattctgaccttttattcaccaaccatcttttgaatgtccagtgtatatattaactgtgctaaatgccatggctatgtagatagtataagacaaaatatgtgatccttacaagtaactagagaaatgaaaaagactgaaaaagactgacctgggaacatatgatgacaatatactgtgattgttgtgtgaaaatgtggactaagtgtcctgaaaatccaggagagaggcaagcagtttgcctaaggagacagcagtgacgtttataaggctaggtctgtcattttacttcttggctcagtttctccttcatttcaaatgctagatttaggaaagcttaaactgagtagtcttcttttaaaataacatctttactgatatataatctacatactataaaattcgctgtatgaaagtgtgcagttcactggtttttagtttattcacaaagttgtgcaaccttcaccactatgtaattgcagtacattttcatcacctcaaaaagaaaacccatacttattagcaattgttccccatgtattttacacctaatccttggtaaccactaatctactttctgtctctgtggatttgctgaacctagacatgtcacataaatggaatcacacaatatatggtcttttatgactgacttgttttcacttagtgtattagtccattctcacactgctaataaagacatactcgagactgggtaatttataaagcaaagaggtttgattgacttacagttcagcatggctggggaggcctcaggaaacttataatcatggtggaaagggaagcaaacatgtccttcacatgacaggaagagaagtgagtggcaagtgaagggggaagccccttataaaaccattagatcttgtgagaactcactcactattaggagaacagcatggcagaaaccacccccatgattcagttatctccatctggtccctcctatgacacgtggggattatggaaactacaattcaagatgagatttgggtgggacaccgccaaaccatatcatttagcataatctttcaaggttcatccttgatgttgcatggagcatatataaatatttcattcttttttattgctggataatattccattgtatggatataccacttttatttatccggacatcagttgttggacatttgggttatttccacttcttggctatcataaataatgttgctatgaacattcatgtataggtttttgtgtaggcatttgttttcaattttttttgatgtataaatagtcatgtggtaactctatgtttaacattttgtggaactgaaaagccgttttccaaagtgactgcatcactttataatcccacaggctatgaatgagttatctaatttttccacatccttgccttgtcattatcagtgatcttgattttagctatcttagtgggtgtgaagtgatatctcattgtggtttttatttgcaaatcgctaatgaataataaggtcaagcatcctttcatgatatatcctctttggagaaatatctaatcaaattccctgcctatttcttttccggctcagattttgtattaggttatttctctttttattattgtattatattgttaactgctagagtatagaaataaaagttgaatatcccttagccaaaatgcttgggaccagaagggttttgcattttgcatttttttttattttggaatatttgcatatagacaaggagataccttggggatgggatgaaagtctaaacatgaaattatttatatttcatatacacattatgcatatagcctgaaggtaattttatacaatatttgaaataattttttgcatgaaacaaagttttgcctgcgttttgactgcaacacatcacatgaggtcaggtgtgcaattttccaatgtggtattatgttggtgctcaaaaagtttttgatttttgagcattttgaatcttgaatttttggatcagggatgtccaaactgtataactgattttttgtatattgatcttatattcatcacccttgctgagcttgtttattaatcctaacaagttatttgtggcctgcttagaattttctatatagaagatcatgttatctgcaaataggaatagtattctttgttgctttccatcttttctggatatcttttatttatttttcttgcctaacttcccagcctacattctttagtacaattttttaacagaagtggtaagagcagacaatctggtcttgttaatgtcacaggggaaataacttaatatgtctctgctggccaggcgcggtggctcatgcctgtaatcccagcactttgggaggctgaggcaggcagatcacgaggtcaggagatcgagaccatcctggctaacatggtgaaaccctgtctctactaaaaatacaaaaaattagccgggcatgatggcgggtgcctgtagtcccagctacttgggaggctgaggcaggagaatggcatgaacccgggaggcagaggttgcagtgagccgagatcgcgccattgtactccaggctgggtgacagagcgagactctgtctcaaaaaagaaaaaagtatattaggtgcttctcatagaggacatttatcaaattgagaaagttctattttagtttactgattattttattatggaagatttggggttgtttcaaatgctttatctgcatcttttggatgaccgtgtggtttttatcttttattctatgaatgtgatatattaattaactttcagatgttaaaccaaccttgcattcctttgataagttatatttggtcatggtgtacataatcttttttacgtgtggctggatttagtttgctggtaatttgttgatgatttttttataaggggtattggtctgcagtttcctttttggatcatatgtttgtcttttgatgtcagggtagtattgttttttactctccatttcatttatttctgctcatgtctttattattgtcttccttccatttgcttttggtttagtttgctcttcttttttgaattccttctacaagctaccttctgggattttagtatttacagatactttgtttcttggggcagctggttttgaaggctgttgtagataggaagaaaggaatggaataagtgaaagtgaaaatagcataaaacatactgttctttccatcttattcagtatcttttcttgaataattgctccttggattgttgaaagcttgtggttaatttcaaaagttctcaaaaaattgattttgacaaattttgccagtgttcttattgcttttatggaggatataatttttgaaggcccttattttttattctagaagtgctttttttctgtagtcttcttttaactgtatttgacagaaagagaatgatctgcaatattttgaggagacagttgtacatttatgtgaacacaaagtagatgatgatatgatgtagatgagaattaaaattcccttcaatgcttataatagggagaataaaacattctgggtagtcagtttgtgagtatgtaccattgacatgggaccctggcaattcttatacagtgggaatcctgattatctttgctctggtgaggaaatggtaatgtgctaatagacataactaaaatatttcatattattagctgagttcagtccattaaatctttaaaagattgcctcttgagaaaagcgcatatgccaacacaccctgtagggtctactcatgatggcccgtggtatagacataggcagagacaacatgtgttcactacaactgatgtaagagaacatgcttccatctctttctcttagtgtttattccctatttttatccctgctctatcttaatatttacatattttgattcagttattaatacttaaatttcattttaatgggagcacattaaggctgaaatatattgccagtgaaaacagtggtaataataatttgctttttttgtaaataacacaaatgccattatggtagtttgataaaaactatactttgcttcttgagatggtatacagtgcctctgtagatgtgactctttccattttaccaattggatgtgaaagagacaaatttctttattttaaataagaaataatgcacacaatggagaactgatattaaaaataaagtaaggtaaaaacattagcatggtggatgtacacagtgcatcacaatggtggcatttgtttatttatttaaaaatatttcagagcatttattatgtattggaaactgttctggattctagagatacagtagtaaataagaaagataaattctgttaaggaagagtcatgataaatagatgcagtttaattttcaaaaatacttaaggagaaaattttcaaaataaagagaataggggcagggagtattgctgcaacatattgcaataatatgtaggtacccaagaaagggcttaactaagaaagtgacatttcagtaacaacctgaaagaattgtgtgtgagccattctgggcagaaggacatgcaagtgcaatatccacaaaatggaactgtgcctggatcactggggaggcatgtgtgcttgcagcagaatcaagaccaaagaggtttcaaagtggcagatctttattagccaatggaggcactttggattctgctttgtgtgaagtagggagacacttgaagagtttggcctgagaagtgatatgatctgaggtacctttgaaccatatcactgtagctgctgggctaaacaacccataagagtgcaggctagaaacaaggatattacttgagggctattgaagtaatatagatgagaggcaatgactttgctaagggtagtagcagcctaggttttaagtattagttgaattttagatatattttggaagtagaattgaaaggatttcctgacagataaaatatggagtgtaaggaaaaagagtcaagaataattaagtttttttggtctcaacaaacataaaaatggagtttccatttactgagatggggacgacttttaaagaaatggatttatgtgtttgtgtgtgtgtgttggtaggggtggaggttgaaatatcaatagcttgattttagacacgataaatctgaggtgcctattagacatcatagatggagttatagaataggcatttatatacacaaatctagagtttaggaagatgtctgagctggataaatatactgagagttatcaggatacagatgtcatttaaagccatgggctgggaagattaccaaggatgagagtattgggagaaaatagcaatgatcccaggtgtgagccgtgggacatttctccatttagaggctggagagaaaaacaggaaacccagagagtgtagtaacctggaagccagtgaagagtgtctcaaggaagacagtgagcagattaggattgagatttggccatttggttcagcaatatagaaataattgtttgattgagcagatattctccccaagaatgtaaaatttataatttcaaggaattatgtgccatatcttagactatagtgctcaacattttaatagatgttagaaaagatgctgagttggaatgcacaatcatagccattagggaagaaggcctccactggctttttagatgacctgcttgattagataagaaattgactaagaggcggcagtgtgattcctgccctgtgttgatgtatcatggagttgttttaagagaagtgcaaaccttatggctcttactatattttcatactaaaaattccttatgtggtattacttcatatttgaggtatgataactccaaacccataggatgaaaatacttatatgaattttgaatgaaatcagatttgtaggtgtttgtacatgtatacacgtgctgtcagtatagtgtaattggctttcaatttagaagtttatttaggcattaaactgttatatctgagatccctttatagattgcagtcaacacaaaccttggtcagcaaatgaggtcactaatatttactgtgttcacttgccagtgctcaagtgaggatcagataagaaaattaaaaggagaaaatcatgtgacattgtcatgttatgaataacatgtgacaatcttttcttacatataaaaacctttgcaggtgttatagcgatcactatagtaaaacccttttacattttctatttgagggaatttgtgatagagataatgcaaaacatagactaatcaaatgtggatttatattttggatttttgtaatgtaatttgaatggctgtagacttaacattctggaaaattatttcaccttgataatctgactaaaggaactaggaaattatttaaatatattttccctttcctgttcttcttggtttctgtgctgaatcttggctccgtgggaatgtgggtcctatgtctttggagggggatgagagtgatggcattttatcagtttagtttttgaagtctggttaattgtagtttttttccccacataggcatgtgaatttacatatattgtccagatagttggtcctaatgtggtattcaccattgtcttgtaagatccttgaggattgagggcatgtcttgttttgccaagctataccagatattctataactctgagaactgatgtaacaccatcccaaagagcttaggcttcagaggcagaaaactggggttcaaatcctgctctgtcacttccacaacaagtcactcaacttctcagagtgttttcttatttgacaataacagtaattacacttatttggaataacatatcaaagttagttctacatatagtcagttcttactctttttaatatagcagtcaattagtattaattaataattgctactaatactataatgataacattctatgatgcaagtttgtcctaccttctttagaggtactggagataataaggtgtctgcattgcaaaatccttttcaaatagtctgcacaatagccgaagtaaacccttaaaatcacatagtttttcctgcttaaaacctattggtgttatctttgtaaaaacatcttcacttgtttggaaagccatgttctaaacccaagcccttggcccactcagcctctttgcaccatgtaccagcagcccttgccttctgctgctttcttatgccaaagtcctttatgcctcagggtcactgcctcctaggggtcttctcactctccttccttcactacatctgttggtcaattcctgctctccttttatttctccatttgcagtgcacttgatatttcaatggtatttgatggtttgtggctggagaagtcagaaatgttggactattcttcccatgaaattctcaaagaacaataatatatggcaaagaactactgtctctttagtgggatagtgctgggaactcgcaaagagtactttggtgaagcaagttggagaacatggcttagactggataaaagagtgcaagtaagatgcccagactccaacaaggaatctgactgaatttacccacattttaaatgtgagcattcttttctgaaactaaaccctgttagaatactagccactcttttaatatgttatcactgagtacctgctatatgtgatactgtactgattactgtatctgttttattttaattccaagatattccatattcattttctaactaaagttgtagtgaatgtgatagaatagatgattcactcactctctaatttggctacattcataagaacatgcccatagatagataaaagttaatgatcttgccccatatttcatcataaagagttggctcactttagattgaaattgtctcttacttctccctctaagaaggcattctatgtgagaccataatttttttaaacaataatcttaataaatgtgtttccttctgttgaaattaaagaattcacatgtttgtactgaaataaattgttgtttagtgcaaatatactagaagctttcaaaatgtgattataggggctttgggtattgaagctgacagttgttgatgaacagtatttgccagtgatatactcaatttggtatacaacaactctttaaacatttatcagatctatactattttccatatgcttggagtatacaagggtaaatatgatgcaatccctgtccttgaggtccttatctagatgaacagataatagcagcagcatgtagtaagttatgtgtaaaacttaagcccagtatacctggtgcacgaagaaagaacacagtgtcagttggggttatatttgtcttggagtagtaataacaacagaataccccaaataacaagatcaaaatttatttttctctcaggtctaacaaggtatagtaggaattgtgtggtgcctcaccaggtccagagctcaggcttctctcctgtcctgttactctcctgtttgtggctttcattcccaagttttctcatggtcccaagtggctgctggtatacagataggtctgcatggagccatcagaaagcaggaaggggagaatgcagaattcaccctcacctttgaggagtaagtcccagaagttgtacatagtacattggcacgtatcccattgactaaaaagtggcccatggccatccatacctgcatatactgagagtttgaaaatacaatttttcttccaagcagttttatcctcaagtagaatgataggttatcttgttatgaaagagagaaagaatggatattaggggacaactaagtataataaaatcccacccagctaggagtgaaagtgaaaagaactatgaagtgttaataataaaatgataatattagtgtgtgatgttttaactttaagctatattgttttccaaaaaatatttacagaaaatttatagtttaattgaaaactcactgtaacttgcagccattgacagcaaaacgtttaagttgtttacacataaaggtggagcatgctgcaggggtatcttagcagttctcccaacaagatggagtcccctgttccccttgttcaaacttgggcgttatcattattatatttgccaaattattacatgtaaatgtttatgtgaatgtgaaaaacttataaggagagtaggtgatccacctttctaacatattctaatacattaggtacatttatattacatatttgttgtagtatagaagaaaaatattcaataccttagtgtatggttgttaacttcagacaaaatatgtaacctcattaagcattaaataattaggcaattagtgtcttaaatgctttacattatgcagaaaaccttggtgaattgttaagtatgtttaagaagattttagtcgtgttcgatgaaattggtttgagatttttggataggctttaaactctttatcatttttttcccatttaaaatattgaaacaaagactctctctatctgaaaacttactatcaaacccattttctggaacatattaggtgcaaataaagaggaatgcctctaatgaatgaatcctaaagcaggaggacacagtggggaggagactgactagaaaggcagaggctttattcataatgtattcttaatgtaatatgaatattgaaagatgatttttataagtgacattaaacacacacatccagatacacataaatgtacagattttagtcctttcattcccttacctttgactgcttactcgtgcatgagttctccatctgtggaaacagttgagaattgcaggctgtttctgtttggagtgatttttgaattattttgctttctacagagaaattcaacaaaggaaaaaaatagtcatttaatcttaactgggaagcttttcaatgtgatttaaattacccaaatcatgcaaaagactcatttacactctgaaagagcaagaaaaatattgttaaacgtttgatttgatagctaacatatacattttaggtctgatttatgatatagaacagtgtcatacttacgtgttgtaaataaatagcacagtagctttctaatgtaattgaagtttttaacacacttgatagttttaaataattcatatgtaattccaataacttaaattgttacaatattttgtagttgtagggtttttttgttattaaagtatctaaaattcactctcaagaaatctagatttacatatatttcctgtaggaaaatgtgtccttatttgataaaactttttttctagtcaatgtttaaaaaatagagaaagagaaaaactttcagtaagtatgatgttatttgagatatgggagacatagctttgtgatcttttttaatttgtaagttttttttcattcccatgctatttgtagctaagtcaagaatttcattgatttggattagacagaattgttacatagtatcgttgtactatgcaggtatcttgtttgtgtaaaatattgaaaccaaatttatttcatgctgaatttatagagatatttacttcatagagatatttacttcatagagatattaactcatagagatatttaaataaatacactttacatgtactaaatattatttaataagaatcaagtgttttgcacataatatgtttcagacactatactgaaaattttttgtaagctaacatggaaaggttgactccttcaaagacatgtccatctaggaggagaagactgtgtcttaatgaggtgaaactacaaagctttagtgtctcaataacttatcacaaaaatcagcctataaaacatgattttaatgtactaattagctttaaaggaaatctgcaggtgaacttacgaagcaaagttcctttacttgcctctcaagcatttctcttactacatctctctttctgcctactggttttttattttattttcttagctctttcttccttcttggcttctttgttcctcattgtaatgtatgcccatcttcttctgttcctagggtttctctacaaattctcatttttactcttattgtagttttctctagcaagatgcactcctacttctgaatctaatagactttgactttatcaaaatttacacatcatctcttagtcttagtctcttcatttgtgaaatggagatgccaatcctgacctcataaagttattatgaagattaaatgaaataatgaatgtaaagtgtttgacatatacaaggcactcaaataatatttgttatttgtattaaaatttagctcccaggatttcacctaatatcattgtcaatatatttagtcagcaatggcttctttacattttctcagttttcaggggtctgcagatgatcactaggctacaaataatatctccaccagctttcaacttaataaaaccaaaataacttaaagtaaaatgtaatacttacaaagcctactctataacaagcaaatattgggcactgtcccatatattatcaatttaagtctcatagtactttcctattttttctgaatagaatagtaataaattgaaatttagaacaactgacttgtccaatgtcacataaataatatattaaataatatatagtagagcagagatttgaactcaggattcttaaaatctgtgggtttttttttttttttttttttttgaggcagagtctctctgttgcccagcctggagtgcaatggcactatctcggctcagagcaacctccgcctcctgggttcaagcaattctccagcctcagcccccagagtagctgggactacaggcttctgccaccatacccggctaatttttgtatttttagtagagacagggtttcaccatgttggccaggctggtctcgaactcctgacctcaagtgatctgcccgtcttgctctcccaagtgctgggattacagacatgagccaccgcacctggccaaagtctgcgttccttttttgccacgtgctccttatatttgttttagacttttacagacatttgcttctttgagtttggtttttccccaaggatccttctttgtgatggtaagtagggcagcttcacactcacacatagtgtgaagaagtgaagggatttactcacataggtggaagagctgaaatttaaaaacaggttaatctacttcaatgtcctgcctctgctgcttctctaaaatgaagctagtagtttgcaaaatatttatatattgctagataatactcttaactataatgcgatataagtaatataccacacaccattattctacctataatggaatgtgtgtccatactgcacacatagtgcacacagttgcactaattttccaaaataatattttgtctagtagaactcccagttgagttgatggctaggacctttttgtactagttatctattgcttcactcgcataaattacccctaaatgtagtgtctcccaacaactataatcgtctcttgtatctcatggcttctataggtcaggaatttgagaaaaatttctatgagtggttcaggcttggattctttcatgaggttacagtcagatgttagctgatgctatattcaactaaagacttgactagtgctggaagattcgcttccaaagtgattcactgatatgactggcaacttggtgctagaaaaggtcatccttctacagatggatctctccatggagccacttgtgtatcctcccaagatggcagctaacctcctctagagcaagaaacccaagaaatcaaggcagaagctgcaatgtctttatgacccagacttagaaattgcatactgtcacttacttcatattttattagccttacagaccagccctgcgtcaatgcagagaaggcctacatagagcccgaattttacaggtgtggattttcagtggctatcttggaggttggctaccacatttcaagaaaaacagcaacattttattatttgttcagcatagagaggcagtgtattgggcctgaaagagcacagatgttgaatctgatggctctactttccacctcagatttatcacataccagctggtggcctatagtatattatatctaaattcccttttacaaaactttggtgattctttattgtcaattgaacaatgtataaacaccatagcctggcattgtagactcaaaaattctgtgcctaatgtattcttctcccccagcaccgcccccccccccaacttttttttttcaaactattctttttgactagggaagaatctaccaatgtggagtccatttgggtttttggaactcttcaaacctcacaaattatgtaaaataacatatataggaatatgtcctttgtttctagagaaatttgcccagatgttctaccattcctttcttctaggaacaacttaaatgaaaacttatacatgaaaaccttatctaatcaacagatagaaagatcatttccaccatcacctcacacaacccctcaaaaaattaaatagtattttgttttcactatgtagtggcactttttgtatactgccttgtatcaccattttataagttcatttcatatctcttcaaaaagcttttaaagcccttgagggcaaaagtcatttctaaattacttctgattctcccaagacttttgatcttctaattcaaataaaaagtgttcatattagaaaatttggaatgtatagaaaatcagatgggaaaatcattttcttccatcatctgcagtttaagctctaaattcagtgagaaaaatgaagaacaatacattaatgaattttaatcatgtgtgcatataaatatgaatgatttaaaatgtactaatatattaatattggcaaaattatttggacaggcaagactttttttattgtgtaatgtgaccccttaattttctatgcattctaagaccaaactggcattcttctggtttattggctgctacgcaaactcaatcttacatcggaaatagatgaacccggaacctgagcccaggaggccttgtggttcattagcctggaagacttgaattgccaaataggtcatgtggccctgtggctggggcaaacaatttttgcctctctgaaggggcaaccactagaatgagctatacaaaatgatcaatttgaccacatctctaccaccaaaactcttaaaaattaatatgacacatataacaggtacttcttgggaatgccctcagagaatgtaaataatatatatatatcaaagcagatttattatttgctgataacaatctaatataaatattccctttttacatgacctgtagttctatctccctatcaagttcttggaaatgaactaaaggaatactctacacttagaaatgtacacttgactctctcttcatttaaaacaacagccctaagaaatttccttggtctcagcctctttcatagatagcttcttactgtcataaagttatcacctgagactgtatcccatgctttaattaatccaataacaacagtttcaatttttatgggtttttttaatgggagtataggagaaattagaaactcaaggattatcagatatacattgcatgatttagattttggatacttatctaatagattttcatggtagcatcaataataatagtcttgattgttgtcttttgctattctgttgaggcattaagtatattggagacatccgttttcatttccatgtatatttgtttttgctcagtaagaacagtgtgcaaaattacttatctttagaattcagattaaagaaaagcctaatcaaactgatatgtaccaggttgtataggctatcaaattgttattaaatggagggaaacatattctgaattctgactggatgtgttaagtacaatgattatttgatttagccaagcagtcaacaataattggtcttacctagtaatgcaatattaatttagtaaaaagaatcatgtagcccagtgcaattcttaacacttttgtcataatatttctaatgtaacatttctaaaagaatatctcataagaaataaatatttagttatgtttgttaaactagtaaatatatagacctaagaagtctatgtaattatttggttactataacttaactatgtagatatttcttgtaaatatttaatttttaatatctgtaacaacctaagaatttgaaaatatattttgcagtgtgaaatttcatatataatttggaaatctagaatctgccagataggccaacaatggaagctgagtaatgtttgacagtcttgtcctaaatcaataccattttcaacatgatggaaaatgaaatgcttcctttttcagcttctgcattatcacattggtgatgagtcaacacacctttctaccaaactccctgctaaaaagacaaacgaaagcatggatgtctttcagttattttagttgaatttccttagattaaaataggatatttcttaaaatattttagagactaaaagtactcagaagtattcagaatacatatttattttaccaaacatacagactcttaaaatcatctggatgctgaaagaaaagtctgtgtaaagatggagattcaataaacatacatgtattgcgcaccttctgtgtgctcatctttcctttatattctgcagaaccagttggacactagctttacttatagtcagaaatgtgccataatggtactgaagaaaatggataatcaagttgttagacttttgtcttctcatatctgacattaaagtttttattgaagtttaaagagtttgcttggtaaccacagttcatgtaaaaagggaatatggaaaagagttttgcttggaaactctttaagcttcagtaaacaaaatccaagaggaatttttgctttattattttctatgatgtggcttgatcctatcacctctctttctgcattttacgtaccaaagtctcaataaaactattgaggtttttggtcaaatgcagcaaatatttggatcaaatgcagaaaaaatactttgtgatttttataagttagataagtagctctccatataattttcatgttaagttataaataatagtttctacatattatagtctgaatgtgtctcctcacaaatttatatgttgaaacttcattgccaatgtaagaggttgggcctttaggatgtgattaagtcatgaggaattagggccattacaaacgaggctgaatggagggaggtgccttgcccctctgacatgtaaggacacagcaagaaggtgacatccagaaggaacagggccctcaccagacactgaatttgttggcatcatgatattggacttcccagcctctagaactgtgagaaataaatttctgttatttataaattatccattatagaatattttgttatggaagtctgaacaggctaggactttctgcaagttagcaccaaaatctttgaagtagtgagatgaaggtgggagatggaggaataccaaaacatctgtcccatatgctcgaacactctagctcctggcattttattatctccaaaattaagatattaagcaattccaaagatgtagctaatgtaagttactgctgttatatttgttgagtgatgtcatacttaggcaaagcaggtagatacctcaattaacattgtcacataaaaagagaacatgtgagctaatgggaactagaaatggcatatttcaaagaagggacaagatgcatgtagagaacaatctagatacgatttggcctcgagaagtcacatgcaagtaaggacccgagatgccaaaggaagactaaaggaaatcaatgtcaaaagtttattcagggccagaccatgtcatagatatgaatgttctttaatttcaaaatatggaccagtgcttttcaatctttaatgaacatgcaaatcacctcagggttttagctaaaatgcagagtttgattcattaggatgtggtggtgcccaagattctgcatgtctaacaagcttcaggtaatgtgatgctgtgggtctttggactacattttgatgtggctattggttgctaaaattattttacttgattcagagagacttttccctctattagttaataaagagactttatctataattttagcagaatatacttttgaccttttatttttacttaagctgttgtagtgttaggactatcataatggatgtttgaaagtaatgtattaaaacataatggaatctagatgtgttatgttaaaatttataattgcagtgacatttctccatagttttttgcattaatttgccatgtcataggccatcatttatttctatgattataaaataacatgaattttaaaagatacactacacaattacattttaattattataataaacttgagatttagtttttaagtggaatttttaatgttatattcacttttctaaaattttaaatgatgtaaagaaatctttgaattcaaaatccatgtgatctttttaaacaaaacaattatgccatataaatagaaaggcaaaatttaagaaacattactttcaattgctaacttttatttccattctattttcaccaaaatagatcacagatcaaagaaagatttagttcaaactctctttgttttactcttctattgttaggaaagacggcacacaaagtaaagagcacagaaggaattgaaacatactttctatggatttttaactttggttctattatttgtctaccatccctttctaacaaatctcatgtgaaggctttgaggtcttcttgttagaataaaaacaagtaagtaaaataaatacaacacatggcatgacagtttttaacattatatcttgtaattatgaaactttcttttgcaaacctttagtttacctgtgatcactcccatgtgaccaaagattacacagatggtcataaatagcaataagaacaaactataagatgacagcttgaagctacattaaaagaagtgctaaaagaagagatatcacctctgattttctgtctgagggaagtgtggggattttagttccaccacttcctgtatatatttagcagtatataaatgattaaacaatacttctgtcagagcccctaccccattctttatatctcaactcatccacccaagaaagcattttcatttatagcttagaatagcagtttatgcttgagtataatttgctagtgattccaaataaggaagtgttattcttgcaactgggattaaaaatatagaaaatgtttctcaatataggaaagtaattatagaactcagattctcttgaattgatgtaaactaaaatccgggggaaatagttggataggaaaaaatttcatatgagtaaacactcagaaagcaataaaaacaaacctacggcattatggtccagcttctgaagtatgtggtggttaatgccaggcagaggtaaaagctcctctgaatgtcagtatgattcatttgtggtgaaatcctgaaatccttacatttcaacacctatttatttctatttagttctttatttatttattactcaaatatctattacttgaacatttattagatgcatagcaatatactctgtgttattaagggtgagaaaaagcagattagaagagaaaggttttgcctttgaagctgtaataatagagatggaaataataagcatacataaaataattagaatgcataagcaaggttttataatataatgtaaagtattggctttaagagaaaacaatgaggaatatattcaaggaagtcttcttgtagagggtcatactggagactaatgatgcatttatatcaggggaaaggaaggaatgcagagtctaaagaacataagcaaagttgtataggagagagtgagaggtgtgtgtgtgtaggggtgtgtgtttgtggggaggtatgtatgcatggaaatgtgtgcatgtgtgtgggtatttccgtgtggccttagaaacaatgaatcacccgtaattaaacagaaagaatggaatgtgtgagaggactaaaaatacagcaagaactgattcattgtcagttaaaagtactgtcttccacagttgtttcatgtgtgaatttccagactcctcaaatagactttagcttcctggagctctctctgcagtactcacattatactgatatatatgggtttaagtttggcttgtcctagagtactgggctctttcattttagctggaaatgaatggtatctgggagagaagacaggatacccctggcacatcatggatttatatttattcatgagggtttgtttaagaggagttctgtctgtataaatcctctgtaaataaaaatgctctattgcatttcaatcagatttcacccccactccttaagaagaaatgtagaattttaaaaaataaaatgtgtaaaataaattcacaatgggaagcagaccacggaagagtggtatctgaataaaagatcttgtatgtaaaattctatgatctatatgtctgattatttctaccctctatctcacatgaccacttatgcatttattcagaaggatctacgtgcccttatgagtggcataactcctattctcaaatagcatttgccttgtaggggaaaacagacatgtggacacctaactcaatctaataagacactggctatgtgggagtactgaagggtatataaaaagtaccagggagttctaaagaagaaataactagccaggcctgcagggatttatgcagatgggatgacaaaagactgagaaagatttgcagaggagggacactggaattgggtcctaaaagatatgtagacatttttcaggaagtgaagaagaaaatgaacattccaggcttgcctgaccctcccgtttctttgtaactggatgttgcattttccagaattcatctttgtattctttgttcaccttagatctacagttcaaaaaacaaaatcacggctgcctagttaccttctgttcactaaccatccaaattaaagccctcttgacaagttgcatgttacagtatgctgacctcagtggcagtgtggggttatgcgtgggcatcttgcccttattccaccaaataagctcctgcctattgcttgccctaccctgggcatgtaattgttgcatgttaattacctaataaacaatcatttacatctatacttatcacatcgtgtgcctcttttcaaaaacaaatttcagtggtcatctcttccaaaattgccaattttttttccttttagactgagttttgctcttgttgcccaggctggagtagtgcaaaggtgtgatctcggctcactgctacctccgcctcccaggttcaagtgattctcctgcctcagcctcccgagtagctggaattacaggcaggtgccactatgcccggctaatttttgtatttttagtagagacagggtttcaccacgttggccagactggtttcgaactcctgacctcaggtgatccacacgcctcagcctcccaaagtgctgagattacagatgtgagctaccgtgcccggccatgttctttattttgttgtttggcatgaacattcctttctactagcgtaacagtgactaaagaaaaaccattaggaaattaaagaacaactctgagagggttggtttatagaaatttttttaaaaaatattttactgcccatagcctgtttgaatagtaactagtgttataatttagtctttttctatataagtgataatttggtgttgggtaggcacagatgtctacagaatgaggaaaattaaatgataccttagactagcatttctcacatgcatgctcagtggttcataagttctaattattttggttttggttttgtgttttcacctcaaatgagtgattcatttactggtaaaattgccagaaaaaattacaagtacccagtaaaatttaaatttctgataaacaatgaatgatttttattatgtccctaaaacttttagtatgggacatacttatcccttatatagggatgtccctcagtaggacatactaaaaagttattctttgtttatccaaaattcaaatttaactgctgtcctctatacttatttgctaaatctgtcaatcccgcttattaataataaaaagcaaatttctattttgtaaggatgattcacaaatacaagatatttccatggtacaagacctgagtttttttaatcagtatttctcagactgggaaactatggaaatgtgttttgcagctctcaggaattatgttttcctggaacaggtgtggtgctccatacgctagcttttaaaactctgtttttaaagtggtaaactgtaaaattatggaattgcttcctcattatctgagctattatcaagcagatagaacaaatatcaagagacaatagagttctaggaatctggagttgcaagagatattaaatgtcactttgtctaagtaatttttattatcactaagaaatgagccacagcttctgatgttaagtgacttattaacgagttaggttaataaactgagacggatcccaagtcttccagctctcagtctgatgttatacaggtatgtaaatatgaaatatacaggtatgtaaattaattgcataattaagatgcataattgtttggttatttaaatgagcaaattaattgaatacaagaactttgaaatgcttctgtttggacattataagccataataacaatctccaatagtactaattgtttactatattcaactagttatccattgccagttgctgacagctgagagccatactgcttggtttaaatccttgctgcaccaccagcttgctatgttactctgggcaagtaacttttttgttcctcaatgtctttatctgtaaaaagggattatggtaatgatagctacatcaaaggctgtagtaagaatttatgaagatctctgtaaagaatttctaacaatgcctcaaattggtaagggtctaataagaattgcctattattaccttgttattcttcatggtgttgttaatatatcagatacctacaaatggtgagggctgattatttcccaacctttatcagagtatatgtgattaagaatgtgataaaaagctatagtttagatatagatttttagtaattttatggaagactcaaaggcaaaacattcaatgctttgtagggttggtgctttaatgtttttaaagggcattagacccccctcctttaatttagcaacaaagacaaatatccaagtttctgtcttacttccttcagtgataccatgtctgagattcagcccccatttcttctctcatctttttaagattaattagaaaaatgtgcccacagtagaaaattattatttgaatttgtgtgtttatgcaatcctttcagtgactcaagaaaaccagtcctgttaagcctcaggttgccttagtgacttcccaagaggcttaattattcactcatgggaagaagagaaagagtagctttccacttcagttctggtaattccaggtaggggtttataccagcaaagtttgggatatgtttccaaatttagtggctgtagtgtgttaaattctggaaaagccacaggggaaactgatgtatttatctcagtaatacttttggacagaaaagaccaagtaatacttttgaatagaaaggtactttaaaaaaataataatagtaaagtagtactttacctgctttaaatttaactaaagaagtaggtagctgttgtattgttatttggtggattcaaatctattataatactctaaggcacagaaaagctgcatatttttccctgaaatactcaaattcataaaattctgccaacagtttatggcaacatgatccagatcaatttcctttatgttagtctcttagcatgactgtggcaaagagtgaatcattgtgtgttcctagtcctctgtgagacctagggagacctattacttgttgttcttttaagagctggaatttagttaaggagtttcttaattttccaaaagctgtagataaggagaagtgaaatataatacagaaaggcaagactctcctggtttgcagtaatgtcgggaatatctactctggaaaatcatacccattcatttcttcacagaactgtttgtatgtttattcatgcatccctgcacttatctattcattcattcatgcccaaggactatgcaaggcataggagatacaaagacaagtaagtacagttcctgtacccaaagctgctgtttgaaacttataccaaagcctacaaagtaaacagatctacttccatcctcagctctgtaagtctgagtctaaaataaatctaataaaatattggaaaatattttcacttaataactgagctttgaagcaaattataatctccatattagcagcaaccacatatttaacactatatcctcactgtgcatgacatatagtaggtaaatagttgtttaaagaatggagtaataactagatatattcttcaaaaagctttgtgttttttaggttcaaacaagctgaagccatctaaagtgcagagctgttaaagttgtcacgcatgtagagttgttctcaagctagaaatgaaagggggcaacatgggaatttttaatgctatagtgggaggtataacctccactttgcttttagatcaatcagtaaatcttagcctgaactttctcgtagcaaccagaatctctgagtaagtatcacattcataccagaaacaacagctgtgatttgtacatattaaaatgatgaagttctttccagctatcaggcccagaaccctttgccatcaccctttgccattataaaatccttagtgaactgagttatgtatatttacttccttatagcaaaggcggtttggaggttgggggtgggggtggcaggcagcattctattttggcatgtggctgaggtgacgggaggattttagcagctcgtgggtgggtgttcagggagcaggtggcactgggagaaggaagtgactgtcaggatttagtggcatttgggggcgtgtataggcaggcattaaaaaaaagagttggatattctaaaaacactttggtattctcataatgagaaatgtaatccagggcttttgctgttctaaggcacagcattttagtttgtcaccctgtgcagttttaggaaaagagcccaaagggttaaagttaaataagagcagtaaccaatacaaagagtatattaacaaaatacagatgatcccttgaggttttagtttttttttaacagctttattgaggtgtaatagagatatcaaaaaaaccctacgtatatttaatatatacaatttgatgagtttggacatatgtgtagaccatgaaaccatcattacaatcaagatagtaaacatatccatcaccttcaaaagttttcttgtgcccctttgggttttttgttctttcttttggtgtttgtttgtttgttttaaggcagtgcttttgctggtcaatagtaggcttttttatgttcttactttatcagagaacaaacagttttcacctcactcttcctatttttggttgatttgagagacatcaattgcctcaaatgaaatgaagctgtttctgtgtatcaattagaaccacatcaacaactgatgacctttaacatttggtattacttggcatatatgtcctgaactgcacctcgagttgctcatttcttaagatatctgggcactctgacgtgtacaatgaaagcgtttcttcagttattgatctaacctatgatcccagcctctttggaggtatggggagaatcagttttgattcagttctctgttgaacaaacaagcaaaaaaaaaaaaaaaaaaaaaaaaaaaaatatatatatatatatatatatatatatatatataaaatctatgtataacttccccacccccagttttccaaggacactatggaagtcttcagtaaaaaaggttaaacaacagagatatgaaaaacccagatatattaaccacagtgacgttacaaagatatttctagaaatgaatagcaagtctcttttttaagtaggcttttgataatctgtggtaatttgtaaacactgtcatatcaaagccatacaaaagatagtattcaaaatctttgggaaaacagtttttcataattcagtgcaatgtttaaagataagaatacccttcaaatgttcatgtcactttaaagacgtgttagggcttaaacaccttaaatgtagaaattcaaatagaaactgatgtattaggccttaaccactgaacatttataagctcatattgaaatgggaaatagggagttttaaaacaaatgtttacttaaccatttattaggggttatgaaggggaaagaatcaaggtcagttatgcggcaaatcaatggttgtgtggtgaaagtagcgtcagtaacagatagccccaactgcatattttgttcctcaaaggaagagtgttcaggctgcaagtacatcagaaataacaaggatatgtctcgctgttctgcactttgcaagaacctgctgggaatgaagtatccaaggctcttatgtggtttgtgttgggatttcttcaagttaccataatgaggtgttttcctattgccctgaactggctgggctataagagtcttcttgtacaatgattgttttaaagtatctccctcttaggtgtctcctgatgtatttacggtttataacttgaaaaaatatttcttttaattagcagtgataatctgaaaaaaattaaaataggatttcactgacaattcaatattgaaaatgaccttatttgacttttcctaacagttttcaagtggtttttgaatgctcttttgtttgtattcatttcttctccagaaactaccattcattaagggctttccaaaagaagtaccagtatttttcataagtgcaggtgtgaattagcaacatacctgtttcaaataatgttgattgaaacattatagcatattgtcatcattggtgtcaaatatagaaaccaatttaatgattcttatatatttttggcaatgaaaagcaaaaaatatgaggcatatttctcttaatctcacaaatacagagagaaaatgttaatttttttctgaagcagatcttcctttgtacctgacattcattttgacagtatgaagaacctgtgaatggattgatcaaagtgtgttgacattttagtgggttttaaatgattcttggtattcaggcaaggctgatggcttcatctgcaggtgagccatattgttaaaatattgaaacacttccttactgctcagaaaaaggtgcccttcattaaatgcttccaaagtacctctgcctcccaagcaccaagactctctgtgatccaacatccaggggagttttgggacaaaatattttttgtatcggatattctatctggttctgtgatttgggtggagttattggtttgcattttaaaatgtatattcagaaatattaatgggttactattatttttaataccccaaaggaagttttagcccagtgtgtattgtatcagagacacttatctaatacaggtacaatgattcaaagcattcactgtacttaaaaaaaatggtataattaatatggcattctttggtgggcaggcttaataaggcaggagaaagaaatactggatcatacaaattattacaatatttgtcttaacattgttttcactttttttgcataactaaaggctgtaagccagaactggtaacttaaactcacagacactgcaaattagcattgtttacagcacataggtttagctactaacacaaaaaattttttaaataattattttgctactgttaggctctatgatactggatagaaggtacttagtacctagggaccttaactttctcatctgcaaaatgaagagtagaactacattctttctccacttctatactttgtattcttatgtcccattttcccttatgcatgataattcccctggaagactagtgaagatagaacctggtgtccagttacagttttcagccatctgttgtttggacctaaagtgaaagcaataacaggacttaatgaatagtagtcacaggctttcctaggcagcatgatgataatgtgatgtttggaaatgcctgtctagattttgaattctagcatttaggacaatacttttattttacagatgagaaacactatgccctgagagttaagcctgaagtcaagttagacaatttcttgaactgaaatttacaatttgggctagtatatttgggggacataggtaacaacctgaaaattagacctgtactgtttcatatattttgattactattatataaaatatgtaagtagttttaggatgagatgtctcagcaagctacagaatctacaattaaaagaatattagtaccatacactagcacctaatgactaaacaaacttgaaaagctaaaataaatctaaaaaatagtagattgttaggtaaaagaccattttattgtttcactttacttttgtttactcttgatttttctagtattcatttaaatttgaactttaattttataaattcctttcagatgttcaaagatgtaatttattttattaataataatatggtttaaaaaatatttggtgtgtccctacaaccctacaaccccccaaaagcctatttgttatctggcgatcgtttcagatgttttctttttaaattgtcctgcttaccttatagacgatacaaattgacctttaatatttgtttttagagtataatgactgacttcatgcttacagatgcttgtgtgcttatatgtgtatgtgtgtatgcacataggaatacacattaagtagctccagatgggctttatgcacataattattcaattttgaaaaaataaacaaactgaagttctttctgtctatctgtccatctgattggaatcacacttattgagaagacagagcattgcattctggccatgaagaaaaacctgaatacctggctatacctgctaaagtcagccaatgccaacaaattttgtagatttttattcatttttagataatagaggttttgaaaaggctttataagaaagttgtacattgtgaaatcctaaaaagctgtctggatatggtatcaaaagttatagtttttatcttgatgacttaagatgaagggaggatgcttatctattaaaaagcggaaaaatgagatcaaactcttttcttaggttgtatctcaactttagggctttatgaaactttatatgtgtatgaaatttgttttactaatacattttaaattatactgctgctattactctctcttgtctaataagacgtggcctcactccctcttccatgcaagtgaggtctccttccacacaactaagccttcactgaacaaaaaataactatagcatatgcatgagttatcagggagtatggacccctagcattgatgtatatttattactgagcacatgctcaatgctgtgcagacacaaaacacatatcttccttgtatttcatcgttgaatcttcacaataaccctataggatagatactcttcttattttatttaacagttaaggaaacggagacttaataaggtaatttgcctacgtaaacacaactgataaatggcagagcaaggattcacaccaagactgacctaacgccagactccaactctaaaccattatgttagcctacttctccccatgataggaaaattttatttacatttgtatctgagaagcccaagtcttgctttatatttttgtcttcttatagttaaatatttcttggtatcacgaaaacattttttctaaatgagcatattttaagataacacacaatattggtattagttttgtcacaaattgactaaactttcaacccagatcagacactatagaaagctaaagtgtcttgtattaatagtagaaagaggtctctgctgcacactcactacagttgagagaagaaaccctgctgatcaggagctgccctcttatggagaaaggctatggcaacatacttttacggaagtattattccaatagctgtgccttaagatctcacaagtttctactgttacttacaaagattttttaagatactggataaatataaaacagttataaaaattagtcccaattttatttccatgtttaatcaggtcttaaattatatataacattttatatcaatgagtgttcttgaaccacattatgtttaatatttggagaatatttccttgtatacatgtgccgtaatttatttttaaatttctttacccacataccacatagggtgtctccaatttttccaaattactaacagtgctgtataacacttgtactttctctgcatgctgcatttcttttctaagtttttcctctgttgaggttaacatattgtgcttaggatttacaaataaataacaatctgttctatctttaggagtatttctaatggagttgcctttccctttcacattataaatgcttttaatatgcagaccacgataaaaacttaaaaatgggtccccagattttccccaaatgatgtttgaataagatgtaaaatgaccacccacaatacttggccaaataagtattccgtgaaattagtcagtggaaaaagcaatatccttttactactcaaaatgctcaaaagaaatataattttaacaatcagaaatcacccaagagctagcttcagacacttgaattggatatgaaaatgaattccaacttctactttgcttttttagctcttacactacacccacttggtactaattataatttttgccatgtttcaatttatcttagactctgtgctgtataatgctatagtcatagaacttgcatgcacacacacacacacacacacacacgcctgcaagatcacttacatcactgacactgtgaatgcaaataagaaattcctgaaaaggcaagtttctccctgccaaaactatcattcttatgaaataggaaagagaaaaggtatgataaagaaagagaaatgtttatagttgtcatttttatctttctactttaaaatctaggaagaaaatcttttaaaagaaaatcaaacaattattctttatgttttgtatggactgtatgatactagtggaaagttcctgatgacctgtgagtgtgaggaaggaggtcaaaactagaacaacattaaaattggatgttatggcacaatgaaattttatggctaaatcattcattgactttttatcttcttaaggatatgttctgttgagaacatttggtttaactttaaaattctgagtgtgttcctttgagaacattaatttcacagtaaaattgtcaaatataatctgatgttgcttttagtaaatgctaatgtactattaactagacttttttcccccttttctgcctgactgagtacaaccttactttatttactgatgtaattattaattctactcatagcttaaataaaaaggtaactctgaagaagcatggaatcaaaaatttaatgaataaaatttcaaagtgtttattgtaatttatatatacattaatgaagaaaaatttaatgaaacacataaaagaaaagtaaaattacccatgattaacccaacaacccctgtgtgtatattttggtacatatagtccagatatgtatacactgttttgctttgccagctttttctttttaatgatgtaattaacattttaatatattattaaaaatttattaaaggatttattaaaaactggtgtgtatttttctgagaaatcagtaaatgtttaaaaataaataggttttttaattaagtgtggaaaacttttcaaatatgctaaagtaattaaatagacattgctgaaacaactggatatccagctacaaaagaaaacaacaaaaaaaattagacctttacctcacaccgtatataaaaattaactcaaaatggattataaacctaagtatcagagctaaaactagaaaactattaaaataaaacatcagagaaaatatttttgtcttttaattgggtgaacatttcttggaatggccacaaaagcataaaacataaaaggaaaaaattgataaattgtatttcatcaaaattaaaatttcagttccttgaaagacactgttcagaaaatgactgaaaaccagacttaaagaaaaagtttataaagcacatttttaataaaagacatataccaaaaataactaaataataagacagcaaacgacccccctgataatgggcaaaatatttgaacaaacccttcaaagatgatcatggcaaattagcatatgaaaagatgtgcaacatctttagtcaccagagaaatacaaatcaaaaccacagcagcatacccttcatacccactagagtggctaaaattaaaaacacaaacattaacaagtgtggacaaaatcttggtgtagttgagattatcacaggttgatgttgggaacataaaatggaaagctactttggaaagcagtttggcaattccttaagttaaatatatgtttaatatatttcccagcaatcaaactcttagatatttagccaagaggaagaaaaactcacatgtgcacacagatatatatgccaatgttcataacagttttattcataatagccacaatctgtaaacaactcaaatgtcttggctggtgaatgaataaacaaattatggtatatctatactactactagtaagcaataaaaaggaacaaaccattgatacatacaacaacactgacgaatatcaaaaacgtcatgctaagtaaaagaagtcagactcaaaaggctacattctataggattctattcatataaaatgctaagaaaagcaaaaatgataaggtcagaaaacagtgactcggggagagagtgggaattgactgcaaagggatataagggtacttgtaaagatgataatgttttatatctttattgtcaaaatgcatcaaactgtacactaaaatatgatgagtcgtattatattgcattatattttattttattcacctgacataaaaaataaaagacagaggaacactagatccctcttagagattcaccaaacatatttattatcttaaaaactctaagacctgaagaaaacaatttttatttcactttagtagactgggaaatccatagtatttaatctcatggataaaatatattctaagttatttaaaatgctttcagcatttgtaattattaaaaaagctacaatgctattttattaaaattaattagaataaattaaacaagtttaatgcttttgttatattgacaaatgtcttccttaaaggctgtgccaattttcatgacagtgactattgccacagatgcataggacatcgtatgttttaaaatcttttccagctttataggtaataagtggttcttttttattattttcatttgtatttttttactactaatagtaaatgtaaatattttccagatgtttattggccatttataatgttttcattttgaattttttatatatattctttattctttcccctccctcaatttgggtctttgtattatttattggtgttaagtttttttttttaaattgaaaccctttaatttaagatgttatgctaaatttcagtattgttatttttgaaatacatttatttttaatgttttgataacagaaattttcccttacagtgtgtgtgtctttggaataatgtcaaagacataattttcttttaaaaaattatcactgctaatgtaaaagcaaagtataatattttgcttcacagataagtggtttaataattggactgatagtgactgattcagcacttatgtgtctcttttgaactctcaggaagttgttgaactcctgggaccagcctatgatgatattaaccttagtatcaggttttctatttacgtaaccctctggttggttcagaaagtgctgcctggtgctgttctcatatccatcattgtgtgtgtgtggaaaggggttgggaggggagtgagatagggtagagattttattgttgggggaaggtgttgacatggaagaactttgaccatgtttagatgctggagtcaataattcctgaaaagtttgaaaatagtattgctgagaatattgcaggggtccacatccaaacacattaagagggattagccttgattagaagaaaactattgcctactaggccacacagaaggatgggaacggggaaaggtatatttgcaaacaagatgtgggaggacttgaggtgaatcttacccaattacccatgtcatttctatggaacagggcaaggttgtttgctataaattgggggttcagggcaggtgccagttattcatttgaaaatttgtactgagaattggaattttaaaattcatttttgaaaacaaggaattccagaagaatatttcttacttttgtaagaaatatttgccttaaatatttgtttcaagccaatagatcatataaaatagatgtctgcgactattttaacaacttctgctcccatatttatacttctctgttctttaactataagctatagtgttatataaaaaactacaataatacaaataaattaccccaaagaatgctttttgttttgtattaaggaaataaaatttgaagtcatatgactcaggaaagtaaataatatttattaaataaattactcaaatacctttttcactgtaggaagattatgatatacatttgaccaaaaaaagtctgttttactgttatatagcctaaaatgaaatgtttttaatttacagtgtcctgtgtaaagaaacaatagatattttttaaagcaacttcaggtttctagttttagctcctcattgcttttttgtgaccctccaacttgcagattgattttctatttgtgcttctgttgcagttttgagattctttgaataagctcatcagacataactacttagtagagctttatttctgagaagcaccattgtgacactcaacaattccaaattaattcccaatgcaaatcatggaattttcagcttctccatttctttgaaggcctgataaatgctgcagaggagggattctgggctggagtaattctagaaatgatgatcacattagacattgctgagctaccttattttaattttcaccagccttaagcagtttgttaatctgcctgaactaaacaccttgtaatctcaaagctaaagatttaagcataatatatgaaagaaagaagtttaatggaacagagaaacagcttctaaagcatgtagctactagatctataaactgtgcgggctagtttgcagctattttggcctcattggcaatctggaatggaataaattagaggacatacaaataatctaaattccctgctttgataaaatttacactaggccactaaaacaaacaagaagttagtatcaattacatgattgaattaggttacttttaatatcgtcttcccaatcagaaagtctttgttaattctattctctttgtgtggtttgtgactgaataagtcagttggatactgcttgggactattcaccaaaatctttgggtttattgggcagtttgtctttatttgctttctacttctattattccagttagtaagcaagtagtaatggattcaaacccatcactactactagcaaaacaacttatacattcaaaaattatttgcggagtgcttggcacttttctatgtagttggaacacaaactgaacaaagcaaacaaaaatcccactctcatgaagctacattttattggagagagacagaagataaacaaaatgcaatgtttttaagtacgaatggtggacaatggagcacaaagtaagtatttaaaaaatcttcatgtggcaaatataacaagagctattttgactcatagtccaaaaatctagccctgaaccagagctcttgcatccaaagcagaaggatttcccactaaaacatttaaaaattatcagcttcatgggtgtctgagtgcttgctttcttccaacgaagttcctttgctggggcttagccaagatggcctgtgtcctttttggctaacactgtggccttctcctgagtcctgagccaaaagcacagtattctttaaagctgacaataatatgttttcattcatcagtgactttcagaaaaaatgtggactaaaagttgccttctcaagagttgtgtgataacatctataggatgtagaaaacaaaataaaatagaaaaaaaagtttgagaaaagacaaacctgaatctgcagcagtgggtgatactaccataatgaaggatctggacctggtggatgaggtgttccatcaagagcctgctaggaaataggttaaatgtaaaaatgttaatgaaaaacggtatcctcctatcaaagttattttcttacctttaaaaatttaatcatgaaaataggttgagaccagagagtaaattcatttcttatgtctgagattaaactcgaattcccactggagttaaaatatttgaggaaggggtggactgcagtctgtataagccctaccatgtgttggctttttgcccctgacttgctgtccctatcctgccctcatggtgggcatgatccagggctttggcaggtgagacagggaagaaaagggatgcaggcaaagattgcacaaagctgggaggctggacataggggagaaggtggagtgctgctgatgcagaggactcagagtgaggctaaaaagcaggaccaccaggggctgagctcagagcagaccaagcttacactgattcaggagggcacagggccagagaccaagatcagaattcaagttcaggggatccagaatcaaaataagaggttgaagaaacaaaagtgtctgaatcctggcagcctgggccccataaaggacataagaaccgggaaaatactgccttgccctgttgtggggaaacaagtttttttttttccttatgtgttcactgactgggttggaatgaacttccagagttcagagcccgtatttgggaactcaacccctcttatggtttagcatgagggcagagatgactgagaacttcttattacagaagcatccatcacaaattgcaacatctgattacactttatttcagatattgtcaaattcaatagcagtaagatagtgaacattctaataacagcaagtgtagtatcaggaattgacaaagtgggaggattaagtgtcattgcttaacttaagcaacagagaaagaacagtttcccaaattgcttaggtttgcataatactgaggtacgaggtaaggtcagcaaacaacataaaataagttcttacttcactcccaacccttaaaaagactttgcgtataatttttgctttgtagacatacggctttcatttggggaaaaatattaaggataatgttgaagaaaatattaaaggataattaaggaaggagaagtacagtaatatttcttagtggttccattattgatccttgctatctatttttagcattttctaatattttcagtttttttcagaaaaagcacttattttatgtcataagctccacattgagtgagtaagtatatattactcttgtgaaaattctctttttaagtgtaaaattgaagaagccatgatgaaggcatggtcagaaaaattaaagagaataggatgactctgcttcccagaacttacagaattacttagggaaaaggaaaaatgatttttaagaggctaaaatgttaattagtgataaagagtttgcacctgacccccaccccttcacacatacacacacaccccaccaccatcggttctgctgagggatggatctgggctgagcggaggatgatcctgagcacagacctgtgtagtgttcttgactgtggcagagattgtaatatctatttttttaagaaaatgttttgattgacaactctcaactcacaaggactagacatcaaattatttgttttttttccagtgaaaactgcctcctgaggattctcctgctgttattctcctactatgaattcatctctcttaaagccttctccatccaattctgtccttctcagtcactttcatttagtaaaaataagctggtatcaagagtgagttatccatcctctttaatatttcagactcacatttaatcccaagtttcttccttccacaccttgctctcttccgtctcctcagtatatgtcactgtggcccagacctgtggtggagggtgtaggctttggggtgtgagtgtgtcttctctcctcagatacttgactccctcctccctgccttgtcctcctagtactggggcttggagctgggaggggagaagactagtcctcctgtggcatccagggtgtgtctggcctcctttggggagtcatcactgcttctctgactcacactgatgagccctttgtggggtgtatatccaaatgtctgtcttttcgtaaggtttatgtggtagacttttagaagcctctatgggaacctgcacagtgctccagtgtgggacatccaggaatgactctattttatcatctttctatctttccttgccaaatggtgggaatgcagtctgctagcactcttcatattgcccctttctccagttccaatgacatcagatatacctttgagacaagaagcaattaccagttcccaagtcagtggacagaattatcagtgtgaatccagtgtgaattatcaaatttcacacttgaaaaaaggaagtgtgaaattgaagggagagtgaagagagagttgccgctatgtcaattcagtacctcttccaaaagatcgtttcttttttcctcctacccttttcgttatctcagtctgacaaaggccggagactgctttgtcttcttttgcctttgagggtatgaagaataggacccactttgaacttggccctggaaattttagggttttcttcctcaacttttcttttatcaaggcaccatctttgcaataatctcattctgttttgtgaagggtagggagagaaggaaggactttacattatccttctagtaatagtgaacgtttactatgtgtttagaggtattacctaactcatttgaaactgaggcccagaagagtttgtcttgtctgtccaaggtcacacgctagtaagtggtagagccagaatttaaatctgggtaatctagcgagagaggctgagttctaactacttcctcttgacgcttgttagatgtaatgcctagtcgtggcttgtgaaagcctaatcctaaaacagtagggtgtggctcttagaggacacacctgagaatattcctcttaccagtgagaattccaagtcataatgctgtgaagcctcattaaagcttggtatcaactacaagacagtaaatcactgaccccagagatggtaagatcctagtaaatttactttctgtctaaataaaaagcttattaaaacaaatgataattattttagtgtgctctccttctgttgtctaattaactacaaaagtggttaatcttgcaaagtattatataatttagtgcccatttagctgtttttttttcaatttagtacacccaagcataatcagtagtagatttattagatgaccaaagaagttttaaaaaatgatgctcacagattagtggtggattcaaacaaggtggaaacaaatgaataattttatgcactcttcatgatatattatgctttgcgaaaatttcacaatcaatggcaaatcgcagaattctaaagctatttattgtaaagatagtggtgtacatagtttcaagtggttaaaactgtattgagtcctctggaatacagttgcactttctcaaatgaaatgttgattctgtcttccaacaagatgagtgtgtagtcctcacaatattagagggatttgaagctcctccagcttgcttggttaccagttaaagacctgctacctctgtagcacatgtatatagtaggatattttccatcgtaagtcagggaactccatctaggttgcttaagggatactgtagtatcttgtggaattccaggaggaatgatgtagaaggaacagagtaatagtgagaaatagggacaagagtatttagaggaactctggaaacttttacttccacttttttatctctgcaggtgtacttccttggttgaccactcattgacctgctttcactctttttcatctattaaaattagaaaatattcatcatctacatttctttggagtgtaagcatggtggactgtaaatatcatggactttgaaattggaccaacctagattttgtatttcagttttgtcacttgcatacattgggcaaatcatttaatctcaatttccttatgtgtaaaaataatatgagatttactgaggtttaatgagagctaaatgagatgctataggtaaagcatctattttttgcgtatgtgttattctcttccttgttgatttagttgttgcttgactagtaatatagcacaaacataattataccatataagacactttatttgatctgttttttgtcagtttacacttttagtatgaaaagggaaagcacaaaggttgtattcacaagctggtggggaatttgcttctgagtgagaggatccctgcagttacactagttctactatgttggaccacagggttaatcttatttaacccatttactagctggagagacaggaagagctgaacgatagcctcatacttcctgaagtgaaccttccaagtttaattacgtcccagaacccaggctgtttctataggcatttctctcaggatctatcccgaagtctaaccaaccttggcataggtctgactcctctctctaaagtgtccccagtccctatgttcctcaccatgaccagactctttgaactgtgtttctttcctccccatggctcatacatacattctggtaactgtagctcatgtagaaatgtttacaccatagtctccttcaatctgattttttagatggcatatttacgttgcctatttaatttctttctgtgtttctcaaatttctgggaaagaaaacagagaatcagtagacccttggctttggtggagaaataccttactctttacgagtgacccaatcagccctgttcctgtagtggtttgttactttgtagacacagatttggattgttttgaccatgagataagatagacaggagtaaagattacacagaatacttgccatctacctagagtgtttttggcatctgcttgaaaattcatggactatacacataaagatatatgcagttattctccccaagtgaggtgcatttcattcctttgtgaagaatggtcctggaaatgaaacctattttaatggctggtattggaatagaaaagaacacaaagaagtctaaggaaataatgcttttgaatcaggaaataaattcaggtttacaaaacttaagagtagaatatcagatttggcagtaattaatatatatgacatgaataagtttacaatactctgtaaatacaatcaagcagtaataattcatgaaactgtttcacagagtattgaaaccagtccccaaatttcattgtattatttttatttttatttttttattttactttaagttccaggatacaaatgaagaatgtgtagtttgttacataagtatacgtgtgccatggtggtttgctggacctatcaacctttcatcgaggttttaagccctgcatgcattagctatttgtcctaattgctctccctccccttgcccaccaccccccaaactggccctggtatgtgttgttcccctccctttgtccattcgttctcattgttcatctcctacttatgagtgagaaaacgtggtgtttggttttctgttcctgtgttagtttgctgaggttgatggcttcctgtttcatccatgtccctgcaaatgacatgatctcattcattttcatggctgcataatattccatagtatatatgtgccacattttctttatgcagtctatcattggtgggcatttgggttggttccatgtctttgtattgtaaacagtgctgcaataaacatatgtgtgcatgtgtctttatagtagaatgatttatattcctttgggtatatactcagtaatgggattgctggcttaaatggtatttctggttcttgatccttgaggaatcacaacactgtcttccacaatggttgaactaatttacattcccaccgacagtgtacaagcgttcctatttctccacagcctcgccaacatctattgtttcttgactttttaataattgccattctgactggcatgagatggcatctcattgtagttttgatttgcatttctctagagatcagtgataatgagctttttttcatgtttgttggctgcataaatgtcttcttttgagaagtgtctgttcatatcctttgcccactctttgatgggttatttgacttttttcttgtaaatttgtttaagttccttatagattctggatattagacctttttcagatgagtagattgcaaaaatgttctcccgttctgtaggttgcctattcattctgatggtagttcttttgctgtgcagaagctctttagtttaactagatcccatttgccaactttggcttttgttgcaattgcttttggcatttcatcatgaagtctttgcccatgcctatgtcctgaatggtattgcctaggttttcttctaagatttttatggttttgagttttacatttaagtctttaatccatcttgagttaatttttgtataaggtgtaatgtccctctattattttcatcatgaaataatagagggacatttgagaattggggagttcacagaggccttgcgatgtaaactttgtgactgtcaagaaattgctttttatttctttttaaaatagaataatagtggcatttcatgagcacctgctacattcagagcacactcctgggtgttccttatatattattatatttatttctcacaagtacatgagggagatcttaatcttcctttaaagatgaagaaactgattcaaagatgtgaattttcttgtcaaaagtcacacagtttgtatttccacgagtaacccaaagacattttcaaaaatactgtaaacagatatagtttgacttcttctcttcctatttagatgcttttatatttttctcttcccttattgctctggctaggatttccagcactgtgctgaataggagtggtgagagttggcatccttgtcttgttctggtgttcaatgggattgcctccagtttttgtccattcagtatgatgttggccatgggtttttcatagatggctcttattatttttacttcactaattattagagaaatcaaaatcaaaatcataatgagatatcatctcacttcagtcgaatggctattattaaacgtgaaaaaataacagatgctggtaaagttgtggacaaaagggaatgcttatgaactactggtggaaatgtaaattagtttatccattgtgaaaagcagtttggttatttcccaaagaacttaaaacagaattaacatttgacccaggaatcccattattgagtatacgcccaaaggaataaaagttgttctaccataaagacacatgcatgcatatgttcatcgcagcagtattcacgatagcaaagatatgaaataaacctaaatgcccatcaatagtagactggataaagaaaatgtggtacatatgcaccatggaatactatgcagccataaaaaaaaagagatcatgccctttgcagcaacatggatggagctggaggccattatcctaagcaaactgacacacgaacagaaaactaaataccatattttctcccttacaagtgggagttaaacactgagtgcatatgtacacgaagaagagaatgacagacaccagggcctacttgaggatggagggtgggaggcagtgaggatcaaaaaaagctacttatcaggtactatgcttattacctgggtgacaaaatcatctgtataccaaacacccatgacatgcagtttacatgtctaacaaacctgtacatgtaaccctgaacctaaaataaaagttaaaacataaatttaaaaatgtaaattatagaagtttaaaacatactataaaagaatgccttatgcattattatgcataactgaagttgttgctctgatttttctcctccaaactggaaagacggtagactttttactttcatattttcatattttgacttcagtatatgaatgactctcttgcctaaaagcttaattctaccatgccagccctatgagtgctgcatttggcctctaatgacaaatatgaccattatcttttaaatgggtagttgtcttagaatatttgtctcaatccttaatttcagtattcatttagcacttttacttttacaaaggaagttgaagttgtttataagttaaacataatagaaaataagaaaattaaggttaaataataaatagattacctaaactatatacagtagatattaaaggatatctaagaaaagctaatttgcacacctagattctaaaataattctgtttcatgacagctaaaacaaggaaaatatatattataatctacattacttttccaacacaaagtaatctgcagatatttttctgaagctatgcttaagaagagcctatcagagggtggagggtgggagcagggaaaggaaaaataactaatgggtacttggcttaataactgggtgattaaataatctgtacaacaaacccccatgacacaagtttgcctatgtaacaaacctgcatttgtaccccaaacttaaagtaaaagttaaaaaaaattcaaactcacatattcagttgtggctctccaaactggtggatttcgtttgttgctgagataacattgtctgaattcactgctttctggacctccaaccatataaccaatacatacgacaaatacaggagaatggatgctaccacgccaacaaaactgtggcatatattatctaactaaaagagaatcattagcagtgtttggatgcagcaaattcaggctcggattctttgacatgactgtatggggataaccttctctactagttaaaggttctgttgttatgtaattattgtccaaatcagtacaccttctttttctttttttttttttttttttctttttttgagatggagtctcgctctgttgcccaggctggagtgcagtggcgccatctcggctcactgcaagctccgcctcccaggtttacgccattctcctgcttcagcctccggagtagctgggactacaggcgcccgccaccactactagctaattttttgtattttcagtagagacagggtttcaccgtgttaaccaggatggtcccgatctcctgacttcgtgatctgcccgtctcggcctcccaaagtgctgggattacaggcgtgagacaccacgcccagccccaaaccagtacacttttgacaaaaatatcccaacagaaactgtcccaggcaaactgggatgaaggtaaccctagtaaaagtaatcatttgtttagacaccagccagaataacaattgttaaggctgttggagaacatatttacatatccacccatgtagaggcttccctacttaatacaggtgcagttgcatagttgcttagaaatcagtattgctttacaaaatatttccaaccatctcatgaatttataaagtacttacttgattcacctgaaggtggatataaagttgttagggaaaccagctggtcctcttaaagcaaaataatcaaaccctgatcttgtaaaatgtatatagagaaaagacttcacagcgtgactttctgaccttgacctttattcccagaacttaccttacttttgggatttctcactcatcaccaatgaaactctcagactagcctcagagaggttctgtaaagacaaatgttctgtgtgattcttcttttcagagatgacacccatctttatcatttaaacaaaagtttacaaaaggctccaagattatagatagaaatacccagaaactgataaacatcttgattacgtggtttgattacaaaatggtctacccatcttcattttggaagcccctctggggttgcactgcctgccaggttctcagtgtatctccacctgactgagtctgtctttctcccatcccttgtaggaaccctttcatatgtgtttgtgctcctagaggttcatgtagaggagagggtagcccagaaattgatgttttctctcttcctgctttgggttctctcctaggttctggttcctccccaaagacctttttcttgaattattgacagcaggtctgtggacccattcagaggagtcctccttcctcttatttcttgccgaggacatcccaaattctatgagcacaccttataaaaaagcttaacatgaacatgagaaacacaaagtttcgggaaaaatgttttgcttcacataattcacagaagcagtgcacttggtctgaaaatatttattaaagtagtaccagatgacctctttatctgtataataaatattgaaaatatttgcattattaaaactagctgtggaagaaaacagcctcctgactgggtgtttaaagtactacaacagagctattaatttactcatttaaacatattaatagtgatagtaaaaggaacctccattcagaactatgtatctactacctgtactgtcttcttatttctaactttaaattcatgattatcactgggaacaactatatggtatatacagagaatttaacaatgacatggttctatcagatttttcatacaaaagatatgtttcatgaattcatataactatgacaggtttctgctaggcattttgttttatttttaatttttttgagacaggctctcgctctgttgcccacgctgcagtatagtgctacaatcacagctcactgcagccttgacctcttgggctcaagcaatcctccctcctctgcctcctgagtagcttgaaaccacaggtttctgctaccacaccctgctaattttttaaactttttgttgagacggggttttgccatgttgcctaggctggtcttgaactcctgggctcaagccatccatccccctcggcctcccaaagtgctggaattacaggtgtgagccaccatatctggccctctaccaggtattttaaataccttctaaatcatattggtttagacttgttaactactatgtattaaaattcaatttattgattgattaagctgtaagaaggaataattaaacataatgccactatacaatttgatgccttattaatttatgctaaaatcattctaatgtacttattagtggtggtcctgttaaaaactgacagcccgtgaactgaattcgtctttcagtcatcagtcaatgaatcaatcaattaaatgtgaattattttaaatttatgaattagaaaatttcacatcaaaatctggatttgcagtttttctggaataactgaaatatttggcagaattggatatgccaaatttcatatgagctagaactgagtaggtcctcaatgaagcggctttttatttttatttttattttttgagacggagttttgctcttcttgcccaggctggagtgcaatggcacgatctcagctcaccacaacctccgcctcctgggttcaagcgattctcctgcctcagcctcccgagtagctaggattacagggatgcaccaccacggccagctaattttgattattattattattattatttatttatttattttttaagtagagacagggtttctccatgttggtcaggctggtctcaaactcccgacctcaggtgatccacccgtctcagactcccaaagtgctgggattacagacatgaaccactgcgcccagcctgaagctgctttttacagaatcttcctgaccttgataagcacttgaatttgcagccccgatctaaacactatttcagtgcatcctacactctgcctccagattaaacttccatctgcattacagtaagtgtgccattctcccacttctaataagcttcctcagctcctcattgactctgtgatctgacctccaaggccttcctgttctggcctctacctgttttgttctgccttattttctgctctccaccactgggtactattgttctgattaagtagggctacttgttaccagatcacagcttgtacatttatacctcttctctttcttatgcattttcttctccctcaaattccttcccatctgtagttgggtacaaataccaaagccatttttttaggtcctctaagcctggttcagcatctcagttatatcttccctgaacagcgaagatggtagtagttcttccctcttttagactcataacactgatttttctgactttcaaattactgaatgtataatcttttatactgaaattatgtgtgaccaaggcttttttcaactactggacagggtctaaatcttgttcactttgaattccacatgtacttaacacgtttccttatatttatttgccactcaataattatttgttgaatgagaaaattttcttctttttttccagtatactttatgtaagtaacatcttctgagatgcagatattgatattgatatttgcgtttcaattaggtaaatgatagatgtgtgtatttaaaatattgatttttgtgaggtatgtgattatttggaactctagagccttgtatataatcaaatatttgaccttcttatttaatcttttttttccataattaccatgatatagcttggttcttaataactcagacctactaaaataattcagaaggaattatgaaatacctgcactatatctttgttgacattataatactatcatatacaaactataaaaaaactgttaattcaaaattataatgtggtattaaagattaggttaacaggattaaatgtgaagcttaactggaaatattgaggcatgacaccaaaaaatttaatatccttttagttacacagttaggctggtcattgctcaatgttgctaactcaaaagcatgtgcttacatttagattatgtttaatagtaagtatgggttgacagtctgtttgtttccacggatggactggtccgctttgcactcactcagcggctgtgcattacgcgctttctgacttctgatcctcttctggcttttcttctgtttcttgtcaaagtgtgggtatagataaggcagtggtggtagatggagaggcctggagttcaccctttgttcccggaccctcctctagttttctgctaagcctgtttcagcatctctgagaaaatagctgactgtaaaatcaaaagagccgccaaaggtggtcaatgtattacatgcataaagttcgagtgaaagtttttttttaatatttgaaatatgttaccagtaattctagaaaagatttataacacaataacatttttatttttcccctagggggaatctttaattgtttttaaagacagaaacaattgcattctcataaatatattcatggcagtgttcataaatataattattcagcacagctatgtcagcaagaactacggggataacttgtgcttgacctttactcacggtagaaaagaaaccattttatgttggcactttaaatctctcaggggactattgggacagaggaatatagcctgcaatgaatagcatttaaacttatgtagtatctatctaacagggaactttgaaaatgttttcaaattcattattagatttaggggttttttctatttatttcttaatattttatattttatttaaaaggagtcatgaggcaactgagtatgacaattctgtccttgtgacacaaccataaactggccatttccaaatagtagttcaacttatttggtctgtatttttttttcaattatctatgtttatgtgcacaaactacttggatcctatggctttttttataccactttctcccttcttgcctccttctttccatccctgtctcacttcctttccaaacctttgttaagtactgactatatggagaatagtttgctagttatcagatgggttaaaaacagcagaaaccccgttttttctaaagaatctcaaaacctaattggaaaaatacattttagttaagcagactctgagataatagttcgagttcaagtagtttatttgggaggtaaaggagctacctgtaggagaatggtaaagtgagaagacaggtataatgatttcctagggctgccttaacaaagtaccaaaaactggggggcttatagcaacagaaatgtattgccgcacagtgctggaagccagacatcagaatttggggattagcagggccatgctccctgtggaggcactagggacagaatggttccatatcacttctgtagctcctggtagtgtcaggtgtcccttggtttgtagaggcatcactacaaccgccatcttcacaaggcacatcatctttcctctgtacttctctgtctctgtggccaaatttccccttttcataagccctaatggattagggctctctctaataatctcgttttaacttaattactttataaggactctgttttccaaatagtcacattcagaggtacttgggattaggactctaggactccaacatatctttttttgggaggtcataattcaacccataacaacagatatgacaaggaagatgaagaatgaacttaattccaggaaaacaacactgaggaacacgttgaaaatacaagcttcagagttatcacactaaaagggacaaaggagcaggagtatgtatttacaaacccctatcagtcatgggagaggaagtattaattcccccttaccttatttctgctctgcactttaggcaaagcaggctccagtggtcagagaaagccctcaggcacagaaatgcaagtgatgggagctgggggcatgtgactccccagtgaagtagaggaagggaacgtgggagggacaccaacagcatctgcgacaatacctgaaacaataagtgtaaaagcaaacaacccaaactgtactagggaaatacaaagcaagttaaaatctggagtagcagatgttaaccagagcaggactttgggcataccttcaaaccctgaaggaactggtgaatgttgtccactagtgggagaccgaccaaggaagtcacaacactcaaggactggataaagtaggaagcaatccgtgtggaatagatcagaggagggaccctccaactatagtggtgtctcattctaggcaggtgattcacatttacttctaggtggaatttcacatttttaaatgtggttcttaatgatgtggccactgcatgtttcttaaatctcatctctgttttagtttgtattcgttttatctgtaaaaactaaaattgccatcagtttgctagggctgctgtaacaaagtaccagagactggatggcttctggaagcaagaagtctgggattgaagtgtggctgtgtggttccttctgaggcctcattggcttgtagatcactatcttttccctgtgttctcacatcatcttccctctttacctctttacttgtctgtcctaatctccttttataaggagtccagtcatattaaattagtctaatgaaattacttggctggatgtggtggctcacacctgtaattccagtactttgggaggtcgaggtgggtggatcacctgaggtcaagagttcgagaccagcctggccaacatggcgaaactccgtctctactaaaaacacaaaaattagccaggcatagcagcaggcgcctgtaatcccagcaacttgggaggctgaggcaggagagttgcttgaacccaggaggcggaggttgcagtgagctgagatcgtgccattgcactccagcctgggcaacaagagcaaaactccatagaaagaaagaaagaaagagagagagagagagagagggaaggaaggaaggaagggaggaacgaaggaaggaacgaaggaaggaaggaattacattttgaggtactgggagttaggacttcagcatatgaattgttgaggggatatgacttatcctgtaacactctgtcctctgggagggagggaggtagggaaggaaggaagaaatgcataaagggaagaagatcagcccacttgacaggaagctgtgaatgcaatgctgtgacaatgtggttccagcacagctgggtgcgtcatctcgatcaagcgatttaacctcactggacttcatctggcaaataaaagagctagactttgtttttcatttctatgatgatgaagtttaaaaaaaaatgtttttcagcagctgagagtggacttaagatgtgctcagggcaggctgggctctgaaggaccaccctaggagtctcttgtataaatacaggtgcggggttctgtttgaaagaaagttaaaatgatgaattttgtttggggttatggtttggacattcaacgcctgcattttgttcctgttttttctagtgtatgccttttgcaggcatgcgtttgctgtaacaggcgtggtgtatactacagtcacctctttaaaatattgttattcattttcagtatataatagagagcaatagtatgaaggttatttatttgaagtcctgtttaaaatatctgtttatgttgttaatctaaattatggtgatatgattagttattaattatctgtgattagagaacatgtcctggtgaaaggtgcagggaagtcttccatggattaacatggagcaaaaagagagcgatttggagctaaacaggtcttaggccaaacccaagcctgagagtgattttgtggtgcctaatggataccaaattcttgtcaaggctcctgtctcatctgcacttgtattaccagtaacttgacagaagaaggaattatttttatgagtagttgaatcacaacatcccatcgatatctgctgaagacatgtatgaaagaataataacactgcctaattttactaatagaaattgcaaaaggtttgtcaaaaaccttttgtccttttaaatgttaactttttaaaattattaatgttgttaattttactttttataatttttatctttttgttagttgtttgttcctctccgaggaaaaaagagaccaaggacacttggaattctaagtacatgtaaaaataatagaaataatagaataacaacaataataatgttaaacttttattgatctcttactccatgccatgtactttatcaaaggttttgcctttatttatctcaattgatactcatatgaggaagattcaattatcatgtccattttacaggtgaaagtttctgtaaggcacagaaaggttctatgacttgcctttgaccatataatggtaaatgatggagctgagattcacattcaggctagctgagtcaagaagtcatgcttttaaccagatatgctatatttataaaagttgagaaataatcgcttgcagaatagaaatcataaataatgttgagagagaaacaatagaatgagaagccgaaaaaaaaaaaaaaaggaattttggatgtggatattccaactgaatttatattgttttgggaatactccaagattaagtacaggaacacatgccttttccattccattgaactttttctcaggggtagttgtatatatgcaggtgaagaccatggaggaactcagattaaactaagtatgtggacaacctcctttcttgagatatttaagtgcgtttgagatacacacaagttgctaaatgattcattatcttcttacatatctacagatttcaatattcccttcaaatatgtagttagccgagaaaaaaatatttagagttttcagttttcttcgttgctttccaggtacatccttggcagattggacctattatgtacctgtgacttgataaaatatttccttgcatttcactgactgtaaaactggaatcttctttatgaggtcattcagtattataataaatgctattattgaatctcagtcaatatccaagtttgttttgtcatcatacattttcagatttttgctactgactgcagatggatttatctcctcggccaacccaaatattagtccacctatttataaagaaactggatccttttcttcttttgttttctttataactcttccctgtgctcaaaagcaaattatttcatttcttcaagcctgttttctcttctgtaaaactgagataataatagtttttatatcttagaacaatatgagcattaagcaagacttacatgtgtatctctaccccaaaccactttcccgaggtcccaatacttgtaaataactgcttattcaacatcttcattcaaatatctaataggcctctcaaacctaacttaatctagatgctactcttgaattttctccctcaaataaactcctcccctggctttctaattttcataatttacctaattgctggagtcaaaaacttaggagtcacccttaaaacttctctttcattcataccttctagctgatacgttactaaattctgtgagctctaccttcaaaataagacctgaatctggccattttcaatacctcccttgctatcaccctagaccatcctccacttcatactacagatatgaattgcttaggtgaaccccatcttcttcaccagagcaattcatatctgttctttctaccccctactcttgactatggattcctcctgcccctagaaaaagccagagtgatcatgtacatctttcaatgagatcatgtctctcccctgattaaaatactacagtcaggtctcatcccactaagcataaaatgtatgcaatttgtcattgataatatgaccctacagcatctgccaccggccatgtattcagtttctcctgaatacgttgctcatgctgaggctgctccactcaccttcctgctgttacttagttacttcaagcttgttcctccctcagtgcctttgtacttgctattccctctacctagaatattctcccttagatatttgcatgacctgttgcctcaccttattttcatctctattcaaattcacttgctcatagaggggctggtcaggactttttaggataatttatctaaaactgccctcccacatgcctagttactctccaacctcttactcagtgatcatagcatctattatttgttgtgtgatgtctttatttgtttatgtgctctctctccatctagaacatataccccttgagttcatggtctttgtcttactcaacatgatatccccagtgcctacaatagtacctggcacatggcagatttgcaatatagatttgtcaaaataagaataaatgaataaaatcacttaacatatattgcctggagcatactgagtactatactcttttccaatgatacacattagaaaatcagagcctgttatattcttcattaatgtgagtcaagtacttttaaaaatctatttatatattcctcataaattatgtgagggcaatgtttccattttacaaatggaataactgagagcttagaaagatggataacttgcccagaatcacattatcattagaagttcatgcttgacccaaactgttcaggaatcatacaatagaaggtgatttaaatgaaaggatgtcactcttttgatcacaagatttggctgatgtcactggtgggccagtgactcttctttttcatgcctggaagaagaaaaaaacatcccacagggcaggggaccaatttttttggtccatggtaacgagtatactagaaaatgttgtaatatccagtaatattctaccatgttccatctgcctcacaaacctctgccatgaaaccagcctcaattcttttttctgttaacctttgtagcttttttttattgattttcagtttacatggtatgggtaattattatgcaaaacaatttgaaaccacttttttgtccacaaaaaaatcatcgtgcttaagcactgatagataaaatattttctttactcttacacactaattgcaggtctgctcagttgtcctcaaaggcagaaaagaggtgaggaagagaaagcaggtaacaataaagctgggagaagtggaggagtagggggagtaaatgagagagaaacagttcaaagctatgagaagattgaaaggagatggccagaattgcaacagtatcatcaatgatgaacaagaagtggcaatgcccaataggaatttatgaggtgctggcggggcgtggtggctcatgcctgtaagcccagcactttgggagactgaggcgggcggatcacgaggtcaggagatcgagaccacggtgaaaccccatctctcctaaaaatacaaaaaattagctgggcgtggtggcgggcgcctgtagtcccagctactcgggaggctgaggcaggagaatgacgtgaactcgggaggcggagcttgcagtgagccgagatcgcgccactgtactccagcctgggcgacagagcaagactccgtctcaaaaaaaaaaaaaatttatgaggtgcaatgagctgatgggactgctgaaaggaattgaactgaagcaagcagaggaagaggaaacctccagaaataacaaactgagggagtaatctatagtagatggtgaggtgtttgggagtaatacaattaaagtacactggatgtacagtggaggctaacaatggttgtaacagctaaggaagtgaatgtaatattgtcatacggtggaagcatgactttaatgctctactgagttgggggagaaatgggaagctggacctaattttccctgcttctgattttactgctgtaggagatgccagtggcacctaggtgctttgctgctgttaacgctgctatagtattagaatagcagcagcttctgttgtggcagtgcaaaggcgaaaggtagctgaaggccctgaacagtcagggagctaacaaactgtagctcactgtccagcttctctaatagaagtctctggtggtttgttgagcctgtaagggcaaattcaacaatgtttgtgataaatatcagattgaaattatttgaggaagctttagttctgcaagttagtgttgtggcaaaggtaaatgaaaaatatatgtctcaggattttaaaaactgatgcatttgtttctgtttcttttgaatatgaagtcaatgctttgtttcctgagcacctgcattaatgcaggtgagcacttgctttactcaccctatgatctatatgttgctgctcaaaaccttctttattcttgatgctcctgagagatgaagctctctcttttgttcttacagtatctttgagcgtaggccaattgtatgattttcgttttttactagtgaattgaggcttcagattgaaaagttcatcttagatcatcactacagcagtcaagaccactcctatccatgcaagcattcttggttttgttttctggtccatgcttaacttaatttgatttgtttgtatgtgttgggatgagatagaggtgcagatacagtgctcagaataactatatgaattgttgctcccaggaaaacatgtatgacacttaaattatgttatcaatagtttcagcatacattttaatttgacatacttgttttgcttatcataccttcccaatttttcctttaataccttgcatattattctcttatattaatgtatttaattaacatacttgaataacaaatattctatatgctaggcaagattctagggactaataatacaatgatcagcaagattgtgtgtaaaaattagcacatagacaattcttggatcatttaataaaagaggtcatttgaaatgtgtcgtttaaaaatatgtaaaatggaaaatcatgaattatttttattcatatttcatatttccttttattcatataatcatatgaaatattattacattgatgaactcatattgatttctgattatgaataatacaatggtattagccctaaggagcttatggtcaactggaggaaaggcattataataaatgatttcaacaaaatatcattatatgatgaagtctattagggcaagtactgttgcctgtgttgctcaccattatattctcagtacttagtcataaaaacaataaagacattcttcaaaagaaattcaaaattttgaatttcttattcttaacaacaactttaaaatcaagttttaaaacctgtgctgtacgtaagagacgtccagggagtgttttcaaaatacacattcccaagcaactctcctgaaccactgaacaagatttttgggggtagagccgcaactttacattttaaaatttctttggtcaattttattgctaagccctcgttatgaaggaataacctggagggaggtttttgtgcatgtcaaggagctttgacaaaggccctcacattcacatcacttttagattaggagtcagcaaaccatagtttggcctgtagaccaaatccttcctcccaactgtttttgtatagcctgtgaggtatgaatgacttctacatttttaaatggttgaaggaaatcgaaagaataatactttgtaacatgaaaattacatgaaatttaaatttcaatgggtacaaataagttttattagaacacagatgtcctcaggaaaaagtttgcctatggtgatgagaacagaatatacattacacttcacaagatataaatctaggagaaataggctcagcacagtggctcatgcctgtaatcacagcactttgggaggtgaggcagaagaatcacgtgaggccagaagttcgagatcagcctgggcaacatggtgagactccccaatctctacaaaaaaatttaacaaattaaccaggtgtggtcattcatgcctgtagtcccagctgcttgggaggctgaggtgggaggataacttgagcccgggaattcaggcagcagtgagccctgattacaggcaccactacactccagcctgggtgacagagtgagaccttatctttaaaaaacaaagaaagaaagaaaacttggagaaacagtaagttagataagatagtcacaatctaaaagtattttgtccttatggagttatgggttagatctagcaagataaaattcaacaggtgagacagtaaggtcctatatgtttgcataaataaaacaaccacacaattagagcaatttagcttttggaagtgtaaaaatgatgttggagttttagttgacattaagttcaaatatgtgtcagttgtatgattatgaccaagaaaaatctaatgtgatatggacctataaatagaagtatagaatataaaataaggaatagaaagactacacctaaataattgattccagtttgagatgtcctactttcataatggaatagatatctgaagcattttcatgggggaactattagggtggtgaagggctaaaaaatcgttccaaatagtaaatgacttagcctgaggaaaagaagactcagggaaggacataacagatagcagtcttcaaatatttggattaatgtcatgtggaaaaagggttaggtttattctgaataagccaaaagggtaatgccagttatggagatagtgcagacatgttaagctcaatataaaaaatatactaattattgtaaagatggaattatatgcctcacaaggtgattcccttatctcccttgaaggtgtggacagagtctggaagaactctgggtcaggatgatgttgaagggatttaaggatcagaaggaaatttagattaaattacacctaaaatctctctctacatgaagtgtctcagagaataattttgttgtattatgcacatattttaatattcattgagcattcactatttgcagagtattttttaaataattgtgaaggatacaaagggaatccaagatatggcttccaggagacaaaggaattttgcaaacaagacagagccacataaaacatcaggaggaatggtacataaactgaaattctatagtcattcaaagaaagtgggatcagtgaagacctccagaaggaagtgagctctgaaaggagctttgaagattggtttgaatttggataagtggtggtaaggcacagaggttctaggtaatgaaacaagcaggaacaagtatcagttaggaaagtagatatgtatggcggggaagaaaaatgcttgctagaacaacattcatttgttattcattcaacacttaaggagcaccttgggaaaccacaatgcaaagcaaggtgtgaagggggttacaaagatgagcaaaaaaagattcctgccctcaagcagctcccagcccagtaaaatgaaaactagtgtcaacaccacccttctatagtaacttaactcctgggtgattcagccataagataagttactggaaatttcttggactgtattcctccagcttaaaaaactcatcaacatttcattcaacaaatatttattgaacttctgaattgttctgtctccttgggatattatcagtgagcaaaatagacagagccctcatgcagagcagaatgtaagccaaacatatttttttgttattccctggttctccaagaaaaataaaacaatatttattgttttacaaattttgagagagcaaaatccatagagaaatacctcttggggttttcagaagggtatttcgagccctgactgtggagcaaatggcgtgagatactcagcagtatctctttaaacctgtgctcctttcttgagcagcatttgtatttttgtcatctatgccatttttagggggttttgtttttgtgttttagcacctgcaaaatttaaactggaaatttcatcctttgtgtcttagctcttgtcactctaaacatctcttgttgtatgaatccgtattggctcttcatacaaataaaatgcaaatcatatccttgccagagctaaacacttatctcaacgaaatcagaacaaatacttgaaggttaaaactgagactcattgctagcagaataaagagaaaaacactgaatgcaacatgaattttccactgagatgaattcaaaatgtgagccaaaaattcagtaaagataaaaatacttctcatgccaaatgatgggtttcgctcttgatagatatcagacttctatctccaccatttttctttcacatgaaacttaacactgagcgtctgattgcttctcactattgaaaaatgccatattaaatttcacaaagggaagcatgttaactttggtgtccaggtcaaatgactattcaaaaggagtggcttttctggtcaatcaaatacaactaagtattctactcactgatgagtgagtggcctggattttgttcagttctgcctttatctatgtaattacttctctggtccatggttccctcattggttaactctgtggtgtgaggctatgaatatcactatagctaggtcattgctttgcccccttaagtacacatcagtttattatattccattttttaaagtattctccttaatgtgtccaagaacttaaaatgactgtatgtatgcctaggttaaaattttatttaatattttgatagcattttaaacataattggttgcctttattattctatgtattttatgatatatgcttaaaaatattaatctgagaagggatccataaactgccgaaagagtccatgacacaaaaatggtctggaacctttaagtctcatacatttctggtaagggagtaggacacattctctgacccactctccatttgcccgttactaccttaagagaggtagttttctaactagatatgctaaagggattcatgaaataagatacccacaaagcaacattcataatggattgtgttacatagctggtattcatagttattttttgtgttcttggtatatttttcttttgtttgaaatctaggcagaagcagaaatactaaaatgtaggtctgacttattgaaaatcatattagaggctgagtacagtggctcatgcctgtaatcccagcacttaggaagtctgaggtgggtggatcactcgagtacaggagttcgagaccagcctgggcaatatggcaaaaccccatctctacaaaatatacaaaaaattagccggacgtggtggcccacacctgtagtcccacctactcaggaggctgaggtggtagaattacctgagcctgggaagtcgaagctgcagtgagccgtgattgtgccactgcattccagcctgggcatgagagtgagatcctgcctccaaaggggaaaaaatatatcatattagagtgaaacattgtgtccgttagcagggaagtatcttgaagatgattgagctaaggtaattaaagtatgtgtattgtttctgcagtttagatagctgctgctgtaaacagtaagtactttccaagggtgtaaaatgatttctgggtgtaattaacataagcaaatatccatcagtgaattcgtagacatgaagtctatggattaattaatggaagctgtgcaattgtagttatccttttaagtattttcttttttatttctttttaattaaaaaaattaagacatcaaatctcacagtattaccaaggctgatctcaaattcttgagttcaaggcatagtcctgatcatccctgaagtagctgggaagacagataggagccactgtgcctggcttcagtcttttattttgagacagggtcttgctctgtcacccaggatagagtgcagtggtgcaatcacagctcactgcagcctcgaccttctgggctcaagcactcttcccacctcagactcccaagtagctaggaccgcaggtatataccagcacacctagctaattaaaaaaacaaaacaaaacaaaacaaacaaaaaaaacgtgtagagagagtgtcttactagtttttccaggctggttttgaactcctgggctcaaacgatcctcctgcctcaacctcctaaattgctgagatcacaagcatgagccactgtactcagcctctttaagtattttcagacaggaaaagggggagatatccttctaatgataaagtccattattcagaaatcattttaagaaacatgtaataatcatttggaagagatgttactttatgtcatattctggttgtggtaaacttcatttttcacttctacatggactatcatgtaaagagctttaatcctggcatccatgcttaatgaagttaaaaaaaattatttaactaagattagaaagatgaaaacagaatgctcaccagcccatctataattctcatcagttcattagaaatcccttctgtgggtctctaaataacacaaaagttcaaaaattctggggggacacagatattcagtccataacactgagggttaaaggaggtagagtaatttgcttagtgttacagagctatctgtcttatagttctgaataagttttttaaaattaaatagtaagaattgtttttatagaattcttccatgaaggctgttcttttagactagacctttaacatattcatccagctaggggaaaaaagaaataaaaaaattctctatgagtaaatatgcgagtatgtgacctgtttgttcatgtgtaattatatgtaaactacatttattgtaaatattaactggcaagctttaagacttttaaaattactattcctaggaatttacccttattaatcattatgacttgagaggattttaaatgacattaattgtggctgctatttatccagacactatgctaagtcctttacttaccttatttcattgagatctcacaacaatactaaggaaaaaacaatattattatccccattttaccgatgaggaaactcagtatattagcttaggcttccattacaaaataccattggctgggtggcttaaagtccatgataaaggtgcccatcaattttgttccctgccaagggccatcttcctggcttgcagatggcccccttctcactgtgctctcacatggtggagagagggagagggttctggtttctcttccaagtattatatggacactcatcccaccttgagagccccacccatatggcctcatctccacctaattacctttcaaatgctccacctccaaatatgactcctccactgaggggtagggttttaatatttgaattctgggttcaatttaacatttgaatattcagtcgataacactgagggttaaaggaggtagagtaatttatttagtgttacagagctagtaagtggttaaaaataaagtgcgctccagagacttccagggatgatgctatcctgggaaataattttctgcactgaaataatattttacattggtgtgagggcttaaaaaaatcctcagcttgacttttccttactacctccagcataagcactctttcaaagaaccatgtggcttgcctctctcctggactgccttgcttatggtctggtttccctgggaaaaacaaagggattctttcaattctctgtcccatcacataaatttgtcaataaaagtccttcagtgacctcccattccgcttagaagaaaataaaaaattccctccatggttctcaaggccttcttgacttcatgtaactgaccttatctccaatccccactccactctgcctcgtctgccctgacccaagctctttcctgtccagcctttgcacgggctgctccatctgcctggaatcctcttccccacatgagtggaaggcgtgtttctcctcgtccttcaggatcccactcctcactcaggcttccctgacaatcctgtctatgtagccatgtcctacccctagccaggggcgtgtctgtatgtttctctcttttatttgtcttcctagctattaaagctacctgctatttctccatgttcttttgttaatctgatttatcacctgcctctcttagttacctacaagttttctgtgaacaaggacttagttttgttcatgtttatatcaccagtgcctcaaaagcacctggtatgcagtagatgatcaattattatgtgttgaatttatgaatgtatcactcttaagagacagaaagaatcccagttcagaagtgctaaggggctatgtccaaagttgtccgggatgtaagagacaaaaccacaactcacacttaggtcttcttactttattggtctttccattcctctctcctacccttttctgtagaaacagaataaggagcaaaacacactcctctgaaagttgaaagtggtgaaagagaactgagatctactaagcattaaagctgtgtcagatattacaccaacattctctaaagtcctaagaggtacagttactaccctcaatttacagatgagggaaataaagcttagatggactaattcacttattcatgatcactcagcaaatcactggcagagcctttgttccagccctggcttgtatctggtaataatgcccttacttaggggatgctgaccatggacattcgacgaaacccttttctgggctttcattaacctaggagtaaaagaaaggggatagcttcactttagatgatagtgaaattttctaaaatttataacacaatccccccttgcctcatgcctctacgcttttgtttactatgatggtatttaaagctaaaacaaaacccagaaatctttgggttttgaaagcaatctgttaaaaactataataatccatgtatccttagacttgagagcatttctaaatgaagcttgcaatctgatcatttggtgatgtttggattatgtggttatagtaggatttaaaatgccttttcacacagatactatagaaaggtgagcagcaggttgcacacagtgacaaattagcggtgctcttagccaggctgtttaaattatttttaggcaggagacatactgtacacaccaggttttagatgcaagtaattactatgaaatgttacctcactctttgcctgtagttaatctgagctctccctatttctctctctttccttccagttctattccctaatacttcatgtattatcttccttgcaagttcccttttttctgtgaaatattttcttgttatattggcaaggatacttatccttacaaaactggtagtggctgcagcagccatgcccagagcttactatgcagagactagtgcctatatcggaagttgagacaggttgctataccaaacctatctttagttcactacctgtttgcttcattaggtagaagctttctcctagacttaggagaagcaaaaacaaacacaaaaaaacaagcaaacaaaaacaatgctcctttatttaaaggagcattttctcagcatctgaaccaattatacatgcctactttccatatctaaatttatagcatagcacaatgagaactcatattaaatggaagaccttgaggctctgcagtatcctggatcatctaacaaagtttttttatatatttatatgtgtatatatatctatacacacatacacacagatacacccaaacactatacatactaagcatttaacatatttgaggaagttaactttatcacatcacagttcacgtttgtataacttcctaagaaaaggtggaatctattacaaaacaaacagaaaaagatgatttaaaaagccctaagagttggagctgtttttattccttcatagagcctgcattctaataaccatttaatataacctctaccttgatttgtacatggactaaaaaggtatgaccactggggcttagcactgaagcaagaagaaacaaaaagaggttgaaggaacactacttacataagatttccagatgtgggattactgtgtattcagattccttacacaatattaatagcacatataaaataattaaaatttctgggaacttttaagctgtttgatgtatcaagcagggtctaccttcatgttatagtgattgccaggtttcagatgctgggtaggtgtcaggtggatacttcattcatgatgccaatagagtgtcaaataaatatggattttttaactatgagataatatattatcatacttctgcaccctcttccaattatgagacacagttttctttgatgtcactcaggctcagaaagttgaacacccttcacttgatgtgatttggcaataattgtctttgatgctgagaaaacatgcacagtatgaagcagaaaaatacagctgggtgaggtggctcatgcctgtaatcccagcattttaggaggccaaggcaggaggatcagttgaacccaggagttggagaccagcctggataacatagtgagaccctgtatctacaaaaaaatttaaaaattagccaggcatggtggggcgtgcttgtagtcccagctacttgggaggctgacatgggaggattgcctgagccaggcgattgaggctacagtgagctgtgattgtgtcactgcactccagcctgggtgacagacagagactctgtctcaaaattcaatcaatcaataaaataaaatagaaaaatgcaacctgacaatcgtttttttaaaaaacaaaacgggctgagcacggtggctcattcctgtaatgccaacactttgggaggctgaggcaggtggatcacttgaggtcaggagttcaagaccagcctggccaacgtggtgaaaccgtgtctctactaaaaaaaaaaaaaaaaaaaaaaaaaaaaaaaatacagaaattagccaggcatggtggcagatgcctgtaatcccagctacttgggaggctgaggcaggagaatcgctggaacccgggaggcagaggttgcagtgagccgagatcatgccactgcactccagcctgggcaacacagcgcgactccatctcaaaaataaaataaaatacaaaacaaagtacataacagtcatgaacataaaatgtgcctacctgcacagactctgggagagttaaagcaaggtagaaggaagatgtaactgaacactccccacctccactatcagagctatggtccagacttccattgtctgtaagctggattattgccaggcctcctgactggagtctcagctttcctccttgctgtcttctattacaaacataggagccagagggagcgtatgaaaatgtaagtccagttatctgattcctctgctcagactcttccaatggcttcccattcacccagagtaaaagccaaatcccgatgatgatgaagaaagctcacataacctgtgtaccctcttcctcctctgcccttgctcagtccattcctaccacaggggcccagccactttgcctcagcctcaccaggtgggctcccacctcaggcctttcacacttgctgcatcctctgccaagcccctctctctgtaatgtgctccctcacctccttcaggtctttgctcaaatttcaccttttggtgaagccttctctaactaccttacttacactttaaaaaaacagggaaatcagtagtaacaaaacattacttagcattcaaagtcctcagatgataatataatatgaatttcactctgagtagctacaatgttttcaatatgctaagtttaaccctaagaagggcaaagggcaataaaacttaaagagtcagaggacaagtagatttctccttagaatcacacacagggtacgtttcctgggctactccactgaacagctttcagttcaattgaactctaaatatttaccaattgcctgttctaagggacttgatgcaggggttactgaattgggtaagaaaggatgagacccagattttaaggttaagatgatttatcagaggggattactcaaatactcaaaggaaatgaccaaaaatagataaaatagggtgttgctcataagtgaagtatagcaaagtgttttcattttgaccaattgctacaaaatcaatagaactgttgacttggaattagatcatggttaatttgattggatcatgacagtgacaaaaactgcaagattttctgtccagggttctgacacagtctattgaattaaatgcggttcaaattcaaagtaccttcatattattcaaagtttcgcatagatggtgcaatattatgaaaggtaaaatgactgctcctagctttgtatgcactgtgattagtgaaagcattatgacactttttttttagtatctaaatataccataccataaaatggtaagttttaaaaatagacttgattattaccaagcagtggctggtgagggtagaagaggttgtctggagttgattaaacagtggtaggggttctgggttacatgggacagatatagaatacatctgcatttgtataaattaaaaatccttctgatagtctctggaattttatattctacattagcagtaatatttgaattattggttttatgatctctctttcgtggatataaaagaacttaagttatttacaacacctgttatgttatttagatgatagttaggttttatatgcatattaacaatgtattttaattaaatgatgaaaacagatgtcatcattagcaaatgtaatgggaagaaaattacatcttgtcacttgccttgaaatgcactccagaatgcattagaaaatactgtacctaatgatggctgactaattcagtatactgtgcaagtaaaattcaggaagcttgtattcttctgcttttaaaactgaaaaagaggaagcctttttggaataaattttttattactcagctattcaacttaagctttacaaatagaatatttgatggcactgcttttaagaatctggattcaatctatgtattttatttcatagttctagatcctatttatgtatttcaatccattgaataatgttacacttcacaggaccataatagatgttttatctgatttttgttcactgtttcctctatacattataaaatagctaatattttactgagtacttactattgtctcacacctccctaagtgctttgcatatacatattagccattttaatcctcacaacaaccccacagtaggtaggcattattatcctccttttacagaggaagaggtggagtctttgcatgttaaataacttgccagatcagaagctaataagaggaagagcccaagaaagttttgaacccaggaaatttggcgctagaaccactgggctctgctcttttctcaagtattggcacacatggagattaaatctaaaactaagaaatatgcttgtgcactcacttcttggggtcaagaagcaagtaatatactttccttctacactcagagtaggagcggcatatcttcattataccctcactagggataagtgggtgttcagaacctctgaacagacaagacaggaatgtcacaagtggccacatagagaccctggtaaccagaatgggtgagcacaaactttaccaacagaagagtttgtccagggagatgaagccattagatgttgtggaaattaggggacattgcacttctcatttattcccttgtggctctgtgatttctgagaaacaaagcaggttgaagagctttataggaccattgatgttttaaaggaattattctgatcaaatattaaaaatgtaaggtaatgatactttgtcaaagtaatgttgaaagctcccctcccttaggtaacacatgcctgaacatagtttttcacctaaaagaagaaaaggcaacaaaatttggttaactcactaataagaaggatacatttgatgtatgtaaatttatcagatattaaacatgaaaaggaaaacaagtctttcacgttaaaatttttctgtatatcattcattcaccaagtatttcagagcattggaaatatttgtgattcagccaatttacatttatcagtgcagtgataatactaatgataatactctttttataaatatcagatttttagaatctcctttctttttttttgtttgttgtgaatcagcaatgaccataaaaatgccgaaaaaattttcagacaaaattacacgtgttccaccagtggttgtatcttctggagtttccacaaaacaaattttgcttgtgggctcatttttcactctgacttccatctcacaagatgacctatttgcccctcgctagtggtctattgatagatcatccaagccactcatactgatccccatctgccaggaaatcctgccagtcatcactgcctcccaaagttatcagctaagtgtactcagaaacttaaaagcgaagtactctgtttccctcatgtattatctatgtctacgtataataataatagctaatatttattgagcttttaccataggctacacacggtgctaagcactttacattgattatctcaattaaccctcccaataatcttacaaagttgctattattatcaccagttcataaatgaggagactgaggaacagagtttaaataacttcctcatggtcatgaagctgagaaatagaactagatttgatcctgaccaggccagactcacacttatgcctgaactattatatttaattccttccaaaaagtgtccagttgtataatgtagttgggttggtttttttccctctttatagtaacataacaaagcaatttggtgaagatagtcaacaacagagcaaaggcaatgtttacagtgtgttgtgcattccagaagatgcaagcatgaattggttacttaacactttggcttgctcatatgtgtagacaccactgtcttctaaattgccaacacatggagtttgctctttatgcattagttaggttggcatgatcacgtgacacattctggaaaagtttgcatggagtatgattagacctatttaatatcagttgattacatatctgttatatagatgatcccaatattacctattaagattattttcttaaaacttacttcattccttttaaaaattacattcctaattcatatcctactttatgatttctcataattttacttgattttcttctcttgaattgtactgtgaatgagataacttgtttgtcaaaatattaaaattaccctttcttgaacgaggttttcagtttcagacctctgatatatctccaatattagaaagcagtaatattgttccataatctagaaacagtatttctaggacccaacacatgagccttctacacatgtagcacctcacagcattcaggaacacagtgaaggtatttattgggagatggagtgcagcagaaaacaaatctatgctagtgggcctccatgtcctcagatgtcttcatttaatgcttactcgggagtggcctcctatggtaaattgaaaatggaattaaaaataaatgcttgactgaagcaatagactataaaacactaatagctaatcatcggttatgctcttattttttgtaagtgtcatctctcagtgctttcagaacactgtgggatgctgattggatgaacttcatttttaacaatgctaaatgggggaccataaaaactaccaacaatagaaaaatatacaaaaacccttaatatataattttttaaaagggtatgtagaatgatagtcatctgcaaaagagcagaaattgcaacattttataaatttttcttttgttctttttcagccacctctgaaaacacattttcctaataagtcaaatctcctgctgattgtactaatttttttttaacacataagatgttgtaaagaaaagtaatttaaataactgtgacagaattgaatgcaaaaataaaatgctttagtgccatctgctggacatttgcaataagaaaaaagtatactcattttaaactaaagaccaaatacgtttttagatacaaactgataatttgtagaactgtagtaattttcaaaaattactcaataacatctggggtaaatttctgaattactgagatatttagaatattgcctctgaagcaacctatgtttaagcctgtgtacaaaacactgtgatgctttttaaaactcacatatacaaatgtgcacatttctgtgattcacaaaattgtaagttttaaacagtgatggatatcaggttaaatatgtgtatataacataatattaaattattcagcatattttcagaggggtagtgccccagattttgcatttatgcttaaagtttcattgggatgattatttttatgaaatgagatgacagatctgtgaaaaaattgccttcattttcaagtttattcttaatgtttgcagtctctgccacatggtggtctctggataatttgcaccagaactactaaaaaagctccttcctggaatttatcccaaacctactgaatcagaagctctgtaggtttgtccaaaaatttgcattttaacaagccccttagataattctaatgcatattaagtttgaggataccaaggaaacacctcttacaaagcaataactttccgttcctttagccataattaaaattagcattctgaaaatagaatggtgtagtggaaagtttgaaacagaggacctaattatcaccaaccattttaccagccttatgtaaggcacataaagcgtgtccctaaattttcccatttataaaatgaggaaattgtacccactaatctttggagtttctcctgtgtctatattttcccaaatgttttcattttacactggattttggaatccttccttcatcttgtctcactctaagaaaagtgcttaagcgaatgccatagtgatgaaccccaagtcctggcaaagaagaaaaccttggttttaagcttgtacaactagatttcttaaatttcagaagtgattcacaaaaagcgttgaaggagacgacaaaggcaaatggtagaataattcatatttcttccaaaggagagcctgtatgctcatatctagaatagcatattatattcctacagctggtgttaggtgaaaaattcacctaagtaaatttagattagtaaagtattgataatttttaatgacacttggtaagagttcaagctatgaaaggaagttcaaggctgaaggaaaaatacactgctgtaaaagcgatttcatctgagttacatacgtttgcaattgcaattgcttctttttgcaggatactatgcatatgcctgacacctgtaaacaacttgtatttataatatcaggtaataaaataatagaaactcaagaccttcttatgctactttctttgtactcccagagccttaaggagtgtgggttgtgcaacagacctcagtagatgtttgttgaattgatgtttggaagattctactgtgtttgacaaacagctggaaagtttaatttgattgtagtgtaagatgtatgagaaaacgtatgtgagagatgctaatagataagtaagtggggaccttgtaccacaggatgagaaattgaactacctcagagatgatatttaatcagtagattgacatgattggttcagtttattaggaagatcattcaggcggtatgaaagatgcactagaatgatggaaaccatcggcaggaagcctagttagaaagctaatgaaataatacaagctaagaataatgagggccttcattcacaggtgatagatttgtgctgtgcattaaatcactacagaaagaaggaggttgtttgttcgtttgattgtatatgtaccttgtatctcagtccaagttttacgttgatttgctgtccctgcagcttcttaaccagataaaatgagcgagacagacacaagtacatatatccacaaagcttgcagaaaaaagatattaaaaataaaaaattacaaactttatttctcaacataggatccatgaagttcaagatgcttttataacccatgataccagccatttagtttatccctaaagaactgagagtcctggggattttaccatgccaatgcagtattttttataactttaactgaagaaaaattagtgcccttcacagacattttaagattaggaaacaaaaggaagttagaagaattcaatttaggactgtaaggtagatgcctaatgattgcctatcaaaactctggcagaattgcccttgtttgatgagaggaatgagcaagaacattgtcatggtggagaaggactctcagatggcatttccctgggactttttctactaaaggttgactaactttatcaaaacactctcataataagcagatgtcatcattccttggccccccagaaagtgagcaagcaaaatggcttgagcatcccaagaaactgttgccatgacatttgcttttgactggtctgcttttactttgactggaccacttccacctcttgaaggccattcttttgattgtgctttgttttcaggatcatactcataaagccatatttcatctactattaacaaatcttcaaataaatactttagcatatttatcccactataaaatttccattgaaaactctgctcttctctgcagctgatctgggtgcaatggttttggcacccatcaaatggaaactttggtcaactttaattttccagtcagaattgtgtaagctgaaccaattgagatgtctatcgtgctggctactatttctgctgttaattatcagtacccttcaattaggatatgaacaaaatgatttttttcctcacaaattgatgtatgtggtctgctactacaggcttcatcttcaacatcatctcattccttctaaaaatgagtcatccacttgtaaactgctgatttatttggaatattgttccataaatttttcataaagtgtcagtgatttcaccattcttctgcccaaacttcacttgcattaatttttattttatttatttactttatttatttatttatttatttatttatttatttatttatttattttgagaccgagtctcactcttgtcacccaggctgaagtgcaatggcctgatctcggctcactgcaacctttgcctcccaggttcaagcgattctcctgcctcagctttctgagtagctaggattacaggcgcctgccaccacacccagctaattttttgtaatttttagtagagatggggtttcaccatgttggcccggctccaggctggtctcgaactcctgaccttaggtgatctacctgcctcagcctcccaaagtgctgggattgcagacgtgagccactgtgcccggtcacttgaaatttcatgtttgttcttgcttcagttttagaggaattcatgttgctctcatagaagctcttttcaaacttatgttttatccttcttagtggctcaaactattagtaggtacttttcagacatgttataacagttattacaagttcattttggtgcaagaaagttttgaaaatgcatagttttttagtaatactaattttctatgaactttttgaagacccctcatataagtaatttgcttggggaactgaatctattttttaaatttcctggtggtggcaaaatgctttccatagtaatgtatgcttagtgtatgatgaagaaaaagaaagggagggagaggagagaagagaagagagggaaggagaggtgaggaggggaaggaaaggaggggaagagagggaggggagagagataaaatggaaaatgaatgggaaagggagatcttagacttagactcagatattgttcacccctggtacagtggaaggaattaagcaatttgacatagattagaggattgtagctgaagtggaagactgaccctcacaatatacatttcaaaatcattttaggaagtcttacgaaaaagctagaaatctgaaaactgcatttcatagactctcctgcagctagaattcctgatgtaatttaggttccatcagtcaaatgggcttgcatgagatttgaattgaaactgatttagatgcagagccacgacaacacactgggcatcattttcccgggatctcctgctgtggctcttgtggtggcttctagatcagaataccttagctgaggtggtaggacactaacactagccatttggacagtaggtttctgatttctgcggcttcctgattgaggaatttggtatttttgttttgttttgttttttgtattagacagggtctcaccctgtcaaccaggctggagtgcagtggcatgatcatggctcactgtagccttgacctccgaggcttaaacaatcctaccatgtcagcctcctgagtagctgggtctacagacatgcaccaccatgcctggctaatatatttttatctagaactagaaataccatttgacccagccatcccattactgggtatatacccaaatgactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaaatgatgagttcatgtcttttgtagggacatggatgaaattggaaatcatcattctcagtaaactatcgcaagaacaaaaaaccaaacaccgcatattctcactcataggtgggaattgaacaatgagatcacatggacacaggaaggagaatatcacactctggggactgtggtggggtggggggaggggggagggatagcattggcagatatacctaatgctagatgacgagttagtgggtgcagcgcaccagcatggcacacgtatacatatgtaactaacctgcacattgtgcacatgtaccctaaaacttaaagtataataaaaaaaaattttttttatagagattgggtctagctttgttgcccaggcatttctcaaattcctaggctcaagtgattcacccaccttggcctctcaaagtgctgaaattacaggcatgtgccactgtgcctggcctgatggtggaactttgagtagttagcttgtgattttgttttgaggggcattccaagagatcaatccaagaccccacaaccatccctcttccaactattttgtagcagaaaactccattatttaacctttttgtctaaaagactgtgctgtttgttattttctactcaactctgacacaagaagccacgatgtacaaacatcattaaaaaaaaaaatagtgacccttgaaattttgcaaacttttatagctcctctattatagagtggaatcaaaaaggcagtttcactaaaagggggacaattgtgttgtggggacaacaaagagttttttaactgtaaaactatatgacttactgtccttctttgacactggtacatgctgtcatgaactgctaatttatatttatgtataacttactttctaaattgattatacattcattgaagtcaagaactgtgaatttatgttcaacagtgtagtgtgatgtcaaaatgtgtataaacaagcctccaacctactagactagcaaaacattgaatttcagtcattattagggctccctcttggacaacccccgtgttttttggaggctcttaatcagtccatcgttctcagaacaactctcctggctttaatatccatgccactaacttcataaggacttggtggtgcccatgtgctaaggttgacgaagggaacgcgtgatggcactgatctgttttctgtgccaaaggcgtcaagggaaacagaggccatgcttattgttttcagcacctatgcccttccaccattgtacacacatcctaaagcaatcctcctgttggaagtcctgcatgcaaactatcctggcctctgccctgcttttacctcagagaaagccctcacctgctctcagaacctaccacttggagttttaaaactttaaaacaatagcttccatcctttcctcctctggaaaaatccagttctatttgcctagacttcataaaggaaatccaggaagaaaggtagaattttctcctagattctcattactttgggaatgggagaagaaaaaataccaaatagaaaaatgtgaatttctgcactaattagaaggatttctctacattccactattatgatttacttgttcaacaaatacatattaatttgtacaaatgtcatcaataattgcttgtttaaattatttattttgcattcatagcatgatatttagattttcagacatttatagaataatatttagttttttaggcattcatctttgtttcttttgaaatatatgctattaatcacccaaacaacttttttacaaattgaattttagagtttcttgaattgaatgtacaattattaaaataatgcaacaattattatatagtgaaacaatgaaaaaaaacagaacctcatatcctgggagaaagtttcaatatcaatgcttttcttttgatagcattgtgtattttacaatactctccattttccatgtggataatttaaatctgtgatttgtgatcatatattttgttaacctcactagtcaataagaatatattgttaattctaaaatcgaagtgtacaaataaatttcacaaaaaggttttacatttgcagtcccacatttactgtaagaccatttaataaaatatgtatttccatttattattcataatagaacactgtcacaaatcttaaagcattaaaacatcagatacaaaaaataaatgtgctgtttatggtttcactaccagtatcttgcttccaaaggcacattttattatgaggacagcatcttgacaacatgagatatcagagtaatgtaaggggaatatgaattgagaaaagggcattaaggttgtattttaagagaacaatttaatagaacagtgcaggttatggaataggtagattttaaggacgtaggagtgaggaatgccctctctccctttcctccttccttccctccctccctccctccctcccttccttccttccttccttccttccttccataatattggctggtaaaataaggagcattgcaggaaataagttggagaagttgacagggacctgagttggactttttcttccagagcagaataagagaatcttatctgtaagtaaaggaagaaacccagaaagaaaaaatatttgaagattaagagagttatagactgagaaaaagcaagctctttcttctctcattatactccctactgggacgtctataccagtagtttaaacaagacctgctgctgaaacaaaaaaggaatttctaaagcacatgagaggagggcatagatgggtacaggtcaccaagggccagcattgagaaggatgtgattccctgtagagtttggagtgatggctgtgtgaatggcctcatgagctttgggatgaagcacttggtgaaaagctgccccaggccacttaggtatgtccctctgggagaagaacatggtgccctggtggctgtcttccttaggacctactccaagatcccccatggagaaagtgagaagctagagatctcaccgtcatacctcagtggagaagtctcatccaaccaactcacttgccatgaccaactagaaaaggaataattgctgcctgcccacctgtcacagccaggagaccttcaattctatgtagccctgatttgctattcaatgctatttgatgagacagaactgaatctgaatctttttctttctaatattaaatcattcatacatacaaaacagtattataaaacatacatgtaaggtgtaaagaaaaaataaactacatcatgtaacccctccgccactagcttaagaaataaaacgattttaggaatttcgggtcctagagagtttgggaaaagtttagatatgtattaagcatatgtatgtgagtatatatatatatatataaaaacatgtgtgtatatatgtatatacatatatgtatacacacacatacacacacaaagagaactcaataagattaactagtaagtttaatctactggatagatatacatatgttatatgcaattaagtttatcattgtcatgtgcaaaataaaatgaatactttttactagtagtttacactctgtagtaatgcttttaaatttaagctctataccagtttttgtttttttgcttttctgtttgtttttcttaataattccctgagatctcttttttctatccttttatttcaaacattctgtgcctttatattttgggtatatctcttcaaaacttcatttagctggatttttaaaatctaatgtgatgatctttgtcttttgatgatacttcttgtaatgtataacatttgtgattcctcatgtgttagatttttttttaccatgtcatactgtaatatttaaatgttctgctttgtctatgtttatgtatttatttattttaactcttatcttcttttagattgacttttttctcattccgtattttttccgctactggtttggatatcatacactctatttcaattatttttggtgaatacctaactaaaattttattttcaatcacttctacaggagttaaaactgaagttcttggtcacagaacctcagtacatgtttcttggcatctgcttcagagatatgttacttttctgaattactgcttctctttcatttttgtcctttgagaatttgcatactttccagctcaaacgtacattaaaagttacctttttaaatattacacccagaattttcagtgttttgtgaagtaggatgtattaggatatgttgtcctcaatatgaacttgtttgtaagttgtatggacttttttctcaaaacagactaatttatacctatatgtataaattttccattcagcaaatatgggtgtgtattggctgctacaaaggaagtgtatgcctgaactatttgctaaactgcatttccaatattgtttactgtttggtagaagagaggtgttatgtacggtaataaaacatagtaaaaatattaaatggtctatgagtgacccaaatgaaatgctatgagattgcaatagagtaaggttttatctcagtggtcagtgccctgcctgtatatattgcacaaagatttcctgaaacaggttcccttttgattgcaccatataaaattcccgtatgtttgaatttaaaaacacacagaggctttggttttcaagccattatatcttagcataaagcacgtactaatgaggaattgacaaactgctgtatgggcaaaatctggactactatctgtttttgtaaataaagtttcattggagcatatttacattcattcatttacatactatctgtggctactttcctactacagcagaaatgagcagttgcaaaagaaactacatgaccctcaaagtctaaaatatttacaatctggctttattccaaaaagtttgccaacactcatactacatcatgttctatattttagaataagtgtatagggaaactttttccttagcctagttttctccttctcatttatatttacttaaatagatttgatttggtggttctcacaataaatatttatttatgtactctctgcttagagtttccttggttagatatatttccttgctcttattacttaattattattattattattttacttatttatttattttgacagagcctcgctctgtcacccaggctggagtgcagtggtgcgatctcagctcactgcaagctctacctcccgggttcatgccattctcctgcctcagcctcccaagtagcagggactacagccaccgccaccacgcccgactattttttttttttttttttttgtatttttagtagaggcggggtttcacagtgttagccaggattgtcttgatctcctgacctcatgatccgcctgcctcggcctcccaaagtgctgggattacaggcgtgagccaccgcgcccagcccttccttaaaataattttctttagtggaagaagtaagattgccggtgccattttgcatgataacttttgaaataacaagtgcccacagttgttttctactagcttgaccctagattaattatacttaaagtataaaaagttcagtgtatcaaataactcttcgataaattgaccagatattcttgcattcattaaatgaaatatcacatatattcctttatgaagtgatattagctggcctttaaattgggaaatatttcagatcctaaactacactgttatgtgctggtgcttggatgtttgctttaattattggaattaaatagaaaaggtgccaactggcaaagcagcaaagggatttgagaatttttaaagtaatcacagaagttctgcttaagagctattaaggttaaaaagaaaatataatgaagtctcaatacctcaaacactgcagtacctggacctaacttatttgattctatttccagggagtatcagttcctcacagttatcttagattgagaacatcaaactaactgcctgaattaacaaaagcatctgtgtactctgtgtcctagggaatactcaaatccaaaaaactagctcagatacccagatgaatttgagcaggagtccctcttttggcgaaatagccaatgactattggctaggctcaggacaactctcagttctcattttcaaaaccaagacatccttccactggggcattcactggatgttcttgtgttctattcagaacagcaaacagttctatttatagagatttaagattgggatttgaactgatgtcgatgggaggagactttaatcacattaaatgtgaacattctaatgggaggtttccctagacaactttagttgtccccacagtcagtagttaatcaggagtggttgctagcaagcttcatacatattacctggttaaaataatgaaaaattgaactatgtaaaaatctgcatatctacaaggtaagatttagaacttttgatgtgaactgcaagaactaggagctcaaatataatgtaaaagctaacattctgtgtactgtattaaattagatacttgatcccaaatagataagtagcctccaggaatgggggatagaagacagattgcccagcaacatagtctaaaacagtatttgtcaaagtatgcatcatgctcaaatactgggtcatggaatcaatttattgtgacaaacttatttttgaattatattcagtattaaagttagaataggatagaaaatagtagagtacatcatatgtatttaggctaaatattttgtgtaatttttgtttcagttatatgcacacatgactgtagttgtaaagtgttgagctctcagttgaaatattttgaaacatctaaaagaaacaggcatggaatagatactcaaatttcattgctggcgacaaacagggcttatgtagcttctacatacacatagttcagtgctaataagcaaaacagggattatggaatcatgctaatacatatcctacctttgaaggtaaggttagtggggaaaatagttttgtatgttttgctttagttcaaagagctatgcttcctttttgttaggaaatattccttgttttgtttgttcttggttttgtcttccactatttacttagtttgctaccattttctcttttgcctaggagattgcatcaacagtttgaaagctataaggaacaagtgagaaaaataggggaagaagcgcggcgttaccagggcgagcacaaagacgatgctccgacttgtggaatctgtcataaaacaaagtttgctgatgggtgcggtcatctctgctcctattgtcgcactaagttctgtgcgcgctgcggaggccgcgtgtctctacggtcaaacaacgtgagtattccatgaacataaggggcgttgtgaatgtggataaaaactattacgccttccaaacatgagaacacgtgcatcttagaaagcagacatgtgcataaacatacacgttaaaatgaacctccctcattttgttcatgtccttaataaggtagtggaatgctgatgaaagtaattcctaaaaagaacttactttatctttgtttcttaatacatgattccaattcaaaaccaacagattacctgtgagaattcatttggtttttgaaaaatgcagttaatgtagatttaatattatcataaattataaaactcttgaaagttatgaccaattcttttaaaaaagttaactacttttgatttctgtaacattagtattcagattgaatgcacgtaaaatgcaaaataactgaatgtcatatattaagcaatgattagcctctatgagagtaaattcagatttactgatatgttaaagaaatacagtggcaagcttatctcatggaaattatttagatatttaaagtctattgagatttgcacttctcattttcttctctataagatatattcttacctgatgatgtttccttatttggcttaaataagagctacctactcctgttatgccagtactttaaataaatgcaatttttgaagcgttaagatgctaatatgataggaaccaatattattatttatgaaatactagagtaattctaataaatatttagtttagaatacattttaatgttatactttatcatattctctaaaatagtgcagtataattatttatagggaaatcttgatagatttccttgatagagatctgcagcttaatgtagaacagttacaagcatgtagctaaagaattcccagtgttcctgtaaagaatttgtcatattatctaatcattaatagattataatacgaagtcatgtttaaaaataacacgaaatctttaagccctcttgatatttctctattttgcacattacagttaaatttaaaacaaacctcccaatcaacattatattctttagtagtctagttgagttacaagtcagatattctaaactttattccagtggacttaagacactgagtatgatcaatatatctttttttttttttttcttttttttcttgagacagagtcttgctctgtcacccaggctggattgcagtggcatttggctcaccgccatctccacctcctggattcaagtgcttctcccacctcagcctcccgagtagctgagattacaggtggctgccaccatgcctagctaatttttgtattttcagtagagacggggtttcaccatgttgaccaggctgatctcgaactcctgacctcaggtgatccgcccgtctcggcttcccaaagggctgggattacaggtgtgagccactgcacctggccgatcaatatatcttatactttaaggtgagactgttactacctctgtggctttaggaagataacttctctgaacagtttctttacctatgaagactggatagtaatatttaccttgtatgggtgttatgaaaattaaataaaaataactaaaatctaggtctttatgatatgtatatttaatctttctttagggtcccattcttatgactccataagttttcttttcctctcctaatagtggtttgttataggcaatcatcatatgccaccttataggctttctaaaataaacttggatattaaggttgtatctggcacatagaaagtacataagatctatttgttaacttccccttctatagtgctctttaatacactattttggaatacattcttacaggtaaaacttggaggcaacatcaaaatacttaacaacccatgtggtaaggacattgttcagtctgaaaagatgttggcagtgaacaatgaggcgcagatcagctgagtgctagtgcttgctaagcacccacaactgttaaatgcttttaacttcccattataggtttgagacatgccaatagcaatacagttaatgattgatatattaaagtcatcaggtcttaaaaaggagagggtgtttaaagaaaattgaggtaggaggtacttacgctttggagaggacactcacgcctagtgtagttcatctttactaaacccatccaatcttggaaaaaatatttaaaggaacaaaataaaagaaagcacacatcttaagatatttcattcggagcacaagacaaaaacattgtataaagttgtttttttctataacaaacgttgaaatgtgtatcacaaataaatattgcctgtggaataatttattgccaaaatagttaacatatttctcttcccatttttatttattataaacatttctcattctttacattttcccaaattgtgactatcaatattttaacaataatttgacaaaattattgatacaattttatgcattttaataaaatatttttcaataataggtagactacatgtggtagtgaattaaccttctttatgaagaatattttaaatctagatttactaatccaagttctaaaatattaggaaattattgtgcctaactcttgtatctaacatatagcaggacccataatgtttgcattttcaatgaaggattgaacaattactattttttaggaaaagtaaacatttacttttcaaaatagttgtgctttaatactttgaagaaacacataattgttttcttaaaaccaatttattaatacatggctcaattttgtttttcttttctttgtcttctttctctactctgcttccttggatgctttcccaaaggaggacaaagtggttagaatccatactttcttttctatcatttgttattgtattgttgtgaactttattaagtgaatgttgcacctagtattgttaataactatatttcacaagaaattatatactaggaagagctcatttccagctctcatgaaaaaaataaacatttaggagcattacagagtttgatattaatagataaagtctggatagtttgagttcatgatgacagtgaaattttaatataatttatatcattgcaagctcatttatctgcttgactctgagttttgatgattattccaactgctttcagaaacaataaattctaatgggctctacctttttcagcatgcaaaggcaggtgatttgaaactttattgcagaaggaatggaaaacacttagtaaagggaatggatcaaattcaagtaaagaggccaaagtataattatttttctatagaacacaagtagcagagttgtcatactgaaccacattttgcctttttcttctctcctatgaatatgaataacttgttaggagagtaaaaggtcacttttaactcttatcagctgtagaaaccacagaggctctttgtgcctgggaagataggctccaagtagaatgttcagtcagcctttcctttgtataaacactatacaccttcatttggtgtaaattttatacatactatacaccttcatttggtatgaattacaccttcatttggtgtaaacttcctcgcagctcattaatctaccaatatgagaatgagacaatgagtatttcaggtttaatatatcaactgagctgcctttgttcaaaaattttaaagcttatatgatacactgcagtgcataattagcaagtgtgacattaaactgaacattaatctgtgtttctaaatttacgctaggatatgcttattgattttttctatgaaaaagaaatagagttgaaaaattatataggataatctatttttggtatttatttttgtctgtaccattgactgtatgtgggataattttaggggatattattataatgccaatttcatcaatattattactttggatgagttcacagttgaaacgtgggtaaagttcctttaaagagtaaaagtgtaagtaaataatgctggtgtttaggcagatttggtgataaaatttaaactgctctcctgtagggctggccaaactcactatccctttgacagcgttacccataatggtaggttatttgtgcttgttatgattatagtgtaatgagaatacaggtgggttttgtggactcagactaaaaatagagtggaaagacctgtaaaatataatcactttcaattattttcttcactttggttagaatgtatatatctatcactttatttttaagtactctgtcataatttctttaaacaccattttagcttattgaaggagttcaatgaatggcctttctagccaagggaaactgaagccacattttgtcttagccatgttaaagagaataactgactattaaatgaaatactttattgccagttctttccctattcctctaatctcttttatttttagtagagaaattataatttacatgtgtgtggtgttggtatgggtggaaagggaagagagataagggtgaataaaacttttctaaaagtaatcttcatcttgatcaatataataataatacattctacttgatctgttaaattggtgaagaactgtgattaaaataaaggagtatgtgatatgaagtcctaagaatagctaatttataaatgtttcctttgttaagcccggcaaaattattgtcatattttccatatcagcaatattttattttaaaacttcatcctcagcctaaatcatatctaataataacttggaagattttgtatttacttataaagaaaattgctgtcataaagaatgactttgtaatgggcatatgtaatggttgataaaagaaaattatgttgtcaagtgcacactctcattggcaaaattatgattatattttttacttcattaaaagccctccttgaagcctaaatatatagcaatactctaaaatttcccatagccagtttaaattacttttatctttgttttactatttggtggcagaggattgaatttagatagctctcttgataatatttaacactttgctgctgctaagccaactgaattgaatcctgcaaacttaattcctttgggatttcccataaattttcatcactatttttttagtaaggatgattggttgatgaatatagcaactaaaatgaacttgctacgtttcttgtttatctgtattttcacaaagaaagtgtcaggttttataagttaagattattctacaataaatgttagcattactctgaaaaacagaaccttactattttcttattctttcaacatatgaaagctgcacatacctaccttttaagtatcacatataaaaaataatttttatatcaaagtaataacaagacactaaattgacaaagttacaatttttcaactagtttttcgtaactgtccattgaagtttgttttaagacatcataataaatgatatgttagtaaataaatatgcttttatagaaaggcttataaaaggtgggaattggcttggatgggacaggatgttggcttgaatggtatagtgccaactgaatttgaacctggctgtattataaggtgttgtctgtgggatggttgattcttaacagcttaaaaaaacattactctcaaagactcaactcttaaataccaaagtgatgatttgtttctttctctggctagcattaaaggcaaccaagaaaaataaccatttttaaaatgatttgcatgattgcattaaatatttattcttgttatgaaaagtcttctcagagttatccatatttagctcatggcatgatgaagcatatgatcctaatttacaaccttcagtcttttgaaaaagtgattataagagtttgcctggacccacttttatgttttcttctttttatctggatgttttgatagatttctctgacaaaagttcttttgaaattcttcccagaaaaataacataggtctatatagaaagtttataaatatagataaatacatcaataagaaaagtttagaatgtatcaagagaactttcatttggcaatttggctgattagatttcacaagctgtctggttttgctgagcttatcctagagaggaataaaacatcaaattgcagaaacttttatggaagataattcagaaagctgtgaatttttaatgacaaatctatttttgaaatttgctagcctgtttttgagatttgctagcctgttttaacctcttgcattcagcattactattctttaaacttcgtatgattattgcatattgcatattattgcatattatcaaagttctggttagtcttggttttgtaccttcctgcatcatcttttagtacagttataaaatctgtttcaagaaattataatttttcaaatcagtattaaataaggattcatagtaggactatgggagctgctcaagggttagaaaattagccttttctagtataaggaaagggctatggtagaaagagcttccaaaaagttaaggactatggacaaaattcttgatatttttgtgaacatacgttgtcaaatcttacgtttatgtatctaggagtggaattactgggtcacatgaaaactctatgtttgtccttttgagggactgccaaactttccccaagcagctgcatagcaataaatgggggtttcaatttctccacatttttatcaatgtttgttattgtctttttgattaggagccatcatattgcaagggaatgaagtagtatctcattgtggttatcataaaactttttttagccaaaattatcaaacttgtttgatatctccaatgattcagtctgtgtgaacttttattcatacataaaaatgcttctagcttagtaatttcttgagaatgaatttttttaagacatattcaaagttttagaagttcatttttttcttctctggggattctttatttctctaaattagaattatataggtacttattaatccgtataagtcaatctaaacaggaactctgaaatttaagattacttggaatttaatatctgtctgtctggactaactatccctaggatgcaaagtaagagatttttatgaccagttgaaaagactgctttttaagctcacaaagagaactagcagtttcagttttatctctcagccataggtccaagattaacagagaaacttaagtgcctactttaaaaggctattctttcatggtgcataatatattttctctagtgaactttcagtagcatttgaacagatgcacataaatactgacaaccaaattttctgtcatctgccacccaactttcaatatatgccacatacctgccatccaacagatttcatggacagggagctcctgaccactcaacagcagttacttataatggagcttctgcaccatggagctggaaatggggataagaaatgttggtagccgtttcctctgggactgatactgtagtctttcagaactggggagagagagagcccattcacttggccgtacctaccaagaatagaatttgcatcttgctgagcatggagcagagaagaaaggaagttggttgtggctcaagtctcttgctgttcttataaaaatttagtagagtttctctaacagatgtttctacatttgctgtatacacttcagacaattttcagatactttaaatgactgtttttttttaaaaaataatttttattagttgtagttgttttgctggggagaaggatctgcagaggtcctcacattaccagtctggagttactcaaatagactcttcatagttttgtgttaattcatccattcacttatttatttattgagttatttatttttgagacagagtctctatcacacagactggagtgcagtggtgcaatcacagctcatggcaacctaaacctcccaggctcaaaccatctttccacctcagtctcctgagcagctaggaccacaggtgtgtctggctaattaaaaaaaatttttttttaaatttttgtagttatagggccttcctatgttgccaatgctggtctcgaactcctgggctcaagcgatcctcctgctttggcctcccaaagtactggaattataagtgtgagccaccacagcagtctttttattcattttttattcatttatttattcatttgttggcttactgtcatcagtagtctcatatataattatttttatttcaaaattactatctcattcttttcaataaatgcattttacatggtaattcatgccaagatgctctctttctgttcatcttaatataaacgttatttgtattcaagaaaattcaattgcatttcatcactaagcttacttttgtttaaccaagcagccactaaaattaattattataattaagagtaaattctattccttgggttacatgaactcattcatttattcatttattcagggatttttaatttaattttattatgactacattaggttaaatagttaatatgcaatgcagataataaacactttcttttgcaagtttattatttaataaattcaacttaaaatgtgtatctatatgcatatgtatacgtatagtataactataatgctatgttgctgcataataattttatgaatgttatattaaagaataaatagaattccctcagatttccccttagtgtacaggatgacaactgtctagtaattcagccagcaccccaccaaaccttttagtgccaaaagcatcttgtgctgattttcttataagcctcaggtctactagactatgactattcctcatattctatttattaaagcaggtttgaagatattttttaaattttggaaaatatgttctaaatttattagttttgcagttactttaaaaactttaaaaatatgttctaaagcttgtaaccataacatgaaattagatatgtagatcttaaaaagtccttgtttttatatatggccttactaaggcatttaacaaatacatttattcattggccgatttattttgtttttgtatgtatatatgcaatagttttttcatatgtaaacttcaacagcaaatattttgttttcagaaagtaatccttttgaatcactttacaatggtggcaaaataattttgtgcatttaatttatgaacatctttgttataaaagacttaatttttataaaaatcaatcaagttgtttttattgaccaataaagtgctgttacagcaaattacatgggaaagagtagaaaactaaatctttcagggagaaaataatatgccttgtgactcttcaactacttctatggaatttgaaaatgtctgtgtcttttaaactacatagaaacacagaagaccaacaatgtcagtcactgagccaatgtgcaattataatgtttttcagtacaagctaaaccaggaatgacaatcacaaggagaagatgcacttgacggacagtatcacagaagtttctaggtagggcagtaagtcaagcctcagatcggtagttgggatttttcttgttttgtttgttgctgtttttattgtttgtttgtttgttttattttgcttttagacatggttaaaacttgtattactttttacaattactttgttaaattacgtgtcagactagtgtatgatggttcccctaaaaaatatatcttctgaaatctatgtattttagttctctttaaaatttactattgctagagatgcttaaattgttattagatatcaaaggaccatttgggaggactcttgtatatgagatttatgcgtcatatgcagattaacttcacttaccagctatcaataactactaacttctcttagtatatctttctcttatatactttcatacctattttcagtttttctctttgttgaagtactttttgtcaaactttttccagttgatgaagagctgtctatcaaagggtcagagcagctcaaatgccatcctccatgcagagtgctccctgagtgtaccagccagaattagctctttctgcatcatttacacttcatcattatcacagattccattttaatgtgtgagtttctggcaggtaaggaaagaatatatacacccttgaatactctgataagcacctggcttgaagaacaaataaaagaacataaaatcctggtggataatagaaatgaaaccccaccaggagcggtagctcacgcctgtaatcccagcactttgggaggctgcggggagtggatcacctgaggccaggagttcaagaccagcctggccaacatggcaaaaccctgtttctactaaaaatacaaaaattaaccaggcgtggtggcaggtgcctgtactaccagctacttgggaggctgaagtgggaggattgcttgaatccgagaagtggaggttgcagtgagccaagatcgcatcactgtactccagcctgggcaacagagtaagactccatctcaaaagaaaaaagaaagaaagaaagaaatgaaatactaagttaggtgacagtactgttttgcttcttaaaatagttcagtggtgatgatgtggtcaaaggacaattaaaaacaatggaactgggtaggggccagttaaggggttatgagaagacatttacacaaaatataccaaataaatttcatatttgttgggaaaatgctaattaaatgagagaagaaataggttcgtttcaattctgacatattatatgtgtattaaatattaatagtggtagctgcagtaaatcattcttagaaactaatgtttattaggcatgtctttctcaaacactagattgatcacaaggcctaattcctgtgatgtttatatcagagattacacaacagccttagcatttgctggtatcagcccgattccattctgtttttttgtttgtttgttttgttttgttttgttttattgtgttttgtttttgagacagggtctcattctgttgcccaggctctagtgcagtgccatgatcagggctcactgcagccttgacttccctgggctcaggccatcatcctacctcacccttctgtaactgggactgaagtgaagtctcctgtagctgggactgaggtggctgaggccatcttcgcttcctgcagctgggactacaggtgcctgccaccatgcttggataattttgtgtgtgtgtgtatgtggagactggggttttaccatgttgcccaggctggtttggaacttgtgggctcaagtgatcctcctgcctctgcctcccaaagtgctaggattacagttgtgagccactgggccttacccagttctattgtttttaattgttactctttgactacatcatcaccactaaactattttaagaaacaaaacaatactatcacctaacttactatttcatttctattatctaccaggatcatatattcccttattttttatttaaacttctgtcttttcatggagattgaggaaacaaaagactatcctcctgccctcactgtgggttaactacaagtacatgtatctcatttttcccaatctatatttgattctatttttcctctaactttgaaactttaaaactaaagtttcagtttattttattttattttattttattattattatactttaagttttagggtacatgtgcacaatatgcaggttagttacatatgtatacatgtgccatgctggtgtgctgcacccattaactcgtcatttagcattaggtatatctcctaaagctatccctcccccctccccccaccccaccacagtccctagagtgtgatgttccccttcctgtgtccatgtgttctcattgttcagttcctacctatgagtgagaaaatgcagtgtctggttttttgttcttgcgatagtttactgagaatgaagatttcccatttcatccatgtccctacaaaggacatgaactcatcattttttatggctgcatagtattccatgatgtatatgggccacattttcttaatccagtctatcattgttggacatttgggttggttccaagtctttgctattgtgaatagtgccacaataaacatacgtgtgcatgtgtcttcatagcagaatgattcatagtcttttgggtatatacccagtaatgggatggctgggtcaaatggtatttctagttctagatccctgaggaattgccacactgacttccacaatggttgaagtagtttacagtcccaccaacggtgtaaaagtgttcctatttctccacctcctctccagcacctgttgtttcctgactttttaatgattgccattctaactggtgtgagatggtatctcattgtggttttgatttgcatttctctgatggccagtgatggtgggcattttttcatgtgttttttggttgcataaatgtcttcttttgagaagtgtctgttcatgtccttcgcccactttttgatggggttgtttgtttttttcttgtaaatttgtttgagttcattgtagattctggatattagccctttgtcagatgagtaggttgagaaaattttctcccattttgtaggttgcctgttcactctgatggtagttcctgttgctgtgcagaagctctttagtttaattagatcccatttgtcaattttggcttttgttgccattgcctttggtgttttagacatgaagtccttgcccatgcctgtgtcctgaatggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccattgcttgtttttctcatgtttgtcaaagatcagatagttttagatatgtggcgttatttctgagggctctgttctgttccatttatctatatctctgttttggtaccagtagcatgctgttttggttactgtagccttgtagtatagtttgaagtcaggtagcatgatgcctccagctttgttcttttggcttaggaatgacttggcaatgcaggcccttttttggttccatatgaactttaaagtagttttttccaattctgtgaagaaagtcattggtagcttgatggcaatggcattgaatctataaattaccttgggcagtatggccattttcatgatattgattcttccttcccatgagcatggaatgttcttccatttgtttgtatcctcttttatttctttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaatgcttgtgatttttgtacattgattttgtatcctgagactttgctgaagttgcttatcagcttaaggagattttgggctgagacaatggggttttctagatatacaatcatgtcatctgcaaacagggacaatttgacttcctcttttcctaattgaataccctttatttccttctcctgcctaatagccctggccagaacttccaacactatgttgaataggagtggtgagagagggcatccctgtcttgtgccagttttcaaagggaattcttccagtttttgcccattcagtatgatattggctgtggatttgtcatagatagctcttattattttgagatacatcccatcaatacctaggtttcagtttttagtgaagagtaaaagttgtgatcctaagatgaattagtggatatggtgtataaaaggtaatagggagtgtctaaaataaattaagaaattgtatattagcacttcttgtgtttccacctcaaaactattctttaaaaagcaaagtaattttgatgagtctgttttggatgtctttaatgtttccttgtattcaagataaaagaaaaaattgtataaagacatggataattggcattgtcttattaaagttgcttagttctttgtgtggtcttttgatctgtaggcatgtctttctttatccttgatcattgtttctcagctacctactttgacctctcctttctattatccaatgtatgttgaattttctgtacctaccttctcatactttttctcatcatcttcaccaccttccgttagtaatatttttcaaaatctcaaagctactcttatatgattattcatccaggtaaatttgaataatctgaaaacaaaattttgttgatagcaggttgtcctgttttcatggaagaaatgtcttctcataaccccttaagaatatgaattgcagttttctttttaatgtgatttccccaaattcttgtaatactgtataatatggctgtctcttagagaaacatttgctctgattcctcagtaaagttccactttttcaagttttcatccattggtttgtttttggacttttatattgatcttcttctaaattttagttttagataaagaggagagttttacttttctatgagtcccatctgtccatttcttgaaaagtctatgaaagatgcaacgagtaggatgccaggcagcagggagttcagggcagggtttctgggagaggtctctctctgggccactcccactctagcattcctagtctgcattcctttggtagcgtcctcagtagtgttcaggggattcagatttctttccccacagttgtcccatggatcatacttgtctccagcctctggaggtgcctctgaacttccaagtatctataacagagttctaattgtcctagtaaacagtgaggagaccaccaaagaggcttcagcctggtagtcaaatatattagcagatgtttaataagcatctcaaatttaatgtgtaaaacccaatccctgctttagctctccaaaccagcttattccagccttcttcactgtagcaaatgactaacacattattaaagttaacaaaactaaaaatcttggaatcctcctggcctttcctccccctgcatccaattcatcaggaatttggctctgtcttcaaaatatatccacaatgcaacctcttcttaccacctccactttcgccaaactggtccaagacaccatctagtctggtttattgcattgaacccctaattggcctttccttctcaacccctcatcccccaccccactcccaaagacaaatctgagcaagaataattgtttgaatgtgtaaaccagaccatgccatgtacatctctgctcagaaccctccaatggcttcccatctcatccaaagtgaaagcaaagacccctacaattgtacccaacaccctgcatcatctgtactccacacatacacacatcctctcctgtcactgtcctatctgcctgctaccttctgctcactgtattcttcctggccccagtgcatactaaacaaagccctgcctcaggctgctagcataactctcttttcctggaacattatttccactcctcactcccaaactctcttcaggtctctgctcaaacattaccttatcaaagaggcccactgtaattactccatgtaaaattgtagccacagcccaaccatagaacatcctttctttttaccatgtttgatttttctccacagtacttcaccctgtgaaatatatatctacctctttcttttctcattgctagctctgtagaaaagggggactttaactttgcagtattctcagtgccaacaaacttgcctggcacaggtagccactctaaatatgtgatgaatattgagaagtaagtgtttgacttctgagtttgtggagtcagcttcatgttaccagggcaaagtatcacttctaaattggcacaatccctgtaccttgagaatcccaacaggcaaagccctgctgtacctggtatgctatatttgccatggaaaggtaatgaaataaatgaaatttgcagccacagggcagtgtgcagagtcatggtatagttattaaaggctttttctgccctcacccacttcacccccaatctatccttgctctaggatcatgtgtcatttagtttagggttctctggggaaaatctgtttatttcaaagccttccattcatccgtcttggatcatggattgaccattgttttactaggcttgattctcgtctgtatgacttccaaaattttctcaaggtttctacttgattaatgatttccatccttgtggcatggaatatgtctatattttattcttatttttatgcttttatagcatttgaaatattaggaaattgtgtttttgaactgaaactttgttgagtaattttgataaagttgaacttttggaaaaataatgaaaggccttgaatagaatagtagccctctgccaattgaataacttttagcttttatgttgacattttacacgattaatttttaaactttcttttgaattctagaataagcagcaaaaaagaattaaaaatcacttttttagtaaatatattcaaatattactttagtacttttattttctttcttataaaccccaagtgttttttcttctttaattcttaatatttgcaactgtaactgggctgatcaccaattagtgaaattcagtgagtttgtatcctagtgactgcaatgggaaaatacacagcaaaaatgcaaatgatattgaaatatcaaataaaaatataggattctcaattagtggttagtcctatgcaataaatgctatatgcaagacactttttaatcatttcactccttgccctaaaatacataaaaagacaccaataatgtaacctgtagtatattcattttttaataatgagactgttttatgaactataattatgtcaaatatcaaatgaacattaagtaattattctttaatgcatctcaaagttattttaaagagaaaaaagtttcaaatgtagaaactcattgttgaactgtagctactttgtcattggtgaagtaagatattgtgatgattagagaaaatgaggaaattagaatttgacttgacacaatgtagtaaatgtaagtaagtcaaaaatatacttttataatttgtttttaaatttgtgtattattttaaatgtgtacagagtagtttctaatatgcattatttcatggaattgtattcgcactggagtcgtattagttattacaggcaaaattctttataggtatataagaaaagtgaggccagagaagtttagtgattttctatacatcataaagttgacagcatgtggttgaaaatccagggcacatacctcagagctcctgacttttaaaataagatcatttgattaatttatgtcaagataaattattgttataaaaattttatgctgcttataacagattttaaaggaaatatcaaattttttttgttaattccttcactttgctgtttgcttgggtgacatgagccatgcttaattttcatggtgcttttgctcagcctttatagtgctgaaagtatagtaagcactcagtgaactttgaatgaatgagtgaatgaatgaatggtacttctctgtaccttttttttccttaattatgttgttttgaaactccagtgtttaaaactataaaacataattttgtattttaggatatgtttcctaaaataaaatcattagaactgtacttagctattgttgtggagctgtcttatcaaacctatgatctctggctttgcattctctactctattcagattttatggtatgagagggatgtttggtcttcttcctcacacaaagttctagaagatacttgagttgagcagaataaaaagaggctcccaccagcttttttgtttatccatgtccaaatataaattacctactgaacgctgcatatatgataagtggaaacagataaattttattgttttggaccattcactcaaatctttcaagtaacccagtttctgtttcatgaatgtttcttaatcttacacttcttggtcagtgatttattattaattggaatgtattgcttaaattcatacctttgattggcatatgagtttgattacagacattcaattttcttagacatacctaaaatagcacatttttaacaaagaatagtattattagaaactgatttcatccattattttaattcacttttttattagaaagagcatctattgagaattctgtgacctaaatacataatgtatatagtatttttgctatccttcgtatgtcaatcaaatgtacagtgtcaagttgatgaatttacaaagcgattaaatttgttacctatatttgagattgcctttatctaggtttgtcaatgctctgtaagaatttcttcccgcttagacttttggttaatgcattagaaagtatttgagtaaatataattttctaaaataatattattccataataagttaccctatgtttttgtgatttttaaaggcttttgctggtgttatttttgctttttaatttcaggaagctaaaactttgtaacaaattgtactatgtgaattggatatagcaaataactaatttcctacatctcactcaactgtggggttaatattatttaatgtatggtatatatgcaaaaatcacagctcgaggttcattaatatcctttatttcttttttcatatcttttatttcttatattaagatgctttcatttgaacccagcttttttttgcttgcattcacagaaaccttcaaaaatatctttaaaatatttcattctaaattgtgttacagatataattgtacatgtttaaacatattttagaactagagactatggctagcagaaataattcttactgacaatataaatatgtaattactatatatttttgtttaggaatagtatacatcttttctattcctacttaatgtatttcttgtgacattgctgagatgactactgaggcagtctggactagagtgagaagcactgcagtgaatgctagagaatctgagtttagtcacaatctaaactgtcttctaaggattggcaactcacttgaagtatctctgcctcaacttttatacagaaaaataggcagtacccaacaccagttctcttactgtttggcttagaccatggtgagctttattaggttggtaacaagagtcatcaagatgtgtaagtacagatgttgggggaagggatgttgtcacatcagaaactaattctgagtgggggtcaaggtgtacaaaaacgagatgaaagagaactagctcaaagaccattgtcagaatccaagaaaactggaagtagtctgaagacagttgtactgtttcatataaatgtaacacaggatgcagttccacaaatttatactcacatgatttactctttcaaatccccacttacttacatttaggcaactatttaatcatcttaatttccctactttatagaggtctgcaaactttttctgtaaaggatgagagagtaaatatcttaggctttgtgagctttacagtctcagttacaactactcacatttgtctttatgcctctatatagccatagataatacaaatagatgtggccatgatccaataaatttacatatggaaactgaaattttatgtgtcatgaaatatcaatttttaaatttcttctctcaccattaaaatataatagctattaatttacaaaacattaccattgaaaatatcaccaattgtggaggcagacatttttggactaatatttattgagcacataatattgttacagtgctgtcagttgtaagtgtgtgtgtatatcataaattcgtgtgtttttatttaatcatcatgacaaccttattaatatctccatgtgacagatgagaaaattgagtcacaacccaattgctccaggtcatgtttgatttgctctatgcttgtcttggagaattccgttcctcatatctggtcactttaaactctaagcaagtgtatacaaatcttctgaggtgcttgtttaaaggtagatttgttggtgtcactcccagaaattttaattcagtaggtttggaatggggctaaaaaatctgcatttctttctcttagttcctgggccatagaaaatggatggcaggcaggatttggcctgtaggtcataagtttctgacccctctttagtacaatagctctctcttctgatcattactgccaatcagtcctaagtggaacaaaagaagcagtaagaatgttctgtaagtatctgttaagtctgtttgttctctggtatagtttaagtctattgtttctttgttgactttctctcttgatgatctgtctagtcctgtcggtggaatattaaagcctctcactattatggttctcatcagcacatgtaacattctccaagatagaccaaaacaagtctaaataaatttaagaaaattgaaatcatatcaagtatcttctcagaccacagtggaataaaactggaaagcaactctaaaaggaaccctcaaaactatagaaatacatggaaattaaataatatactcttgaaaattatatttaggttaacaatgaaatgaagatggaattaaaaaattctttgaaatgaatggtagtagtaacacaacttatcaaaacctctgggatacggcaaaagcaatgttaagaggaaagttcatagcgttaaatgcctgcatcaaaaagtctgaaataccacaaatagacaacctaatgtcacatctcaaggaactagagaaacaagaataaactcaacccaaacctaacagaagaaaagaaataacaaagatcagagcaaaactaaatgaaattgaagtaaaataatacaaaagagatatgaaactaaaaatcaattatttaaaaagatatacaaaatcaatagaccattggtaagattaaccaacaaaagaagaaataagatccaaatatgcccaattacaaacaaaactggagatattatgactgataccacagaaatacaaaagatcattcaaagctactataaaaaccattatgcacacaaactggaaaatctagaagagatggatacattcctggaaatatacaatacttctagattaaatcaggaagatatagaaacccagaacagatcaataacaagcagtggtatctgccattataggaggttttttccactgattccccctgttattttttttttatttttcagtaattaaaaaaaattgccagtaagtaaaagtccagggccagatggaatcacagctgaattctatcaggcactcaaagaattggtaccaatattaccgaaactattccaaaagatatagaaagatggaatcctccctaaacgttctatgaagccagtattaccctaatacaaaaaccaggaaaggacataacaaagaaagaaaactatggactgatattcctgatgaacatagatgcaaaaatcttcaacaaaatactagctaactaaatccaacagcatatcaaaaagataatacatcatgatcaagtgggtttcataccaggtatgcagggatgttttaacataagcaggtcaataaatgtgatacatcacatatacagaagtaaaacaaaaatcatatgattatctcaatagatgtagaaaaagcatttcacaaaatccagcattcctttacgataaaaatcctcaacaacatagtcataaaaggtacctacttcaaagtaataaaagccctatatgatggatccagaatgaacattatactgagtggggaaaagttgaaagcatttccactgagaactgaaacaagacaaggatacccactttcaccacttccattcagcatcatactggaagtcctggccagaccaatcagacaagagaaagaaataaaggacatccaaattggaaaagagaaagtcaaacagttgctgttcgccaatgatatgattgtatacctaaaaaaccttaaagactcatccaaaaagctcctagagcttataaacgaattcagtgaagtctcaggatacaaaataaatgtacacaaatcagtgacactgctacacaccaacaatgactgagctgagaatcaaataaagacctcaatccctttcacaacagctgcaaaaaatttataaaatacttaaccaagcaggtaaaagacctgtacaaggaaagtgcaaaatgctgccaaaaaaataatagatgacacacaaaaaatgaaaacacatcccatgctcatggatgagtagaatcaatattgtgaaaatgacaataatacccaaagcaatctacagatttagggcaattcccatcatcattcttcacagaattagaaaacacaattctaaaatttatatggaaccaaaaaagagcctgaatagccaaagcaacacttagaaaagagaacaaatctggaagcatcacattacccaacttcaaattatactacaaggctatagttactaaaacagcatggtactggtataaaaatagaccagtggaacacaatagagaatcaagacataaagccaaatacttatagccaactgatttttttttaatactttaagttctagggtacatgtgcacaatgtgcaggtttgttacatatgtatacatgtaccatgttggtgtgctgcacccattaactcgtcatttacatcaggtatttctttaatgctatccttcccccactcccccaaccccacaacaggcccctgtgtgtgatgtttcccctcctgtgtccaagtattctcattgttcaattcccacctatgaatgagaacatgtggtgtttggctttctgtccttgtgatagtttcctcggaatgatggtttccagcttcatccatgtccctacaaaggacatgaactcatcattttttatggctgcatagtattccatgatgtatatgggccacattttcttaatccagtctatcattgatggacatttgggtcggttccaagtctttactattgtgaatagtgtcccaataaacatatgtgtgcatgtgtctttatagtagcatgatttataatcctttgggtatatacccagtaatgggatggctgggtcaaatggtatttctagttctagatccctgaagaatcaccacactgtcttccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgtttgttggctgcataaacgtcttcttttgagaagtatctgttcatatcctttgcccacttgttgatggggttgtttgatttttattgtaaatttgttaaagttctttgcagattctggatatagccctttggcagatgggtagattgcaaaaattttctcccattttgtaggttgcctgttcactctgatggtagtttcttttgctgtgcagaagctctttagtttaattagatcccatttgtctattttggcttttgttgccattgcttttggtgttttagtcatgaagtccttgcccatgcctatgtcctgaatggtattgcctaggttttcttctagggtttttatggttttaggtctaacatttaagtctttaatccatcttgaattaattttttataaggtttaaggaagggatgcagttaacagctttctacatatagctagccagttttcccagcaccatttattaaatagggaatcgtttccccatttcttgtttttgttaagtttgtcaaagactagatggttgtagatatgtggtgttatttctgaggcctctgttctgttccattggtctatatctctgtttttgtaccagtagcatgctgttttggttactgtagccttgtagtatagtttgaagtcaggtggtgtgatgccaccagctttgttctttttacttaggattgtcttggcaacatggtctctttttcagttccataagaacttcaaagtagttttttccaattctgtgaagaaaatcattggtagcttgatggggatggcattgaatctataattagtttgggcagtatggccattctcatgatattgattcttcctacccatgagcatggaatgttgttccatttgtttgtgtcctcttttatttcgttgagcagtggtttgcagttttccttgaagacctccttcacatccattgtaagttggattcctaggtgttttattctctttgaaacaattgtgaatgggagttcactcatgatttggctctctgtttgtctgttgttggtgtataggaatgcttgtgatttttgtacattgattttgcatcctgagacttttctgaagttgcttatcagcttaaggagattaggggctgtgacaatggggttttctgagtacacaatcatgtcatctgcaaacaggggcaatttgacttcctcttttcctaattgaataccctttatttctttctgttgtctgattgccctggtcagaacttccaacactatgttgaataggattggtgagagagagcatccctgtcttgtgctagttttcaaagggaatgcttccagtttttgcccattcagtatgatattggctgtgggtttgtcataaatagttcttattattttgagatatgtcctatcaatacctagtttattgggagcttttaggataaagggctgttgaattttgtcgaaggacttttctgcacctattgagataatcatgtggtttttgtctttggttctgtttatgtgatggattacgtttatttatttgcatatgtagaaccagccttgcatcccagggatgaagccaacttgatcgtggtggataagctttttgatgtgctgctggatttggtttgccagtattttattgaggaattttcttatagatgttcatcagggatatttgtctaaaattctcttttttttgttgtgtctctgccaggctttggtatcaggatgttgctggcctcataaaatgagttagggaggattccctcttttccttttttctttttttttttttttgagatggagtctcactctttctcccaggctgcactgcagtggcgctatcttggctcactgcaagctccacctcccaggttcatgccattctcctgcctcagccttttaagtagctgggactacaggtgcctgccactgcacctggctaattttttttgtatttttagtagagacggggtttcaccatgttagccaggatggtcgtgatctcctgacctcatgatccacccgcctcggcctcccaaagtgctgggattacaggcatgagccaccacacccagccagattccctctttttctatttattggaatagtttcagaaggaatggtaccagctcctctttgtgcctctggtggaatttggctgtgaatttgtctggtcctggactttttttggtttttagggtattaattattgcctcaatttcagagcctgttattggtgtattcagggattcaacttcttcctggtttagccttcggaaggtgtatgtgtccaggaatttactcatttcttctagattttctagtttatttgtgcagaggtgtttatagtattctctgatggtagtttgtatttctgtgggatcagtggtgatatcccctttatcattttttattgcatatatttgattcttctctcttttcttctttattagtcttgctagtggtctattttgttgatcttttcgaaaaaccagctcctggattcattgattttttgaaggtttttttgtgtctctatctcctttaattctgctcagatcttagttttttcttgtcttctgctagcttttgaatttggttgctcttgcttctctagctcttttaatgtgatgttagggtgtcaattgtagatctttcccgctttctcttgtgggcatttagtgctatagatttccctctacacactgctttaaatgtatcccagagattatgatatgttgtgtctttgttctcgttggtttcaaagaacatctttatttctgccttcatttcgttatttacccagtaatcattcaggagcaggttgttcaatttccatgtagttgagctgttttgagtgagtttcttaatcctgagttctagtttgattgcactgtggcctgagagacagtttgttgtgatttctgttcttttacatttgctgaggactgctttacttcccaccatgtggtcagttttggaataagtgtgatgtggtgctgaaaagaatgtatattctcttgatttggggtggagagttctgtagatgtctattaggtccacttggtgcagagctgagttcaattcctggatatccttgttaactttctgtctcgttgatctgtctaatattgacagtggggtgttaaagtctcccattattattgtgagggagtctaagtctctttgtaggtctctaaggacttgccttatgaatctgggtgctcctgtattgggtgcatatatatttaggatagttagctcttcttgttgaattgatccctttaccattatgtaatggccttctttgtctcttttgatctttgtcagtttaaagtctgttttatcagagactaggattgcaacccctgcttttttttgttttccatttgcttggtagatcttcctccatccttttattttgaggctatgtgtgtctctgcatgtgagatgggtttcctgaatacagcacactgatgggtcttgactctttatccaatttgccagtctgtgtcttttaattggagcatttggcccacttacatttaaggttaatattgttatgtgtgaatttgatcctgtcattatgatgttagctggttattttgcttgttagttgatgcagtttcttcctagcatcaatggtgtttacaatttggcatgtttttgcagtggctggtcccagttgttcctttccgtgtttagtgcttccttcaggagctcttttagggcaggcctggtggtgacaaaatctctcagcatttgcttgtctgtaaaggattttatttctccttcatttatgaagcttagtttggctggatatgaaaatctgggttgaaaattcttttctttaagaatgttgaatattggcccccactctcttctggcttgtagagtttctgctgagagatccactgttagtctaatgggcttccctttgtgggtaacccgacctttctctcaggctgccctcaaggatttttccttcatttcaaccttggtgaatctgacaattatgtgtgtgtcttggggttgctcttctcaaagagtatctttgtggtgttctctatgtttcctgaagttgaatgttggccagccttgctaggttggggaagttctcctggataatatcctgcagagtgttttccaacttggttccattctccccatcactttcaggtacaccaatcaaatgaagatttcatctattcccataatcccatatttcttggaggctttgtttgtttctttttactcttttttctccaaacttcttttctcacttcatttcattcatttgatctccaatctctgataccctttcttccacttgatccaatcggctactgaagcttgtgcatatatcacatagttctcatgccatggttttcagctccatcaggtcatttaaggtcttctctatgctgttttttctagttagccattcatctaatcttttttcaaggtttttagcttccttgcgatgggttcaaacatcctcctttagctcgaagaagtttgttattgtcgaccttctgaagcctacttctgtcaactcgtcaaagtcattctctgtccagctttgttccattgctggtgaggagctgcagtcctttggaggagaagaggcactctggattttagaatttttagcttttctgctctggtttctccacatctttctggttttatctaactttgatctttgatgatggtgacatatagatggggttttggtgtagatgacctttttgttgctatttatgctattcctttctttttgttagttttccttctaacagttgggaccctcagctacaggtctcctggagtttgctggcagtccattccagaccctgtttgcctgggtatcaccagcagaggctgcagaacagcaaatattgctgcctgatccttcctctggaagcttcgtctcagaggggcacccggctgtatgaggtgtcagtcgacccctgctggcaggtgtctcccagttaggctgcacaggggtcagggacccacttgaggaggcagtctgtctattctcagatctcaaactccatgctaggagatccactgctcttttcagagctgtcagacagggacgtttaagtctgcagaagtttctactaccttttgttcagctataccctgcccccagaggtggagtctacagatgcaggcaggcctcactgagctgcagtggggtccacccagttcgagcttcctggatgctttgtttaactactcaagcctcagcaatggtggatgcccctcccccagcccaggctgccacctcgcagttggatctcagactgctgtgctagcagtgagcaagactctgtggacgtgggacccaccaagccaggtgtgggatataatctcctggtgtgctgtttgctaagaccgttggaaaagtgcagtattagggagggagagtcccgattttccaggtaccatctgtcacggcttcccttggctaggaaagggaaatcccctgaccccttgcgcttcctgggtgaggcgaccccctgccctgctttggctcaccctccgtgggctgcacccactgtccaaccattcccagtgagatgaaccaggtatctcagttggaaatgtgaaatcacccatcttctgtgtcgatctcactgggagctgcagaccagagttgttcctattcggccatcttggaactcctcagccaactgatctttaataaagcatacaagaacaaaaattggagaaaggcaccctgttcaataaatggtactgggaaaactgacaagccacatgtagaagaatgaaacttgatcctcacttcttaccttaaacaaaaatcagctcaagatgaatcaaagacttaaatctaagacctgaaaccataagtattctggaagataacattggaaaaactcttctagacattagtttggcaaaaagttcatgactaagaccccaaaagcaaatgcaacaaaaacagtaatgaataaatgggacataattaaactgaaaagcttctgcacaacaaaagaaataatcagcagagtaagccgacaacccacaaaataggggaagagcttcacaaactatgcattcaacaaaggactaatatcctaaatctacaaggaactcaaacaaatcaacaagaaaaacaaaaaaaaaataattccatcaaaacatgggcaaagaatgtgaatagacagttctcaaaagaagatatacaagtggcaaacaaatatatgaaaaaatgctcagcatcactgattatcaggaaaatgtaaattaaaacaacaatgatataccacctgcaagaatggctgtaattaaaaagttaaaaaaaaaaaaaaaaaaaaaagatggtgacctggatgtggtgaataaggaacactgctacactgctggtaggaaggtaaactagtacaactatggaaaacagtttggagattccttaaacaactaaaagttgaagtgccatatgattcagcaatcccactactgggtatctaccaaaggaaagaagtcattatgtgaaaaagatacacgcacatgcataattttgagaatgaagatccagtttgcataattttgagaatgaagatccaaagttccttctcaaagcttctctatattcatgttttataaatttgcttatatcagagaagaaacacctaccccaatgaatatttccccatcaccagagtatttttccatatattttggtgcgtagtgatggtattattgatgttaatattttatatttgtctcttttcagcaaaaggaaaatatcagtagtttttaatttgtgagcttcaatttacttcaccaactatatctgcattcttctttctcagaggctaataccagtacatgctgtgatgttttttttttcctccttgtgtgttttgtgtcacttgtgtatattccgctgaaatgtattctgtttttcaacttttagggataaaaactgtgcagtgtacataaagttatttaaattatcttaattgattttcattaacttaattatgtcttgagaatttattttgtgaggccagcaaggaattcagtctcagtaatcattgaaatttagtcctccaattctcccaggacctcagagacatgccttatatagacactatcaaagcattataaaggcccctccagtcatcaattctacactggctagtacagacactctccagaggttctgtgccttacttgaagcatggctatgtttgatgaagctgaggccctgttcctctggtccagcttttgagggaaatataattaaaaataaaatcttcttccaacccagaaatcttctccatgaaggtagtagagaaagaaaacacttttttgttgaataagcattaagccaatatgtgatgcctatcacaggcaatctgctgagattgcagagacagaaataaatcttacgcttacatacaaccaagtaggtacaacccactccatacatgatctcaagattaaaaataactaatcctctagtaagaagacttggcagcagcagttagcgcacatagtttgccctaaattggtaatttgggtaaattgataactaatgtatgtcagggaattggctttgtccaaagggaaaataagcttctcctatccttatgacaagaggttatttggcaatgtggagcaaggtgcctgctgaagttagactactcttcctcacaaacctagagaggggcgctatcttcctggatgattgcatttcaaacagatggctccaggtccttaaaaaagacaatactgggtgttaaagctggcaaaagtcttatttaaccttaaaaaagatgtacatacatttcaaaggacagagaaattttgaattaaatgctccaagaaaaccagagaaggagggagtcctttcacttacttttaagaaggaaaactgtctcttcctctcctctccacttccttcccctcccctccccgcttcttgtccttttttaaaaaaaaattgtatttgccccctttaaaaaaaatgtatttgcccttacagagcttccctatacccagaacacagccatcctcttaaaagtgttaccacatttcccaggacatgactagctaaccacgagtgagtctctgctggtccccaggctgccagcctccagtttcttcaagaatggggaatcttccaggattcctctcttaaaattcacaatgtgttttctattgtacagaaaaaataagaagtccctgagacaaataaatcaagaatatttaatattttgtctgatttgaatgtgactttaaaaatccaggaacaacaaacacagattagtatcttaaattactttccaccacaccactatcattacttttactccttaaatatgtttgaaataaaccaaactgaccagacacagcaatttttttgtggaaatatttcttccttctgtagctttactaccgtatacatcattgaggtgttaatttcctttgtgagaataatattcatctttaatattcccacattgcatacagtaattccagatcattttatgacattaaatcaactcagaatctgtaacatagcataattattgttcccatttcattactgcctttaacaaattttacagatgtttcctccacattttaaattgtttccttcaaaattgtttttaatattctttgttagctcttctggactccaggaagcctgtgtctttttatctgtcttgccctaaaattatctttgaaaagttaaactggtggcaagtttacatatggttaaagaaccatttatattgatctatccttatgaaatattatctgtgaagcatcataatattccataattacctcagcagcatgtgaatctgtgtgtcaaatggcatatacatttcactatatagagaattaataattttcactgggtataagaggtagccatgtttaggatgatgagattagtgacacactaggagttggatcattttggtctgagttgcagtcctgtcacctgaaaaaagaaaaatcacagcttccctagatttttttgcttacttgtaaaaataagaacaacagtattacccaatacatacttctcagagctattgagcagatagaagtagtaagaaatttctaacgtcagattatattttataagtataagagttttctagtttatgttttcttgcatatgatttggattctaagtagaacagaaagatctagataagccttaatcagtactgctcatttaatgcagatgggaccctatgtgatttacttctcttaaaatgtattaaaccagagaaaactgctaaaaaaaaaacggacagttcagctttgttggcttgtaatctttgtggtaaaatggtaactgcattcaaccattactttagggctgcctgaccaaatggtctcgagaaacatacatgaattttaataaacaaaacatggcctggtaggtcacagtgcaaaactagatcatttgtaacttatgatttctgttcaattattgtgatgtatgacttttctatgactccttctttacaagttttcttttctacctacattatttcaggataatatcattttcagtcttgtaaaataagtagaattaaaaccagtttaataagttgattttagttagaaatctcaaccgattttgtttcacttactctggaaaaatatatttatttatttatttactttatcttgctggctattttgaagttgaaattattgttttctctgaatgcaccaattatttgtgtgagcccaaactctctgactagatgattattccagaaaccttattatttaatatgttgaatgacatttacttttatgtggtgtaagccattcccagctactttttttctgaatgtattattttgtatactcgccttacttttcagagaaaatcattttttaccttattcatatattcatttcttttctgtgaggtttgaatatttttaggtcaaaatttaacagtgctactgctgtgccattaagcgtaaattgtgtatattctgcttctgtttttaaagtataatatcaagataggaaccgattatgaaagtaggtcataatgagggataatctccttagagacatgtgttttggggatattgtgctgcttgatccactaaattctattatggtagcagcaagatgatagtgttattggaaatttttagtttagtccttttattgttttagttattatcttttcttccaccaacaccacattgctttgaaatatattttggaatacatatatgatagacatttgtgttgcaggaaaatattatgtcccacaactatttggggagttcataaaaggtaaaaatattgacattttgatatgccttgaggaaaatacactaaggcactgaaaaataatatttataagcccatagtaagagatacaaaggccaggcatttctttgcaaaaataaagaaattggcaaaatatttatcaaaaagccttgagagactccccaaaacaggaaatattctatcttgttatttcaaagaaattcaacagttcagaaagtgcaaagttaaaaatgagagggaaagaaggaaatagaaattgatcaatttggtttcccaggcattgattaatttcctatggtgttcttaatatatctttttgacttggttccttcctttctaatagagaaagtaccatctcctacatctgttgatatttcaaactgtgattggaaaggagagattcattaatcttcattcttcaacattaagagagttagaactctcctatactgagcatagtggaaagtggacctgtttctctctaaagataaagtaggagtatgatgacctaacaactgtgactaaattagcattattgacaattagtgtcaataatatcataaagttaatatcagggaaacctgccccgatagtcacgtaggttcttttctgttttccctaagtgtcggcaggtttgagaaataaagggacagagtacaaaagagagaaattttaaagctgggcgtccgggggagacatcacatgtcggtatgttccgtgatgtcccacaagccacaaaaccagcatgtttttattagggactttcaaaaggggagggagtgtaccgatagggtgtgggtcacaaagatcacgtacttcacaaggtaatagaatatcacaaggcaaatggaggcagggcgagatcacaggaccacaggactggggcaaaattaaaattgctaatgaagttttgggcaccattgtcattgataacatcttatcaggagacagggctttgagagcaactggtctgaccaaaatttattaggcaggaatttcctcttcctaataagcctgggagcactatgggagactggggtttatttcatccctacagtctcgaccataaaagatgaccacacccaagggggccgtgtatagacccacccccaggcgcatattctctttcccagggatgttccttgctgagaaaaacaattcagtgatatttctcccatttgcttttgaaagaagagaaatatggctctgttctgcccagctcactggcggtcagagtttaaggttatctctcttgttccctaaacattgttgttatcctgttcttttttcaaggtgccaagatttcatattgtttaaatacacgtgctctacaatttgtgcagttaacgcaattatcacaaggtcctgaggcgacatacatcctcctctgtttaggagatgacaggattaagagattaaagtaaagacaggcataggaaatcacaagggtattgattggggaagtgataagtgtccatgaaatcttcacaatttaagtttagagattgcagtaaagacaggcataagaaattataaaagtattaatttggggaactaataaatgtcatgatatcttcacaatccatgttcttctgccatggcttcagtcagtccctctgtttggggtccctgacttcccacaacaagttaattcataaaacatgtattacttgaaaatatcaccagttgttgaggcagacatttttggactaatatttattgggtacataatattattgtagtgttcttagttgcatatgtgtatgtcatatatccatatatttttatttagttgttaaggtaaccttattactatctccatgtgacacatgagaaaattgagtcatagcacaattgctccaggtcatgcttgacttgctacatgcttcagttggagaatggtattactcaaatatggtcactttaaactctaggccagtgcagacaaatctcttaagagactcatttaaatgtaaatttcttgggcccgccccaaacatcttatactatcatattatgttctaaacatagaatgtggtttagtaatgaagtaatatctcatttatccaaaactcagctctctatcaacttcacctttcttgtctgaaaaacagatatttttggactaatatttattgagcacataatattaatacagtgttatttgttgtatatgtgtgtaaaatatccatatgttttttattaattgtcaagacaaccctattactatctagtcatgacaaatgagaaaattgagtcacagcacaattgctccaggccatgcttgacctgcttcatgcatcactttgagaatgctgtctgaaaaacagacaggcaacaggaaataagcaaaaaggtaatgtggaatttcacaaataatttgatcatgtcaaatccatgccattaattcataagagaacttagtgtactcatagtttattcatagctctctctcttttttttcttttctctcttttttttttttttcctgatacagagtctcactctgttccccaggctagaatgcagtggctcagtcattcatagctcttaaaatctaggttttgttgctagccttcaagtttgtagaatgcgttagaaaaaaagaaaggctgctccaatttagcagatatgctgggtgacaagaatcttacaacttcagaggatattcaaaactagaaaaacagacacaagaattcaaaaacttgcagtctggatctgacatgcacagtgcagctggcttgcacatatcagttggacttgactatttacagttctcctttgctgcagcatgagcaaataaatccacttcttccagtgatggctatagagagagaaaagagtatgtaatttagagtcaaatatactccatttggagtagtttcaaatctcagctcatctactcactgactgtggatgacaccaagttttctgcaactaggttttttgtttgtttgttcttggtctatgaggcagtcatagcaacaacctccctagatagagtaaataatgcaggtgggaaaattccctatcaggatacctagcacataatggaaatccaaaatctttcctttgtcatcttccaaaagcatgaaagatagttacagagggtgggatatggtgttaggcagctgaggactcagatcctggctgcatacttataagttggataactttaggaaaatgatttcaactctcaatgcctcagttttttcatttgcaaagtggagttagtaatgcctatttttctaggttaatataagagtgatcaataatatacatacagcacctttaatatattaggccttcaataaatgatgatagtaatgattatatttctaattttcaatgtcttcctttaaagacaatactgcagatgtgttatacattttggaaagatttgtatcctaaatcataaaccattagtatttcaatataatttattcatcaggttcctggttgtttatagggtaatgtttaagccttaccttcatacagaaaaaatacatactttattattgtgaatttttattgtgatatatatttatacttataaaaatatgtatatatgtggattttcatttttccttcattctcagcattacacacagctttatatctttattcttacaacattagcttgtgtagatttattttgagatgagaatttcagattttaatacactttaatattgatattattactgttcaggaaaataacagaaaaacatagttaggattctgaacttagaagtgtaaaagaattaaaacctggcttctctactcatgagtttcgtaacttaagatgatctatgtaactacactgagtctcagtttcttattcatagaggcaataatattctctacttagtatttggggatgattactagcatttataatgtgcttaacatgatacacattataaattcctaagatgaggtaggctagtctatttttcatttgactgtcacatttgatagtgatagtaataaaatttgatcacttagttttcaataattaagttctaaaaaagaaataaaaatacattctccctcatctcaaggacaacacacttaatggatagacaaacatgaacaaataccagtaagggtcacagatgttttagatgttttgagtaagttaaatgggagaaagaaagggagtgattattcaacctggagagataaaggctttccagaatgtgacattcagtttgagtacatttagttcaagcacaaaattttcgttaaatgataataataaatatataatgcagaagactggatcaaaatgctgcatagaacacatatataaacacctcaccacccacccaaaattcctttaaataacaaggagaattcagaacaaagttaaatgtaagaaaaggtgttattagcagaccataactttttagatactcctcaaagacagaaagcccaaaagagttcattaataaaagcaaaccacatgtcagctcaaaacacaagcaatagaaaattattacaaagataaaagctggagagtttattatgtttaatgatactcaatataaatattaaaagaagaggaaactgtcagtgcaattatcatgcataatgtcacctcactgtcaaaaatatcatgcatactgtcaagaacatttgaattcacctcacctcccaacactactccttacatgtccacttaaagaaaaaatgcagcagctaactctctaacacttgaaaacttgtagacagtactctaaggaaatttagctacttatttgaggaagatgcttagaatgggcatcggtgtctgagaatgaatgtttagtgtgggtgtcagggtatgagggaataggagagcctgaggtgacttgatatccaaaactgacgtggaaaggagaagaaaagaagttaaagcagctacatcacagggaaattcactaggatattctacaatcagagaacagccaactttgtttcaataagtgaaaaattgagaaatgtttttgcgggtttgggtagcagtgggtggtcactgccattctgcacatgtgtaagatgcctaagtgataaaacaaagccagtcagtcaaggtacctacccatttacaccaaacccacggtgaccccatctgtttagaagatggggacctttagaaaataaccctattacctgcacaatggcagaagaaattcattccagaatgaacaaagatgattccatgacatttgaaataacaaagatttgcatacaccaaataaaaacagtctgctgaggaaaggggcaatgagaggataagaatgagttaggaattaaaatagatttgcaaaaattatctttaaaagtcaatagaactggtaaataacagacagaactgaggacagaatcagtaatctataagataaatatatgatattttcactggtttaagaaaaacaaatagaatgttagaagagttagtcatagatgcttaaccaaggaagtctaacttcaagtaataggagttccagaagatgaaaaaagaaaataatcgagaacataaatacaaaatagaggaaaatattcccaaattgttaagcatgattgttgaaaaaatacttacacaaatatgcatcttggtggaattttattactcttagtataaacagaagaatcctaaaatatttcaagaaaaaaaaatgaaaaggtttacttacaaagaaaggagaaacattgcattctgatttatctttaacaaaatgttagaagttaattaagcaatatattcactgttctgaaacaaacataaatttttgaaatcgagaattctgtatctaactggttgtgagggcaaagttaacaaatttttggacgtgaaaacattcagaaagtttaccttttacattctctttctaaaataatcactccaaaatttagtgcaaaaaatgatcaaataatatttactttaggaagataaggatgacttaacaccaaaaaaatctaacaacataactcagtgtatcaaacaagtaaagtataaaattatatgattaaatcaataaatgcttgaaaaatgtttggtaaaattgacagccatttctaatgaaacactagctttaaatataatacagcctcctaaatataaataggaacatttaccaaaaattaacaacacttattatttttacaggtgaaacactaaaactatattaataaaaatcaaggaatgggacactaaccgattatcatttaacatagtcttggatgttttagttaatataataaggcaataaaataaaataactagaataaaagtggagagaaagaagtaaagatgtatctttttgttgactataaagttgtataccataatgaaaattattgagaaatttagtgaggtggctaaatataaatttgaaaaatcccatatgtatatcccataatttattcatcattcttgttgtttcaagggtttttaagaacaataccacagttttccttgtgcatatattcttagtagcattttataagaataaattccagaaaaaagttattttcaaactgctttccaaaaatgttttagcaattcagcagtgtttgaaggtatacatttctcacatagcaccaataataaatgttagtacttttcttggaatcttgtgaacatgatacatataaattaacattgtattattaatttaattatttgtatttctttgatttgttaagcttatgcattatttcatgtgttttgagacgtttaatttttatttttctgagaattatttgctcataacctttgcttatttttctattgagttgtatttttcttgtccatttgtaagcattctttgtatattaagtacattagcattttatatattaaatgtgttttaaatatatatatatattccaatctgatattgtgtgtttactttatagctttcttgttttgttcttctgtcctaaaattaagatgcaaagttgtctgcaaaaattaagtctatacaatcttttttttttttttttttttgagatggagtcttgctctgtcgcccaggctggagtgcagtggcacgatctcggctcactgcaagctccgcctcccgggtttacaccattctcctgcctcaccctcccgagtaactgggactacaggtgcccaccgccacgcccggctaattttttgtatttttagtagagacggggtttcaccatgttagccaggatggtctcgatctcctgacctcgtgatccacccgccttggcctccccaagtgctgagattacaggcgtgagccaccgcgcccggcaaagtctatacaatcttaatgcaaagatcgtatgtgagtctgtgtgtgtgtgtgtgtatgtatatgtgtatagacggttcaaaaaggtaggtagactttcctccttttaacttgtagggatatctatgatacatttttatctaaaaaagcaagttgctagaaatgtgtatacatcattttctttaaagaagttaattgatatatacaaatgaaacttattattttcaaatgtacaatttaatgtttcttagtaactttcagtgtttcttggtaacgttacagagtaatgcaatcatcagtacaaaccagttttagaacattttaatctccccaataaaatcccttaagcccatttacaattaatcctcattcctctccccagcttcaggcaaaaactaatctactttttatctctataaatctgctttttctggatttttcaaataaatgaaaatcaaataattttatatatgtgtaaaaatgtttgtatacgtttgtatgaacaggagaaagctgagaaggcatacacatctggctgttgacattagttaaagtcagagaagtgggatgagaacaagggaggcaaaacaaaaacaactaaatagacactcttaaataaaaaataattcaacaaaaaaatataaaaagtaaatttgcataaggcacattacaaaaaatgaagaaatatattttaaaaaatcaactataatgaacaatgaaaaatcattttcactatcagattgacaaaaattcagaagactaataacacccagtgttgttgggggttttgagaagtggtcactatcttatgttgctggtggaagtgtaggttactactgcttgttgtgaagggcaatttgttagcctccatgaacatttaaaaggagtttaccatgaacaattctacttttatatttttaaattctagggaaattacagatgagcagtgctatattttataataactaaattaaaattcctataaacacaaacataaatgcatataactgtttatatgtatatatatgtagatacacacacgtaggtatacataaagatacatgcctgtttctgtgtgtctgtgtgtgtgtgtatgtgtgcatatagtgttggaaggatacatatgaaaagactctggccttttctaggacctaaaaagtcctattagagctgtagggctcctcgtcttcaccacacctctcccaacttgatctcatcctctcatataatccccttcacacactggttactttgctgttcatgagcacaccaagtaaggtcttgacattttcagtttcctatacctagaatgacttcctttataagtctggcccaaggtttgtgcctctgctcatttggcatctcatcaaagaggccctttctaaaaacttcttaaaaagcactgcccacccactgctcctactctgcactggccctttgtgctaatttacatttcatatagcactacctaacatagtatatattgtcagtgtatctgcttcttcccactagattataagctttgtgatcttggagacttgtttccctagggtctggttagtacctggcacataatagacactaaataatatatattaaatgttatgtggatggactaaattataatagatttggtatgaagggaaagtttcagatttcagttcttaatatatatagttctttatttttaatatttttttcaaaagaatacatttccctaatgtgtacattgttgttttattaagttatttaaaaatcacagaccaaatgcaaatcaatctctcatctttccaaattaattcaggaagcatgtttttagttacattcttccaaatcacctaaacaaattctagcttaaaattaattaaaggccttaattttacataagaggcttgaagattgatttaagatattacatgaacagtatgaaggaaacagcaagttaatttctttgtatttaactttgtgggataaatgtagcattggtccagacagggaacagcttaccttatttctactattatgaaagaaaaatgttcctcattcttgtggacgtctgagctctgactaagtggagctatcttggtttagaaaactgttctgatcagtaatctataaaagactgatttattttattgtgaccttttttatttaaaaaaaatcacttgaactgccaacctttctaaagaatattgtcttcactttaatgcttttaaatgtataattatcagcaaggaacactattattttagtttctgtataatcctatctgccaagtagtaacagaattaaaaatcagaaattatattggtaacatagttaaacagaggctacagtctgtaaggaggttatctagatatcaaataattccaaggtatttcagtacatttagaattttaaaaattctttaatattttccctggtagaatttacaaagcatcaggaagagaaaatgtccctgtcatacagtatgacagataatggttaaatatttccacttggcatgattactatatttaaaacttaacaccttccaccctttatgatagttatttgtattttgtctgagtgtgtgagaaaaagcactttgatttctccaacaagaaagcagagccctgttatgtgtgttagtgctgtaagacctctaacttcccagagtttttgagatcagaaaagaagacatttggattgcatttcccatcttcagattatcaaggattacagaccattttagttcaatttcgtatttctgtccttaagagacatcaacatttatatgatatatactcaaatataactgttttcctgttgtcatatagatgtaaagatactttttagcaaaagtacatagttttcctaagggtttggggttgagaaaagtaagttgggaacaagtcttcaaggagggaggaatttatttcttaagatggtgatgttctctatccttccacaggatggcaggaaaaacttggtaatttacccagttgatgagtagtaggttatacatatctgtattttaaggtgggtatgacttccaatatttccaacaatattttgatagacatttctgcatatcttctaggagtagatgttttcactaatagtttaacaaactatttgaaacaaatctataaagttagccatctaataacacagttgtggagtttagataaagattcattgagaaactgtatggtctatgaatatatgggagggataataaaagcatcagtgacatagtgccagacagttgagcatgaaggccatcagcatgctgttactagaaaataactctagtggaacttttaatgctattaaatttccaaattccctcctccccctcaaaaaaagtttaaatgtacttccaggttttgggtatttaagtcaaatgactagtaaatctgataatccattattgtgacacttggtaaattagaggctgcaatttgaggcaaagttctcattaataagttacattttccctaagaataatagtgttgaatggtgtccagcatgcttagtactcagaagaataaaacttgccttcaaatgaaagaaaataaggagagtcctaattaattttccttacattttgacattttataaatttatttaaattttaccacacaatttaaataacccgtgatagagtaagtactaaagttttaaagttttaaataagtgtttaagcatagtgaaaaaaatctttggtgttatatttttaaaatgtgtttttcagaatttcatgataagtcactagacttggattaaagtggttggttctcacctcagctgagctattagtaaaatgtatcactgtggacaagttatctaaatgtagtttcctttcctagaaagtaacaggtattgaattaggtggcctattagcttccttcaagttctaacatttttgtaataaaaatatttttactttgtgttctttgataaaatattttatattatgcttttaaaacatctattaaaagtgacatactgcatttgtcttagttgctagtgggtcttttaaattttgtatgatgtcctataagagatcactgtttttaaatttgtacactaagtatgtgactggaaattaatttaatctggcccctctaaatatcaagccatttaatattttatctcttctggcagaaaaaaaaatcattgggttaaccattattgtcctccctttataggagaaaagtaaattgacctgctatatttacaaagcaggtatgcctaactccaaagatggtgattccccccctacagtgccattttaaatgaaaacacattattttttccttggaacaaaatatgtggtattttgttattattttaaagtgatattctgacagaaagtagtagaacatcgttttatgtattttaacaggttagatggtaaattccttgtctatgatatgacctctttctacttcctgaaaaaaggagacaattattcatatattattttcaaaatctatcagagctaccccagatcatcaataaaagatagctcttttatgagtggtcacagactgatctcagtgtgaaatcactgtcaaataacattttccattatgtatatagaaatgaggttatcgccagcttaaaattaagcagcaatcatcttgcaatgacagttgtttctgctttattataatatcatttccatggtaactaaacagagcaccataaaggaaggattatgctagcaggtgtgaaataaacagcaggaggacacttacaaaaactttataaaaacttgaagatagatgacatttttaataaacattgcaaccaacgataatacatatggacttaggaagggaataacaatttaacctagtatatgaagtacatggttaaaactcttctaatactaatttattagaagtagagaaatttatgcaaacagctttctccataggacagttttattaagcaggctatttttgcaaattctttgatcaccatgtaatcgtgatcaaagaattgtgatgtgatgtattggtatgtagtggataaaattatgtccagaatatagtgttcatggtggttgatgtgcctgttttcctttatttttaattgaaagctgtttccatttgtttctaacatataggctagtgataaaattctcttaaatgtgatatttatctcaagactatgagcagaaagatatattatttctttttaaatatatacgtagttgtggtttctgatagaaagaaatacattttagatgactgggatatggatttagccttgtttctatttcaatttgagccatatcaaaataggatattgtttaagtgccatggttttggagaaaagacagtcagcttaaattacttaatgagagctgggcatcataaagagagtccaaagcaaaatactgggttcacaatgtctcaacctatggccttggtatttgggaaaaaatggtcaattccagaaggtagatcttggtggaagtcaggatgaagtcaagaggctgtcagcaatggaatgtggaaatgtgtgcagtatttcacagcttctgtgattatgggctatggtactgaaggcagagaaaggaaggttctacgttgaaaccttggtgatgaaccagccttctatcacgctgtgttggtatttagttgatgtttagcactgcctgtgaagatcaaactccagtttgagcagaggttggctccagacaatgccaaagaggatacaattaatttctaaacatacttaatagtttctacattatcgtatttttacgtcttttctgctagaagcattgcacttcaacaaatgacacattactgcataaagccccatttcttgaatgaaaactctgagccatctatagtttttagaaattaaaggatagcatatgtatcctggaattggtgagtaaaaggacagggaaaagtaaagaaaggtgaggatggcaataatagcaagtaaacatgtcctggaccacagtattttgggtggataaaattattgcatgaaattcatggcttccagttcttccactatagcagcgaacgcaggcccgtattactaaagcagcatatcattatttaaccaatttaagatacagtcacaacaaaaatgacaactattcattatgcatctattaagtgttattcaagcagttggccattaacaaagtagtgtactttaaggccatattcatttttactcaagattacttcttgccaatgcctcaatggttctgaatttcagaaaagcagctaatatgcactctgttagagaataaataaggagtaacatctacttaacttcttgagtagagcaggagtttgagatggaagttctaaagaatgtgtctcctgtcttcatgaaatatcagtgatgtagtatttttcttggtcactttgcccgctggggtcctccgtgaagagacatgtatcaagacgtagacatttatcaaaatgaaagtagaggataaagacagctcaaaagtcctaaggctgctgacatgaacagataattggtggctacagttgtgcctgctaagatttgggtgcatggggcttcgctttggttagctcccatggtcttcttttccaaaaaaaaaaagaagccttcaggttaaagacactccatttacccccagcacctggcaggatttgcaggataattgcccagaattagaatattgatctagttttttacattacccatcccttttatttcttttgagctacagctggagatcactgattggttcacaggaatgagggttagtctaaaatgcagacaaaaacttaaaaacaactaatgagactagaatgtaatgacaagtgtatgataaggattttttttctttcttttttctttttttttttcgagatggagtttcgctcttgtcacacaagctggagtgcagtggcgtgatcttggctcaccacaacctctgcctcctgtgttcaagtgattctcctgcctcagcctcctgagtagcataatttttctctctccagttcttttgttaaaaacaaatcataatagaactgagttgtttgtaaaataaactttagtcttatacttggcctgattatttgcataaagtgcagcaaaaataattatgtttcccataggctttttaaaattggctttgatggaattctgcttcataaggaatctcagataagaccttttaaagccaagcccagccatgggtttgcaccttcaaatacctatgaattgggtaaattcctctcttcttgatgtccccaagataacttgggctcctgggcctattagaaagtgacatttttggccaggtgtgtcggctcacgcctataatctcagcactttgggaggctgaggcaggtggtccacaaggccaacagatcaagtccacctggtcaacatggtgaaagcctgtctttactaaaaatacaaaaattagctgggcctggtggcacactcctgtagtcccagctactcaggaggctgaggcaggagaatcacttgaacctgggaggcagaggttgcagtgagcccagatcatgccactgcaccccagcctggtgacagagtgagactccatctcaaaaaaaaatcaaaaaagaaagttacattctttactgaccacaggttaggaaccccgtataaagactgtgtagacaagttaagaggccagtgttcccaaggggcttttattggctctgcaagtcaagcttgattccttaaagggaagcacacccttccagtcaaagctttggcaaaaacaaacaaacaacaacaaacaaaaaacagtttctccaattgcatcctgttgcaagagaaaatggattcttattgcacttatgcaaatagctatattgtcataagttaagaatactcccaaatcgtttccaaattgtggagaaaccaggcagagagaaacaaatacgctggaaattttgttcacagaagtataccttactcaattgttaaaagctgtaaatagttcaaaataaaaattttcttgactctgagaaacaaaggatcagcaatattttaagcaaaaagtaaaaaatgattacttcagtcctttattagtttagttcattcagttaattcttgttctgcatgacattcatgagtcctgaacatttttcctctattttaatgtcacaatctctacagctatcggaaactggcattgtctcaaatatttttaaaaaggcaaaatctttacgcaacaggagggaagacttagctttccaaaaaatctgtcacgtgtctttcccttctttcttcagtagtttatttgcaaggcaaacaaaaatctttcattatccttttatgttacacgaaaatcttgttcaagaggtagaaagcttgatttcatccttgcattactctaccattaaggtcaagcccattttttaaataaaaccttaaggataaatcttaaccagtttgaccatgaggtgaaattcttataaatcttttataaacctttacaaatttttgttaaagagaaggttagtgcctttagaaaaccctgttgtgcttttatttcagtgttcaatttaccaaattgaaaaaccaaataataaccttttgaatttagtcaatatgttcatacacagaatttcttttacaagattaatttttacaaaccttccacaccttgttcaaacctttagatttatttaatttaaaacaatcctttaaccctctaacctagacaaaaatttatattcccatgccttcttataatcttttactaaaaacacattttactttccttacatacctatcatgtaaatctattttaagtagtctcaattacatgttataatggtaattcttagcaattttaaattttgatgtaaaacctagtaagttattttaattatgtactaggtgtagatacggtctgactctttccagcataatcaggggcatggttaactccgtatgtccccagaccttaccaactgtaaagcaggcaagtcaaacgattttcaaaagccaaagaagcagtttatgaccttaaagcatttagcaaacctaatatctgacctgtataatttagaccacatgtctacattttgaagacatttttactttaccaataatctttaaagctgtttttatttctcaaagattaaagtcatatgaattaaaaggcattacagctttaatttttccttcaaaaatatttgatctatgcatttatttttctttagtcaattaattagagctcttctaaataaacatcacatacataacacatatataactacacagagagacagaaaattgagtagttgtaagatttttcattgggcagtttcttaattggattactggcctcagggtggagcccttgaagaaacagggctaggaaagcatgtggtttctagggcctaataagcaggcatatctgaaagacagaaacaaattttgagagggctctatcctgggggttccatgaggaaaacagaaattttttccaacacagggtcagtggcacctcctctgtttcccaaggagtcccaggctatcaaaagctattctagggcctctcatgtgtgtgtgcattaacagtgaagaaaaataattccattgactgagaagaaaagaatgtttttctggcaaaacaagatccacaaagagaaaagacataaaggccttttaaatatacctatagcttgaatatccacttttaattaagctgacttttaactatagtgctctgtttttaaaaaagtccttttgaatcttttattacctgaccttagccatggtatatggccaatacttctgggttttgaactcatagaggggcagaaaatacagagatttttaccattcctgcaactattttgcacagagagtggccagaagtccaactggcaagaaattttatgtttttgccagcatcccaggcttctgggttccattcccctacactgtggagccctattgaccctggagtcctgtgatggggaaacagacaaagaggttaccttcatgttgtaaaagttagcccctcctcaagagattgctcagctaaatttgtaatttcttaccagctcatttttaagccaaacagtttaaggcttcaggaaattaagctttttccagtttgggggattcatctgaggggtgtgtcctgtggtacagggacacaattaaccatctgggaagagaggataaaggagaaaaaggaaaaagaaagcatttattttccaaagagtcccaatgattcaagatgcactcaagagaagtacagactgaagatgtttggttaaccatctggaaaaaggaggaaaaggcatccctttgttcctttctctttctagaaaaacctgggatacaagagggggagaaaaaaaaagatgtccccattttctcttctatccttatatcctcgagtcctggtgaccttggcagtgccatccatgggtgccagtgtgaccttcaccacgtagcaggaaggcctagagggtaggattatttgcactcacctaatgcactggcctatactccctgctgtcagtaaccttgagttccctatacctcatctatgccatggatacgagcatgacctccttccatgaagtggggagcccagtcagcaggaattagttatgcttaactatgttgtgcccctagacttgtgctgtcactaacctttgggtttgcggagacttgggtttttttttttttttctagggcttcaatcgaaagctcaggattgagtttgggacaaaaaggtgcctcagtagggtacacagactcattaaattaagtccaaggtgaccctcatgtttgcagtcagtgactggtgggggtagttggggccacttctctgttgcttccctatcataagcagagtgctaaggtgaagttgtggaaccagggcctcctcaaataagggagagaaaaggagtcccaggaattgggaacctgccctagtaagatgcctccccaaaggaaaaaaaaaatctgccacgtagaaaagctccctttattcacaggactttgtgaactcctgacatggtggaggaaagaaaaaaaacagcttaagtgcctgtgggaaaaagcctcttgttctatgcaaatggattccttcaacaggggaaaaaaaaactttaattgctgcatcctccctgtttctaagaatagacagaaactgcatttcttatgactgggccaagtgcccattctacccagtaatatctgtgtagtttgcaacagcacctttaacattataaaagaagagctagcagccatcacaatccatgaaagaaagaaaaaaagtaccattgaaaagtctgggcatcttggctaacaccctaacaccccctccagttgcagactggagccggtctaggggccttaggacaacaatgaggtgttgccttggccagatgccttcagtttcctcaggaccttattctgatcccatgtgacagctagacgtctgtgaagggaaacaaagtgaagattccttacacctgagagtgatgggggtgggggtggtggcagagccctccccacatcctgtcctctgtagccatgccattcactcttaactggctaattggaggtacagtgcttatctgccttcagaaaaaagtctgaggacaaaaagtcttgggaaaaaagtgaagaattatatgcccacattcactcaccctctgacaatcctggatgagcccctagaaatgatgcaggatttttcttgttaagtttgctagctgggggcttccacagccagcaacatccttgattgagcctttcttggccctaggcctgctgcaggatgtgtctcattcactcggcccactgggccacacctggcttgcagaccagcctgtattctgtgctcaccaggggatccgtgctcagcctgtggtttggcatgacctagcctgcctgttttacagctcatactcatgttcagtggctcccaagttctttttctgcatccaagaagaatgaggttacactgacaatcgaaaggtgaggggggtggagaggaattttatttcatgacagaacagctctcagcagagaggggatgtgagggtggtcccccatctgaagtcaagtggtttctctcagtgtggctgggcctggggcttttatgggctcagaatggggagggcatgctgattggtttgtgagtatgcaaaaaaaaaaggctaaaaaaaggccagtcaaaggtgggcatgacagtgtaaaaaaaacaattatggaaaggtaggtatatgtaaaatatgtgaagggtgaggatcaattagaagaaagcaccaaatgggaagagaggttctcaatttggtctgtggatttgacttgtattttggctttcagactttaaactgtcttttggcttgaaggtggggtttcaccagggacccacccctatctgtttaggatttgtctgcctcctgccactattatcaggacataagatattgaagacattgaaatatgggttgtgaagactttttctcgtatttgtgaggaaaaatattcaagaatatttgactccattgtcctcattaatcatagatacaggttattgtgcagaaatctctcaagctagtatagccagaaatgtgtcaccttacatgtgatctaatgtcacgaactagtttcgtaggaattgaagtaaatgaatatgcaatagtaattgcctgttcattttgtttgttcattactattcccatgtctcattcccctaagtctgactttttgttttcctttccattctacttttcaggcttcccctcatgctcttttcctcaaattgaggacatctgctctaaggtgaagggccacaagttccagattatattgtgccatttgatgtctttttctgctttttaaccttgaggaatgtaataattgcagacagaattattgttatatttggtttagatggaccatggtgacagtcataaatgcatttgaaatcatttttgtttagggtttctgaaagcaattaacataaagttggaaagacatatattctattttttttttcttttttttgagacggagtctcgctctgtcacccaggctggagtgcagtggcgcaatctcggctcactgcacgctccgcctcccaggttcacaccattctcctgcctcagcctcccaagtagctgggactacaggctcccgccaccatgcctggctaattttttgtatttttagtagagacggggtttcaccgtgttagccaggatggtctcgatctcctgacctcgtgatccgcccgcctctgcctcccaaagtgctgcgattacaggcgtgagccactgtacccggcccatatattctattttaatggaaaacgtaaccagcggaatcaggatgaaagtctaaagatgtgatatctgagtcttaaaattataaagaagaaatcttgagagggtttctgatttttctatagcttcctcattataacctactcatattagtgaactaacaataatctgatagggaagaaaaacttgcagtccttattttctgagctgtatttggcatcttgtgttgtcaataagttcttccttatatcagatgcaaatccttgccaatacaatatgggctcttgtcactaattctttgtttttctgtaaccaagaaaaggagtatcatatatctctctctatctgtctgtctaactgtctctcttttcctgaaatatgtcatttcagggcagtacattttactttaagaaaggatagcatgatgtgttagtttttgtgttgctataatgaaatacttgaggctaggtcattagtaaggaaaagaagtttaactggctcacagttctgcaggatgtacagaagtgtggtgtcatatccacttctggtgagggcctcaggaagttgcaaacatggtgggaggcaaaggaggaaccagtgtagcacatggccagattgagaacaaagagagatgggggaggtgcaacactcttttaagagagctctcccatgaactcataaggaggactcgctgattaccatgagaatggcaccaagcattactgagagattctcccccacgatccaaaccctatcaggccccacctcaaatatgagggattacatttcaccatgagatttggagggaacaaacatccaaactatatcacatgggttggatgcgaaatgctcatttttaagtgccatatttcattttcttaaccaacatttttatagcacttactatgtgctaggcattattccaagcactttgcaaatgctaatttaactcttacaacatacctatgggagaggtactatcactatgcctattgtacagacaagaaaactgaagcagagaacagttgggtagcttgtctaagatcacaattggttaagtgacagaggtgactcttagccactatgctatgcagctctttgtgaaatcatctgtgtgcttttctgacatctttaaggcattttttatggttctgttctccaactgtatcaccaactttggatttatactacagattttcccagtgttcttgtgcagtgtatatctacaatgtatgtgcatgtgcttgtaaatatgtgcttgcatgtgtttgatattatcacagcactcatggagattctggcacaagtggaaccttacattaggaggaaagacatatatattccatagagatacatttggaatatatgtatatatatgtgaatatatatatatggaatatatgtatatatatgtatatatatggaatatatgtatatatatgtatatatatggaatatatgtatatatatgtatatatatggaatatatgtatatatatgtatatatggaatatatgtatatatatgtatatatatggaatatatgtatatatatgtatatatatggaatatatgtatatatatgtatatatatggaatatatgtatatatatgtatatatatggaatatatgtatatatatgtatatatggaatatatgtttatatatgtatatatatgtgtgtgtgtatatatgtgtgtgtgtgtatatatatgtatatattccctatgtatatatatggaatatatgtatatattccctatgtatatatatggaatatatgtatatattccctatgtatatatatggaatatatgtatatattccccttatgtcctccaatagacctcataacgaattgcatgtgagaccatggacaatttatgacacttctgaatcaatttacttatattcaaaataagagagttggactggttgattttttttcatcttcaaattctagaactgaatcaggaacttctaaagcaaccagtaaggagattttttttcagtatagagcaaacccttgacatttgaaagaactacatcctattttggtcaaatattttaaaccttaaacaatcctaagacttttaaaaatctctaagtttgtaagaaccacaataacatatcattttctagtataaaataaattaaatgtttacatggccatgttctaatctctattagctctaaaaatactgaagtaaataatctatagattttttacaataaattatgcaatgaaatcaaagtggacattactgcattatataataatcagataaaactacccccagtatacttgcagtcaaacaaagcttgtgcacttactgcgctaagggataatattccagaggaactttagaaaacattcagaggaggggctatggaagaagaactaatttgattgggtctgcccatttatactggtatcttcttaaatattttgagaaatctgatgagtataacaaacagctgcattcatttgtttgtacaggtggttgtaatcctatataaacttttttatagtttaaaattttaaaaacgtacaaaatattgaaatgtataaggcatgaaaaaatagaacttctttgcatgctagctaggtataaaaatgcaggaggagatgctattgagaacataactcttacctaatgaaggaacataattattatcttgaatatgcaagtaattatactacttcataatatctctgcttagcagagtgcttgattcctggaaagaaaaaaaaatacacacacgcacgcactcacacagacaagatataaggaatagctgtatatgaaatagctacaaatttgcatgctaggagaataattacatgtggaaaaagttatgtgttttacagacagcaaaatctttctattttatcttttgcttgaggtttttggctccttctatgaaggactatgttgctatgcttgcagacaactgacggatagatggatgtattgattgtataattataaaatacatggcattagttatgcctaggacatatgatgtttgataaaagaaaaggaaaaagattcacctgtcaaggaattgcagtttattagagatgaaaacaatgatcaaaatagcaaaaaatctaaagactaatgtaaaggcaaaaatacgtcaaaacataatatgagaagttaacaaatgagaacaacctggtgagttgaatgagtaacatcagcaagatgagagactagactctttctattatcatgcccttgcgcaagtatcaactttgacaactacccacagataagagtacatttgtgagaatctaggagttcactgaagttccagcacatcatcaaagcaagaaatttaagaatagaaacatcaaagaggataaaaagaacagtttcacttcttgtatcccactttcctcaaggtggtacagctcagtgctaagagagacttttggcccactatttatcccatggggaaaaatgagaacatagtgtttgaactcctggctccttctggtgtgcaagatgctgccctagaggcccacttctttcttgcttcacccagattactgagataatcatcatagccgaatggttgagagaggctgggagcaggaagagaggctgtgggctctacttaccactccatggattctatcaggaagcctgacaatgaactcctctcatgttgacaccccttaaccctctcatgggcaccccaaatgtgtccccaagaatcttgctgctgacactaaatataagcatcttgcatagagagctggctggccaggaaaccattttctcctaggcctccaggcctgtgatgagaggagctgccgtgaagtcctctaacatgccctggagacatttttctcattgtcttggggattaatcctttttctatcacattgtcaggctgcaaatttttcacacttttatgctctgcttcccttataaaatcgaacgtctttaacagcacccaagttacctcttgaatgctttgctgcttagaaatttcttcctccagataccctaaatcatctctctgagccctccaaactgttccaaactcttcctgttacccagttccaaagttgcttccacattttcaggtatcttttcagcaacaccccattctcgttaccaatatactgtattagtccattttcacgcttctgataaaaacatacccaagactgggcaatttacaaaagaaggaggtttaattggacttacagttccacatggctggggaagccccacaatcatggtggaaggcaaggagcagcaaatcatttcttatttggatggcagcaggcaaagagagcacttgtgcaggcaaattcccattttttaaaaccatcagatctagtgagactcattcactatcacgagaacagttcaggaaagacctgaccccataattcaatcacctcccaccaggttcctcccatgacatgtgggaattatgggagttacaactcaagatgagatgtgggtggggacacagagccaaaccatatcactggcccgtaggtatatcagtaggggctcaacatcactaatcatcagagaaatggaaaccacaaccaccatgagatatcacctcacacctattatcaaaatgttagaagataacaagtgttggtgaggatatggagaaaaaaataacacttataccctgttggtaggaatgtaaattgacatagccactatggaaaacagtatggagttccctcagaaaattataaatagaagtactatatgatccagcaatctcacttctggatatacatcaagagcaaatgaaatcaatattttgaagagatatctgcacttccatgttcactgtggtgttattcacaataaccaagaagtggcaacaacctaaatgtccactcacagatgaatgaagaaaatgtgataaaaacatacaatgtaatattattcggccttaaaaaagaaggaattcctattatttgtgacaacctggatgaacctggaggatatcatgttaagtgaaataagctagaaaaataccacttatttagaaagaaatataccacttatcacttgtatatggaatctgaaaaagttgaactcatagagaccagaagaatgattactaggcagggcctgggggatgaaggaaatggggagaagtaggtaaaagggtactacctttgagttatgatcaataggtctggatgcctaaaatacagcatgttgactgtactgaataatagtgtattgtatacttgaaatctggtaagagaatagatcttaagtgttctacctccccacacaggcggagaaaagataactactactacttaaggtaatggatatgttgataccttgattgtggtaatcactttacaatgtttatgtattaaaaacatcacttggtatatctcaaatatatataattttatttgtcaattacaattaaagctgagaaaaaatgcaaatggattaatgtgaaaatgcttacaagtgcgaaagcatttatccacatgtaattaaacattttattaattgacatttacggaaataattaaatttcatgaatgcaagactaccagataatccaagatgtaatcatgtataggtatcttatactaatttcttttagagcagataataatcatctgcctaaataatatagaaatatctgtgcaattggtctagtagcactgatgcttaaaaaagcaatctgtccgtacttaggaatgctggaataaaaaacagtataagtctctgaagtttttctctttcaagattgtttttgttcttctttgtcttcagaatgtccatgataattttagactctctttatacaattctggaaaaccttttcgggatttatgtgtcaggcatgtggggaacagactgcatcaaatatatagagcatttgtagaacaacaaatttatacttgttattctgtatttaacaagcacagctctttttatatgtgtcagtgagatcaaattttgtccaactcttctatatccttgctgtttttattctgtatgttctgtcagttacagatgtgtttctgtctcccactgtatttgtgatttgcctatttttttatttaagtttatataggttgagactatgttgttactgcatatgaaatcagagttgtgtgtcttttgggtgaattaatttttcatcataattaaatgctccttttcatctctagtaaggtttactgcatcaagtctactttgtgtgatggctgtactatcgttattataaccatactggttttcttctgtttagtgtttgtataatatttcttttactctatctttctgtatccttatgttctagtagtctttcttctaattagcaaatcattggcttaggttgtttacacagtccattgtgatgattgtttaaatgggaaaatttaattttcttacatactgtaggtggcactatatttgtattgaaatttgtcatctttatattttctatttcccattttattacttcttttggattagttatattagcattctatcttttcattttcttgccagcaatacactctattgctattattttgttattcataaaatcttatgttattaatgcttagtatatactaacatatttaccacaatataagaacctcattcaccattaacatagcttatccccacaaatattttatgttattattgtgtgatttattataatgacaaatatgttaaattatgcttgtttgtcatcaatattcatttatatttaccaactgttgctgtttattctttcctgtatttttatttccatttagcttcattttccttcagctaaaaacactctttagtatttcttttcctgtgatgcttctggtaacacattcactttttgtttgaatcaaaatgcctttatttttaaaaacatgttttcctgttacagaattccatttgacatttattttcctacatcaccaaagtataattgcattgtcttttcttctgttatgttgagaagttagttatcaatattatggttactcctttgaaaataatgtgtcttttatctctggttgttttaaaaagattgtattttttttaatcatactctaagttttaggctacatgtgcacaacgtgcaggtttgttacatatgtatacatgtgccatgttggtgtgctgcacccattaactcgtcatttaacattaggtatatctcctaatgctatccctccgccctccccccaccccacaacaggccctggtgtgtgatgttccccttcctgtgtccatgtgttctcattgctcaattcccacctatgagtgagaacatgcggtgtttggttttttgtccttgcaatagttttctgagaatgatggtttccagcttcatccatgtccctacaaaggacatgaactcatcatttttatggctgcatagtattccatggtgtatatgtgccacattttcttaatccagtctatcattgttggacattggattggttccaggtctttgctattgtgaatggtgtggcaataaacatatgtgtgcatgtgtctttatagcagcatgatttataatcctttgggtataaatgggatggctgggtcaaatggtatttctagttctaggtccctgaggaatcgccacactgacttccacaatggttgaactagtttacagtcccaccaacagtgtaagtgttcctatttctccacatcctctccagcacctgttgtttcctgactttctaatgatcgcaattctaactggtgtgagatggtatctgactgtggttttgatttgcatttctctgatggccagtgatgttgagcattttttcatgtgtcttttggctgcataaatgtcttcttttgagaagtgtctgttcatatctttcacccacttgttgatggggttgtttgtttttttcttgtaaatttgagttcactgtagattctggatattagccctttgtcagataagtagattgcaaaaattttctcccattctgtaggttgcctgttcactctgacggtagtttcttttgctgtgcagaagctctttagttagatcccatttgtcaattttggcttttgttgccattgcttttggtgttttagacatgaagtccttgcccatgcctatgtcctgaatggtattgcctacgttttcttgtagggtttttatggttctaggtctaacatttaaatctttaatccatcttgaattaatttttgtgtaaggtgtaaggaaaggatccagtttcagctttctacatatggctagccagttttcccagcaccatttattaaatagggaatcctttccccattgcttgtttttctcaggtttgtcaaagatcagatagttgtagataggcagcattatttctgagggctctgttctgttccattgatctatatctctgttttggtaccagtaccatgctgttttggttattgtagccttgaagtatagtttgaagtcaggtagtgtgatgtctccagctttgttcttttggctaaggattgacttggcaatgcgggctcttttttggttccatgtgaactttaaagtggttttttccaattctgtcaagaaagtcgttggtagcttgatggggatggcattgaatctataaattaccttgggcagcaaggccattttcacgatattgattcttcctacccatgagcatggaatgttcttccatttgtttgtatcctcttttatttcattgagcagtggtttgtagttcttcttgaagaggtccttcacatccctcttggattcctaggtattttattctctttgaaggaattgtgaatgagagttcactcatgatttggctctctgtttgtcttttgttggtgtataagaatgcttgtgatttttgcaaattgattttgtatcctgagactgctgaagttgcctatcagcttaaagagattttgggctgagacaatggggttttctagatatacaatcatgtcatctgccaacagggacaatttgacttcctcgtttcctaattgaataccctttattttcttctcctgcctgattgccctggccagaacttccaacactatgttgaataggagtggtgagagaggacatccctgtcttgtgccagttttcaaagggaatgcttccagtttttgcccattcagtatgatattggctgtgggtttgtcataaatagctcttattattttgagatgcatcccatcaatacctaatttattgagagtttttagcatgaagggctgttgaattttgtcaaatgccttttctgcatctattgagataatcttgtggttttgtcattggttctgtttatatgctggcttacgtttattgattttcatatgttgaaccagccttgcatcccaaggatgaagcccacttgatcatggtgggtaagttttttgatgtgctgctggatttggtttgccagtattttattgaggatttttgtatcgatgttcatcagggatattggtctgaaattctctttttttgttgtgtctctgccaggctttggtatcaggatgatgctggcctcataaaatgagttagggaggattccctctttttctattgattggaatagtttcagaaggaatggtaccagctcattcttgtatctttggtagaatttggctgtgaatccatctggttctggacttttttttttggttggtaggcaattaattattgcctcaatttcagaagctgttattggtctattaagagattccacttcttcctggtttagttttaggagggtgtatgtgtcaaggaatttatccatttcttctagattttctagtttatttgcatagaggtgtgtatagtattctctgatggtagtttgtatttctgtgggattggtggtgatatcccctttatcagtttttattgcatctgtttgattcttctctcttttcttctttagtagtcttgctagcagtctatcaattttgttgatcttttcaaaaaacgagctcctggattcattgatttttttgaagggctttttgtgtctctgtgtccttcagttctgctctgatcttagttatttcttgccttctgttagcttttgaatgtgtttgctcttgcttctctagttcttttaattgtgatgttagggtgtcaattttagatctttcctgctttctcttgtgggcatttagtgctataaatttccctctaaacactgctttgaatgtgtcccagagattctggtatgttgtgtctttgttctcattggtttcaaagaacatctttatttctgccttcatttcgttatgtccccagtagtcattcaggaggaggttgttcagtatccatgtaggtgagcggttttgagtgagtttcttaagcctgagttctagtttgattgcactgtggtctgagagacagtttgttgtgatttctgtcctttcacatttgctgaggagagctttacttccaactatgtggtcaactttggaataagtgtgatgtggtgctgaaaagaatgtatattctgttgatttggggtggagagttctatagatgtctattaggtccgcttggtgcagagctgagttcaattcctggatatccttgttaactttctgtcttgttgacctgtcaattgttgatagtggggtgttaaatctcccattattattgtatgggagtctaagtctctttgtaggtgtctaaggacttgccttatgaatctgggtgctcctgtattgggtgcacatatatttaggatagttagctcttcttgttgaattgatccctttaccattatgtaatggccttctttgtctcttttgatctttgttggtggaaagtctgttttatcagagaccaggattgcaacccctgcctttttttgttttccatttgcttggtatttcttccttcatccctttattttgaggctatgtgtgtctctgcatgtgagatgggtttcctgaatagagcacactgatgggttttgactctttatccaagttgccagtctgtgtcttttaattggagcatttagcccattgacatttaaggttaatattgttatgtatgaatttgatcctgtcattatgatgttagctggttattttgcttgttagttgatgcagtttcttcctagccttgatggtctttacaatttggtatgttttcgcagtggctggtactggttgttcctttccgtgtttagtgcttccttcaggagctcttgtaaggcaggcctggtggtgacaaaatctctcagcatttgcttgtctgtaaaggattttatttctccttcacttctgaagcttagtttggctggatatgaaattctgggttgaaaattcttttctttaagaatgttgaatattggcccccactgtcttctggcttgtagagtttcttccaagagatcagctgttagtctgatgggcttccctttgtgggtaacctgacctttctctctggctgcccttaacattttttccttcatttcaactttggtgaatctgacaattatgtgtcttggagttgctcttctcgaggagtatctttgtgtcattctctgtatttcctgaatttgaaagttggcctgccttgccagattggggaagttctcctggataatatcctgcagagtgttttccaacttggttccatgctccccgtgactttcaggtatacctatcagatgtagatttggtcttttcacatagtcccatatttcttggaggctttgttcatttctttttattatttttttctctaatcttctcttctcacttcatttcatttcatcttccatcactgataccctttcttccagttgatcgaatcggctactgaggcttctgcattcatcacatagttcttgtgccatggttttcagctccatcaggtcctttaaggacttctctgctttggttattctagttagccatttgtctaattttttttcaaggcttttaacttctttgccatgggttcaaacttcctcctttagttcagagtagtttgatcatctgaagccttcttctctcgactcatcaaagtcattctccatccagctttgtttcattgctggtgaggagctgtgttcctttggaggaggagaggcactctgatttttaatttccagtttttctgctctggtttttccccacctttgtggttttatctacctttggtctttgatgatggtgatgtataaatgggtttttggtgtggatgtcctttctgtttgttagttttccttttagcaggcaagaccctcagctgcaggtctgttggagtttgctggaggtctactccagaccctgtttgcctgggtatcatcagtggaggctgcagaacagcagatattggtgaacagcaaatgttgctgcctgattgttcctctggaagttttgtctcagaggagtacccggccatgtgaggtgtcaatctgcccctactggctggggggggggggcctcccagttaggctactcggtggtcagggacccacttgaggatgcagtctgtccgttctcagatctccagctgcgtgctgggagaaccaatactgtcttccaagctgtcagacagggacatttaagtctccagaggtttctgctgccttttgtttggctatgccctgcccccagaggtggagtttacagaggcaggcaggtctccttgagctgtggtgggctccacccagttcgagcttcccggccactttgtttacatactcaagccttggcaatggtgggcgcccctcccccagtctcgctgctgccttgcagtttgatctcagactgctgtgctagcaatgagcgagactccgtgggcataggaccctccgagccaagtgcaggatataatctcctggtgtgccatttgctaagactgttggcaaagcgcagtattagggtgggagtgacccgattttccaggtgccgtctgtcacccctttctttgactaggaaagggaattccctgatcccttgtgcttcctgggtgaggcaatgcctcaccctgatttggctcacactcggtgcactgcacccactgtcctgcacccactgtctgacactccccagtgagatgaacccggtacctcaattggaaatgcagaaatcacccgtcttctgcatcgctcacgcctggagctgtagactggagctgttcctatttagccatcttggctccacaaaagtttgtatttttctgtagttttattatgatgttcctatatgttgttttctttgtatttattctactgatggtttgcagcagttcttaaatctgtggcataatgtctctcattggtttattagacagttccagctgctataacaatataccatagattatgtggcttgaaaaacaaacatgtctctctcacaggtctagatactagaagttcaacatcaatataacagcagatttgttgtctcaaatcctggtttgcaaacaacaaccttcttactatatctacaaatggcagggagagaacagtgtggtctctttcttcttataaaggaattgatcccatcattgaggtttcacacttatgacctcaagtaaacctaattaccctccaaaggccccaactccaaatatatttcagataagggcttcaataaatgaatctggggtgacaataactttaaattcatagcaattgattttggcaaaccatggccagaagtactgcttctgctccatactctatattatttccttctacgactccaattatacatatattaaatatttttttccatattttatgtgtttattgtaatcatctttgttttgtattttacattttattctccctacttaaggctatgtattttattctaatttgagttcactaatcttactgatcttatattctgttttgtctaatttgaaaatacacaagtctacttagttcttaattacataagttcatttaatgtttagttttagttctagaattttcatttcttttatgtaattcctggctctctgtttaaattctccatgtttttatgtaacttactgaacttgtcaaacaacatattgaaatatgtgccttacacatccactccattatctctgtatctcctgtgggtcggttggtctattttcattatgtatgtttccctctctctctctgtcttcctctctttctgcctttatatctatctgtgtgtgtctctctcttttcatgtggtattgcctatgtagggatgccttatatttttcttgaaaaattatagatataatttgaggtttatgtcctgttacccactgagacaatgtacttttgctccttgcatgcagtaagagaagaggcagattattttaattcaatcagagattgaacagatttgaagctggaacccatgaatatacctagatctaatgagtaaggagaaaaaatgctgctagtagggccataagagaataatgaatgaggaggccacccaaaaggaaccatgatgggatgaagtaaacagagggaaaaatatctaaacttttctctcctgacctctggtatcctactggtacctattatttgggggaactggcaccttaacaatactgagtttttcagtcattaaatatggtatatgtctgcatttattttgctcttcgtattaatatgtttgggtttccataacaaaataccataagctgggtagcttaaataacgtaaaattattttctcacagttctggagactgagaagtccaataacaaggtgccaacagggttagtttctgttgaaagctctcttactggcttgtagttggctaccttctcaccctgtcctcagaggaccttcctctgggcttatgtgaaaagagagctagagagagaaatacacaaatacacacacacatgcacacatacacagtgagagagagagagacagagacagagacagagagaaagagagacagatgaactccttggtgtctgtttttttttttttttaagaacactaatcctattgagctaggcctacacctgtatgacctgattttatttaaacttgattacctctttgtagtccctcacaatacagccacattcagaattagagcttcaacatacaaattttgtagggatacttttctcagcaatattttcccagcaatattttgtaaatgttagtgtaaagctcttggacatattttgttaaaattatccttatgaattttggttttttgggtatttacaaataaactgtatttttaaaaattatcttgctaggtagagcatagtggctcacacctgtaatcccagagatttgggagtccaaggtgggaggatcacttgagctcaggagtttgagaccagcttaggcagcgtaatgagatcccgtctctattttaaaaaaaaaaagtaactctcttaattgtttgcttctggtgtatgaaataaaattgcttatgtttattgacttagtatcttgctaattgctaaactaatttattagtctcaatagtgttttgtagattttttttggatttcctacatatactatcataacttctgcaaacatggatttactttttcccttttaatctttatttatttttattgcttgattaatttgttatgatctctattacactggcgtatagaggtttaaaaagtatatatatttgccttgttcctgatcttaagtagagaacatttgccttctatccttaaatgtactgttagtggtaggttttttgatgattactttatcatattcaggaattattctgaaatcttttttatgtctagtttgttgagcattttttctcattaaaagtgttggattttgtcaatactttttcttaaatatatatttatacacacatacacatatattttatatataaaatgtttattttgcatatatatgtgtatatatatttccattgctaggataaatttcactttgtaataatgtttttatatggttatatagtactgtattaagtttggtagtttttttcttaaatgtttttgcttccctgtttgagagacattagtttttaattttatttttaatcattttcaaaaatttgttgtgtcaggattttagtattagggctaagctgatctgataaagtgagttcagaagcgaatgtggttctcctccctctttttaaatagtaaacttcaagtaagattgatatcattcgctctttaaatatgttttaaggaatttgccaatgaagatatttggttctggcattttcattaaaaattggctttcaattattaattcaacttttttaatagctaaaggactattcgggttttcagtttcttttttgcgtcagttttggtagtttgagtttttgagaaatttctctattcatgttactgaatttattgacatacagttgttcatagtactctcttatttgtatttttaataattctaggctctgtagtgctgtcctttctttgagtaattatattttctgttatttttcttgaccagtgctgtgggattttatcaattttattaatcctttcaataaacaaatttctgggtccattgatttttttctaggttttatttttttttttagtttatatttcatttattttcactctaatatttattattttcttctttatgtgatttttggcaatttaaaattttgaaagatctggaaatggtatggataatttattgcaggagcaataaaagaggcaagaacatcaattaggatattgctattagagatgatggcccaaataaggcagtacaatggggatagacatgagggaataaatttgagtcattgtgttccagaatcagaattaagaagatttgatgaaagattggggaaagggtgttagcagtggcaaatccttatgggtgtgcagcaacctcaattcttgccttcttagatgaaagaatttgactgaggggtttaaggcagatgaagagactaaggcaagttttatagcaagagtgaaagtttatttaaaagctttggagcagaaatgaaaggaaataaagtatacttggaagaggactaagcaagtgactggtgagatcaaatgcatggtttgaagtttggactggggttttatatgttggcatacttctaaggtcttgtgtcccttctttcctgattattagtttggggtgggctgtccacatgtgcagtggcgtgctagcacttgggaggggaacatgcacagtgtgtttactggaattatacgcaatgctcacttgagttgttcttcctttaccagtctagcattcctagaccaaggtcatataccagtcaaactctgtcattttgtctcatagtgcacatgcttgagcccactcacccaactcctgatatcttattgggaagctgctgatcactagtttcagggttttttttttttttttttttttctagtgggagactgccttttcctggtgctggctgagattaattattattttagagagacagttaacaactttgcctgaccatcacttgatagtcgcctgacattcctggtggtggtggggagccctctcctgccctgctcatgtctgtctactgtaacaagggtaggctaagatcaatttttgatcaatatattgggttactctgcagatggtgttactgttaactaaaacaagaagtactggacaagaaagtttttgagaagcatgatcatttctgttttgtatattttaagtttgaggctcctgtctaacatttaagtggccatatatagtaaataagaagataaatggatttggataattgtaaagatgtctgagctagaaattatgattttagagtcagcagtttatagtgcaaggtattctttttgggtacaaaataaaattgaaattctatttatatttttatcttattttaatttctacttctgcatgttttacaatgcaaatactgtgttattctaataggcatgcataatgcattacacaaatatttattatataagccttctcaaaaatattttttcagagggcttgagatcaaaatatttggaaaactttacatctttcatgaagcctatttaagtaacaaatgtagaagagcaagaattgagtcctgtgtaacatcaacatttaataaaagagtaaagaaggaagattttagccaggaatatgagaagaggtgatacaaataggaaaaagaccagaaaagaaaattgtcactgaattttagaaaccaaaaatgagggatggttaggaattccctatattttattctcaatcaacaaccaaagagatcctattaaaacccaagttatatctggacacggtggcacatgcctgtaattgcagcactttcggaggctaaggcgggcagattgcttgagctcaggagttcaagaccagcctgggcaacatggtgaaagcctgtctctaccaaaaaaacacaaaaaaacaaaaattagctgagcgtggtgcctgcctgtggtcccagctacttgggaggaagaggcggatggatcacctaagccaaggaggttgaggctgcagtgagctgtgatggtgccactgcactccagcctaggtgacagagtgagtccctgtctcaaaaacaaaacatatgtgagatgacttctctcctcagaatcttccaatggctcgtcattactcatcataaaagtcaaagtcattgctatagtccacaaagacctactgggtctgactcattactttactgaacatatcttatacgacctgaaccatcacttactcggctccacctgtgccttgaaaccaccaggtataagctccacaaagtcctttttatttgctgtttttacagcctgagatgctttcctccagatacctgcatagcttactcttactcaaatatcactttctcaatgaagtttttttgactagccaattttatattgtactctaccaccactcagagtgcccaatgccttttcttttgcatttattcctcagtacttatcaccatctataataccacttatgtttaccattatgggttttttaaattttttctttttttgagtcagagtcttgcactgttgcccaggctggcatgcaagggtgcaatctctgctcactgcaacctctgcctcccaggttcaagcgatgctcctgcctcagcctcctgagtagctgggattacaggtgcccaccaccacgcctggctaattttttgtatttttagtagagatagggtttcactatgttggccaagctggtctcaaactcctgaccttgtgatccacccgcctcagcctcccaaagtgctgggatgagccactgcacccagcctaccattatgttttgtttctgtctgtcttttttcactagaacataaactccgtggggagaatttttgtctatttttttcagtgctgcatccctagaacctaaaacaatgcctaacacataacaggcacctaaaatatttgtggaaatcaaaaatatgtactgagtgtatcactttatattgcaaaataaaataatatttatttacctttagtttgaagacacatcagcaataaatgttgtatgatgctaataaaaatattattgaatgtttactatgtgtcaaacacagttttgtataactcaatcctaacatagagtctatgaaatcattattattattttccctattttataaatgaggatactgaagcacagagagaagatataagctgtcctaggtgagataatgagaacgtcagcaaataaggattcaggactatatattctacctccaagggctgctccttaaccatgattcagtattcattgctgcctcttacctgccattacctacacagaatcagggtaataaaaattttagtcatttacagaaacaagaaaagtgagtgacagaccattagatagtgtgtaaactaaactttaaaatgtagaaactttaaataatgtaatataattcatattgaatttatatataatacatatatttatacctaatacatatacatacatatataatgtataaatatatattacgtgtgtgtgtgtatatatatatatgtgtatatatatatgcacacatacacacacacacacctccatgggaaaaaataattttcttactgatattgtatgaatctgatagcccccccgaacctttctgataatgataaaataaccattataatgctgataatgcttacttactatatttcaggcactatgctaagcaatttagatgtattatttcatttaattctcaaaacaactcagtgagataggaactattattaccccctgtctatagatgatgacaatgagtctttgggaggctttgcaagttggcctgagtgaattgcaagtaagtggattgacagatggacgtgagatgagaacctaggcagtttaactctagaaatcactcttctttgcaggttgacagtgaaatgaagtatccttcagtaaacatgttgagacggttatctatgaaaagaaatgagtgtagttccctaactcttgttatacctcaaaatagattctgagagatcaagaaagacaatgtaaaatgttcaaccatataaatagtcaatgaaaataaaagtgaatatttataaaagcactttctgagctaaagtacaacagaaggattgcaaaggaagagaataatagaatagatgatataaaatgaaaaccatctttatgataacagaaaaaaaccaatatggcaagcaacaaaattaataaaaaaactatatcaaggagttaataaatcaattaaattggtaagaaatactatgaatttaattcataaatacacaaaaacctgattagtttacatgctaacaaacacggaaaacattcgaaacaaagtgtttaccttaacggtacaacttaaatgaataaaaaaatgataaaatcatcaataaatggtaaatgatcaaaaaaatatttttaatcatgttatgaatatgttaaaagataaatgtatagctatatgtaataccacatataactatgtaactgtgtatatgtggataaaagatgaaacagaaggctaataataaagagcaaaagtcttttgactattctccaactttgtctattcatgagagacaaggcactattaagcatttatatttgggctaataaactcttcacagctcttgtagtattgcaatgacatataaaaataaaggaagatactaaagcacagagatgtcattaactcctctgtccttccacccaaaatctctattttgtttcttctgtggttcacttctgcagcttaacacagtcattaaccagagccaagcaatgaatttagattatgcttcatattctatggattggataccatgaccactgtcctacttgatgggaaatgttcttagcttcaaatgtaaatgggtcctccctttagctaaattcctttatcctatgaagtttttgtttcatttgttttgtgttcaaaatcgcactatgcatttgatcaatttgccttttgtgttgttgctgttgtcttctggtttatttaatttttgctcccagaatcctcattctagagtctccatcctcctgctcgaaatttctctctagggtttcaaagagggctcttcatcatgggacttcccttaacatttgctcttctgtgaaaaccatttgcttcctggattccctctttcttggtagattttgttttgctaacaaggatatgtgagtggtaaattttccaagttcttccaaattctgaaaatttcttaaactgccttatatttgattgatggtttacctatatataaaatttcaggacccatatcattttcctgaagactattgatagtatttctcccttgtcttcaaacatccagtattgctgatgggaattctgataccattctatttcctattcctttctctaggacccaacattttctttctggatacttttaggatcttttttttagctttgttatattgaaatttcataatgatttttatcttggtggtttctttttccattcattgtattaatatgcaatgacttctccattctgggaatttgtcttctattatttttgcaactttattcccctccatattttgttctttttttctagaacttttatctcatgttttttatttcatgtgttttatctctctaacgttttatctctctaacattttatctcatgtgttttcttatctcttgttttttcatacatcctttcttttaaattcttcttttattgagacagttttaccattaattttaaaagctcttttaaggttgacatctgaacactaattaaaggttattttaaggtttctttaagatatttcctggaattatcttttactcttccaacattaattcttctctatgttgattttagcctttctctttaatgttatagtttttattttaatagtttagtgttccttgattagccatatataggggaataaacaaaagcgaggcatgagaatggatgattggggtgtgtgtttgtgtgtgcatatgtgggaggtgtttttaagtgaacaactggagaatcagccattaggatggagaaaacctacctgccagaatgagaaaggctctttgcaggtcaacaacacctgtctgtttcagatttgtgggaaagtggtcattctgcatatggaaaataaacttaaaaaaaaaaaagacaaatagtcatctgttttaattctatttctcacttctctcctgccatagtatctgccatctaacctagatcttctcatgggttctgcagagaaaatcaactccgttcttggttacggccctcctccatctgtgatttgagctacagcttcctccattttgtttcacttaccacccttttacatacatacacttagcagaaattcattgttatctcccttccttgagggtcctcttttgctgtggggtttatggttctattatctaaatgaatctcactgtattatttcaaatttgaaatatttgtaagagtatagggtttgggggcattattaagtcattagattttaaaatgcagaattgatattgtcacttttgggttacaatttagcaccccttttgggaagctattttgcaaattatacagagagccccaactgttaccacacagtgattatataagaggagctttaaatatgttctaaaattttaccaaataatttgattttttctaatgtatcctaaaaaaagaccataaatatgaaaaaaagtttgatcaacacacttttcactgcagagttctgtgttaatgtgaaaggttataagcagtttaaggactaggtaagtgatattccaactctgtagaatattttgcagatattaaaatgctttagaaacgtttagaatcacatagaaatacttgtgccataatattaaatatataaataggatatagagtaacagtggaatctcagttattttaaatttgcatagaaaattgtattaaaatgctaatagtaagacagtggaatgggaagtgatttacccattaaaaagaaacattctatatcatatttttgtctttcataaaaccacatatattataaacttccaaagggaaataaatttatgaatagcaataacaacaataaaagactaagagaaacatacccacatacacccacccattcccacccacatacacattcacactacaagaaccaaagagaactcattctcatttattctgacatctactcttttctaccctctcatctacttttgtcaacaaagttgaaatattaccttgataattttgtccccagtttctgctagagtgcttactgaatagagaaaggaaaatgagcaactgtaattgactatctcgtcttctttttcatgtttttcaaaatggtaccataataatttttaaaaacatcctatattcattgaaaattgatcttaaaatttatctgtaaaagtatcaaatgaaaattgaatcacaatctctttttctaaaccttcatgcttatatttattctttatattataatactaagtacctcagatggattcttataaggaagacatttgtgttaatataagaattctgagttgggtgcagtggctcacgcctgttatcccagcactttgggaggctgaggagggtggatcacctgaggtcaggagtttgagaccagcctgcccaacatggtgaaacaccgtctctactaaaaatacaaaaattagctgggcgtgggggcaggtgcctgtaatctcagctactcgggaggctggggcaggagaatcgcttgaacccaagaggcggaggttgcagtgagccaagatcgcgacactgaactccagcctgggcaacaggagcaaaactccattcccccaccaaaaaaaaaaagaaattattctagacctcgtcgtgaatcaccttagtaatatcatcaagaataaatcaagggcacatttcttttgttctgtgtgtccggctctgtaaatattttaatatttcttccacttgaatacctttttagtttttctgccaaacttgtggttttatctatggaattttctgtatatgtatagtagaaagtgttgcaatttttatttctctgggtaaaaaattcctatgggttttataaaatagtttattgtacttcttaagaattaagaggaaaagacaattaaaaatgcagttacagcaaaaggtcagaatacaattttcagtcctgcatattttctgatatgtggcatggtgtttcaaaagtcatgtaacttcacgatagtatttgaattgagtttgtgtgtgattgcttaacatctgtaaattgttaagataagttattgcacaggcctactttagtttagattagtttggaacacatcccagggtatttaatcagggtataatcctgcatagtgcaatttctaaaaggtgtgtttgtgtgctttaaataaatagcatttttttgtaggcaaagttacgtcttatcctcttttctaaaaaaaaatctgttaaaaatgactccctacagcactcttgtattatctatagcttcaggcaaatataatacttaatactgacttcaaaaaatgtactgtagaggtctgcaatgtttggtattaactgtgttgaaatgtatgacaatattctattgtaatcttatatatttttctttataacttatatgagcaatttattttttatttgtaaaatttgtggtatgattaatttgtagaactgaaaatagagactgggaggtgatattttgataaaaataaatattttaacattgccatggttaattttactttcagtttggaggatggattgactacacttatagttaatttaaaaatacaaatttaaaaatgttgtggtgtacaaggaaataagacatagaaaaagtttggaattatacagtattttactaaatgttaaaaacaaaaaaattaacaaagcatcacagacttaaatgaatacaaagtattttaagaatagaatttaaaatgcctatgctgttttgacatagtcactaattgtaaccttttgaataaactggaaatgaaattaaattgtaaaattcaacttatttaataataataaattgtgtttcttttaattgatctggtagcagttctgcacatactcaaaatttggaacatgcccaaatctggcagttagttctcattgacccattttttgtaacgtttaaaaatgtgaagcaatcaaaataagattgtgataataatttctagagaatattcaaatgtaaaatgaagagtatcctttacccttcatcagtattattgtgctcctttctgcttctttatttagctttattcaattttagaaactttgtaattgtaaatttgtgttttctggttttttaaaaactgcatatttatcctaagtataccttgatatttctgtagaaaagaacctacttgattttattttatttcttattatttattttgagatggagtctcgctctatcgtccaggctggagaacagtggcgggatctcagctcactgaaacctctgccttccgggttcaagtgattcttctgcctcagcctcccaagtagctgggattataggcatgcaccaccatgcccggctaagttttgtatttttagtagagacgggatttcaccatgttggcctgactgatctcgaactcctgacctcagaagatctgctcccctcagcctcccaaagtgctgggattacaggtgtcagccaccacacctggctgaaaagaacctactttaaatgatgataataagttgcttactattagtctgagaaatacaaatttaacgtcttcttatttgatgtaaaatagtcaaaatttcataccagtcttgttgaattacatgatttcaaactttcttattatggtctgtcagctaaagagacaaaaaacaaaccaaccaaccaaaaccttcccaccacacacgtcctgtccccactcagggttctgggcagaagagactcagtgtcactgactgttcatgaaggtcctggccctggagtactgcaccttttaatgttacccttaatatgtccatgttcaaacaatcaggacttctgagggacctactcagtaatagattttgtaaaatatacccttatttggctagcacttaaattgaagttactttccataaaatccttattttgatataggtttatgcaatgaattgttcatcttgtttgacatcttagtagatgagaattccgtaatattggttataatactttgtgtagacattatacctaactgcttttttgaacctagtacacttcattttatgactgggaaagtctaaataaatcaattaaccttcatgaattttaaattttttatagcaagtatttctcttcagtcttaatttttcctatattataattcatttgagttttctttcctggaaagcagttcttaattcacctgcagtattttccttttaaaaaagtgtattacttttttcctgtctttttcttattcttattttagcttcatcttattctatggctacagttacagtttttccccatttatctgaatattttcagtagttcattttcttcatttgacctactaaacaatgcttcttttactattttctattacttatcagttaatgtttctacgatttattcatcctgatgcaatatttttgagtacatgttgattgagtcagtatttgtgaaaaggaagcctagagtttggtaattagtttttcctgtggaggtagtttctgaagtagaaacaaacacaaaacacctgaagtgcttttggaggcatgtaactgaggcagcgatgtaaagtcacagcacaaagaaacagaggtactgaggatatttgaaaagacagctcatggagctgttagcacctatctttgccctgtgacagctagtcattgctgctattattattttttattatgataatcgtcctcattattacattcattttaaaggtcatcaaatggagaacagacatatagtttattttaagtggtgctacatcttataatttatcagtggatatgttgctaaatgatggttccccaatagctctccttggggaacattacattggagtggtcacatatgaataaactcagagtcacatttattgctttagtaaatatgtgcatggaaaattatattttatagcataaataagcttaaggttagtttatcactaagaaactagagaaaatatacacattgaccttttttgtgtgcttactttgtatgtttcttctatgtgaatatttttaatattgcctttaattgtgggtgatttttgaaaagacagactttttaaaaatacttgcaagtactgaggtttatgtatttacgtactgattctgtagttcctggtaacatttttctttttttttcctggtaacatttttctaatcagttaactaccttgcttagaacatttttgctaacactccagagtcaattataaaaaatatgacagatatatggtaaaaggaaattcagaataatcaaatcagaaatgctgagaaaaaacctctactctggctgctgagaggctctctagtctcagacaagtccctgtctaggcattcatatatttgactgtgacttgtgggaggaccattttcacaagaaatttgcaaggataaatatgaaaatgaatactgttctttttttcttaaatatattttaagatactgaaaaattatttccaagagggcataaaaatttatattgttctttcttcttcaaataggttatgtgggtatgcaatttatgtcgaaagcaacaagaaatcttaaccaaatctggggcatggttctttggaagtggccctcagcagacaagtcaggatggaaccctgagtgatacagctacaggtgctggctctgaggtaccaagagaaaagaaagcacgactccaagagcgatcgcggtctcagacacccctaagcacagcagctgcctcctcccaggatgctgctcctcccagcgcaccaccagacaggagcaaaggggctgagccctcgcagcaagccttggggcctgaacagaagcaggcttcatccaggtctagaagtgaacctcctagagagaggtaatagttctttcaccctgtaagcaaaaggcaagattttgctaggagagcaaagccgttttcaagaatttaacttctattacgaggaatatgtggaagtagtacttctcaggccccacatggaaaaacaaaaggcctgaggggcgttgtctatctctagaatgtattccttaggagacctttgttgaaagcatttctttcatatcatgcacagatgtaaacatgaactaagtcacccagctgagctaccaacttccaatgatgaactcagaaaagctcttagatcatgtttcacttataaacctagccctttaattaaaagtgtgctctgagaggatgtgatgggggaatctgacctatcagaaagtatgtggacacatcagagaagccttctttaagggtatttcttttatgctgagctctaaagagtgactttgaaattaaccaggagaagggaaggatgggtgctccaggtatctgcacaggcacatggcctgaaggaacaagcccaacgtgagggcctcctaaaggatagctgctggctacagtgcaagtagcagaggcaatgtggaggagaaaaggctggtgaggtggtgaagggacaggttacattttatagcttttattgtaggtgaaagggaagccactgaatatttaaacagggacgaatatgatcagattatttactttgattgattcattcaaaaatgtattcatgggcaaacatgaagctatgcactgggaaaaagtgttgacaaagaagacagagcccttatcttcatgaggctcatgattttggggccaggacttttgttagcacctagactgggcttattgtttttgtatgtgtaaccattacttggagaaaggaggctccaaggaaagcttttgaaccccttttcaagcaaagcccatacagtaaaagatcaaggacttcaaagttaaataggtctggattctagtcctggctctgccacaataggcagtaaaaactcacttgcagggttgtggcaggtattaaaagagaacatgtgttcccaagctggcacatagtaggctttcagtgaatgtagctattattcaagccagtagtcattgtgtatttactacagataaacactgtgccaggaaccagagggcataaagatgattagaacatacatggtcccttttctgacaaatcctagggaagagaccacacactattctagggaagacagacacctaggtaattaacaaggatgctaatttgatcaaagctaggcaatatgtatagtattttgagagccctaggaaagaggaagtgacttctcaattaagctttgtaagatactcaggagttgtaggggagctacacagcgtataagagggcagtacaagagaatgagtgttactaagctatttggagaaaggatagaaaggacaccagagatatctcagggaacgtagaattaatagcatttggtgacaaattgttgtgggagaagaagagacaaaaatactgaagctgcagtttggaactggttggaagatgatatctttaaataagatagagaatttggagctgtaaagtttctaaagagaaaagagttctgtttttgacatatagtgaaaaactataaaaatttcaagaacaagggctgaatagatactttttgttctgactttttagttaaaatttgaagaagattgatagggacaaataactttactaatgatataaattcacaggaaagcaatgaggaattgggaagtacagaagcaggaagagaggtggccagtgtaaagagctgggcaacttcagggagaagcaagattgaaagagacactgtttatttgttttaaattactgaagaattcttgaccgtattttgtactgtcaaggagttagaaacagaaaattaaaggtagagatgagaaaaagtataattagtagagcaaagaatcagagacactggagaactccttccatttgcatgacactctaccctttcataaaacatcttcacagatggtgtctctaatcctcacatgaaccttgcaaggtaagtatttttcagcatttcaagaaaagtaaattgattcaatgtaaacttctaacaagagcaactatgcttcaatgagctgctaaatgtagtacaagcatgacactcttatgaaaactatatttggtaataattaatatgtgttcccattagatcccttaccttgtaaaattccaacacccttacagttccaccttcagatccaaatccctataactaattattgtaactgaaatgatttaagactggaatgagaagaaaacatgttttttatgtctagtctttataaattgctctccttgacgttcctttgtatatcatagaaagaagaccccagggctttccgagcagaatggcaaaggagccctgaagagcgagcggaaacgcgtgccaaagacctcagcgcagcccgtggagggggccgtcgaagaacgggagcgcaaagaaaggcgggaaagccgaaggcttgagaaagggcgatcacaggattacccagacacgccggaaaaacgggatgagggcaaagcggcggatgaggaaaagcaaagaaaagaggaggattatcagaccaggtaccgcagcgacccgaacctagctcggtacccggtgaaaccgccgcctgaggagcagcagatgcgcatgcacgcccgggtgtcccgcgccaggcacgagcggcgccacagcgacgtggcgctcccgcgcaccgaggcgggcgcggcgctgccggagggcaaggccggcaaacgcgcgccggcggcagccagggcctcgccgccggactcgccgcgggcttactcggctgagagaactgcggagaccagggcgccgggcgccaagcagctaacgaaccacagcccgccggcgcccagacatgggccggttcccgcagaagccccggagctcaaagcccaggagcccctcaggaagcagagccgcctggaccccagctcggcggtcctcatgcggaaggccaagcgcgagaaggtggagaccatgctgcggaacgactctttgagctcagaccagtccgagtcggtgcggccgtccccgcccaagccgcaccggtccaagagaggcggcaagaagcggcagatgtcggtgagcagctctgaggaggagggcgtgtcgacgcccgagtacaccagctgcgaggacgtggagctggagagcgagagcgtcagcgagaaaggtaagggggcggcgccggccgtgcggggacttcagccaagtgaagaggcgtgggcagaggtgcaggtgctaggctagttgctgggttcagcattgaggctgggaatgctcacagataagatagcgttaccgccagtggaaggtcttatttttattaatttaattttattgattgatttgtgggattttaaaacacaacaagctccaaacttaggctacaaaagttcttggtgattttgcattctgtcattctggtaaatttggtatgcagtctaatatttttaagatattattttagagtggatttattattctgtgaaaaacaatttgtttgctagaaaatgaaaattatgccttataaaggaagtagacattaaaaaaaaaccacatcagttacgtaatattacagttgcaaaggtagtttttttttttttcaaacttcaaattaacctttctcacaatttgtgaacagattacagtttattcttggacaatacggatttgaactgcatgggtccacttatatatggatgttttttcaataaatatactggattttttttttgagaattgcagcaattttaaaaacttgtggacgaaccgggtagcctggcaatattttaataaaataagaaaaagttaggtatgtcatgaatgcatactatatatatagatactagtctgttttatcatttgctatcataaaatgtacatgaatctattataaaaagttaaaaatgataaaaccttaaacacacacttatagactacgtggcgccatttgcagtgggaagaaatgtaaatatgtaaacatgcggtattaaatcatagctgcatgaaattaactgtagtgcatactgtattactgtaataatttccttagcctcttccagtgattttagtgttgcgagcaccactttaaaatgccctgtgatgcttatcatctccctttgagcagtttctttctccagtaaattgcgtggtatcttgtggttctcacgtattttttgtgatgtttagtgcaataccattaactttgaataataccatgagacccatacagagtgtcattagtgacactagaagtgctcccaagaagcaacgtcatgacattacaagaaaaagttgaattgcttgatgtgtaccgcagattgaggtctgcagctgcagttgcccaccatttcaagataaattcaaccagtgtaaggactattgttgaaaaagaaatttgtgacgctgttgctgcagctacgtcagcaggagcaaaacccgtgcactttttgtgaaaaacttttatcttgccttaaaaatgcagcttttatgtggctgcaggattgctataaaaatgtgtatctatagactctaatattaggaaaaagcaaagtcgtcatataacaaagcagaaggatagtcaaggacctaaagctagagaatttaatgccggaaaaggatggcttgatcatttaaggaagaggtttggcttttaaaaaatgtcaaaagtagaagcagcttctgtggaccagcagagacgagttctagatgccattaagaaaattattgaggagaaaggatatgtgcctgaacaggtttttaatgcaaggtgctttattctgggaaaaaaaaaaaagtgccaaaaaggacatttagtagtaaggaagagaagcaagcactagtatttaaggcaggaagggttaggctagctctactgttttgtgcaaatgcagtaagggctgcctctatgtataaaactattaaccccctgagtgttgaagggaaaaaataaacaataactgccagccttttggttgtacaagaaggcctagacaagagttattttcctggactagatacatggatgttttgtccctgaagtcaggaagaacattgctagtaagggactgtcttttaaagttctttttatattgaacaatgcccctagctacccagaaccccatgagttcaacacgaaaggtgttgaagtggtctacttgccttcaaacacaaagattccagtttggcttctggaccttaaaggctcatttgacatagtactgtatggacaagattgtaacactgtggaagagaaccccgataaatagaatatcatgaaaatctggaaggattacaccattgaagatgccatcgttgttatagaaaaaaaacatgaaagccatcagacccaaaacaattcattccttctagagaaaattgtatcagatgttgtgcatgacttcactggcaaatcaaggaaatcatgaaagagattgtggatatgatgaaaaaaaaaggtgtggggtgaaagggttctaaatatagattccagagttaatagacaccacaccagagggattaacagaagataacttgatggatgagtgcttcttaagcaatgacagacactgaggaagaagaggtaaaagaagcagtgccagaaaacagattgacattagacagtctggtagagggttcctgttgttcaggactccttttgacttcttttaccacatggatccttctatgatagagacaatgacactaaagcaaatggtggaaaaaggattggtaccatacagaaaccaatttttagagaaacaaaaaagcaaaaatgtcagacagaaattactatgcattgccataaagttacaccaggtgtgcctgcctcttctgcttcctctcccatctcctccacctcttttgcctctgacatccagagacagcaaggctctttttccttctcctcaatgtgaagacgacgaggatgaagacctttaggatgaagacatttttggtgatccacttttacttaatgactagtaaatatatgttatcttctttatggtttccttaataacttttcttttctattgcttactttattgtgagaatagagtatatgatacatataacatacaacatttgtgttaattgactgtttatgctatcagtaaacagtaggttcctgtcaacagtaggctattagtagttaaggttttctggagtcaaaagttatactcagatttctgactacttgggggtcaacccctaacccctgtgttattcaagcatcaactgtacttcacaagtattgtatcaagcaaggtgttatgtatggtgttttgggtagtaactttgaggtaaaaagttcatactccaaaagttgtgggaatattgtgtgatggtctgaattttcactatataatgctgtagccccatgtagctatttaaattaaataaatgaacttaaaactcctcttcttctgaagaactagccaaaaagcctggtgctcgagaatgattatcacaaaaagttccattagatagtgcttatgtagaaaaggtttcaatgtaatattaaaattatgtgcttagtttgaagattctcctcattttgcttctgttcactcagatttaaagtggccacagtcctaaatttaatggtgctggtcatcatccttgtagaagtgttggagcccttcagtgtttcttaatgtttttgtatttagggggactgtttgcagtttttggctttgtttgtaattgccaaattgcataataaattatatacaaaatattataatttaagaattacttcacttcctcattctatgtccgaactgcatgtatatatgtacccccccccatatatatgtgtccgaacaatctcatactatatataggaacaattaagaaagctcattctggccgggcgcagtggctctcacctgtaattccagcactttgggaggccgaggtggggggattttccgagctcaggagttcgagaccagcctgggcaacatggtgaaaccccatctctactaaaatacaaaaaattagccaggtgtggtggcatgcgcctgtaggctacttgagaggctgacacaggagaattgcttgaacctgtgaggtggaggttgcggtgagccgagattgtgccactgcactccagcctgggcgatagagcgagaccccgtcaagaaggaaagagagaaggagaggaagagaggaagaaaggagggaaggaagagaggaatgaaggaaggaaggaagggagggctcattttgttattattgctgcaacccaacttaaaatagtgtctttggaatgtaatatatgtatatgggatcagtcagctcaccttccaatgacttctctttataagttgcatattatttatgggcttgtaaaaagtcaaatggcgggtagattatcttgactgccttttgtgccttaatattgttgtatgaacacatatttttccctgaggtaataaagtaggtattaaatagaaatgtagatatacttaatttgtgtccagatatcctttttgttttttttttttttttggagacagagtctcggtctgtcaccaggcggagtacagtgatgtgatcttggctcactgcaacctctgcctccctgcaacctctgcttcctgagttcaagtgattctactgcctctgcctcctgagtagctgggactgtaggtgcgtaccaccatacccagctaatttatgtatttttagtagagacaggatttcaccatgttggtcaggatggtcttgatctcctgacctcgtgatccgcccacctcggcctcccaaagtgctgggattacaggtgggagccatcgcgcccagcccagaaatctcttgatggagattgatatgtgtattagggttctctagagggacagaactacaggatagatgtatatataaaggggagtttattaaggagtattgactcacagggtcacaaggtgaggtcccaccataggctgtctgcaagctgaagagcaaggaagccagtctgagtcccaaaggtgaagaacttgcagtcaggtgttggagggcaggaaacatcccacacaggtggaaggctgaaagactaagccagtctagccttttcatgttcttctgcctgcttttattctggccgtgctgggaactgatgagattgttcctgtgcagattgagtgtgggtcggcctttcccagtccactgactcaaatgttaatctcctttggcaacaccctcacagacaacccaggaacaatactttgcatccttcaatcctgtcaagttgacactcgatattaaccatcacaagtccacccttgtcaacttgaacccatacacatctgaaatcatatgtaatcttcaaataaagacaataataaggtaataattatgccgaacataatacaactatccttcgtacaaccagaaagtaccaatccccaacccaaatgctgttacatagagttaacaacactgaaatgctgatatgaagtcaataaatcttatgtcacatgataaaggaaaaaggaaataagatgaagatattttcttagcacaagtgtatacatgcacaaatatgttcttaacaaaataagaactcatgacaattacagttctcatttctgcacttggtcacatggccatagctggaattgatgactaccttctactacccattctttatttcctttgccttctgcaagcacctcagcagtttgtggttttttacctggtagagtcacccagaccatcattcctgagggtctgggccatttgtaatcctgcctggattgggctgttgtagttttccatttacctcaatcacagggcatggtaatactaagagacgccctaagggatctcctgtattccatgcatacttttccttacctccattatggagtagtagactgatttcatcttgatagtccaggtcattcacccaagccaacactgcaattcccttcttggcctgttgacttaaaggtagcagtggccaggtggcaatattaacttacagtttaatggaatcattgtgtctcctggtgacaggttccttcctctggaactaagacctttagaccagcagaacataatgttatgggaacaggaagcaaaaattttgctagtgggtctctagggatgatggtgagtgttgccacttccacttctaccttttgattcctggacctgtgaatcctggctaagggagaaacagtaccatgtattggacactgattcagagcatacacagccctctggagaactttgcctgagccctgcaaagtattatcacctagttggtgttgtcattgcgacttcaaaaggccattccactgttctatcaatccagctgcttcaggatgatggggaacatggtaagaccagtgaatttcatgagcatgagcccactgctgcacttctttagccgtaaagtgagtaccttcatcagaggcaatgttgtgtggaataccatgacagtagataaggcattccatgagtccatggatggtagtcttggcagcagcattgcatgcaggataggcaaacccatatctggagtaagtgtctgttccagtaaggacaaaccactgccctttccatgatggaagaggtcgagtgtaatcaacctgccaccaagtagctggctgatcaccccaaggaatggtgccatattaagggctcagtgttggtctctgctgctggcaaattgggcactcagcagtggccatagccaggtcagccttggtgagtggaagtccatgttgctgagcccatgcgtaacctccattcctgccaccatggccactgtgttcatgggcccattgggcgatgacagaggtggctggggaaagaggctgagtgttgtccacacaacgagtgatcctatccacttgattattaaaatccttttctgtggaggtcacctgttggtgaacactcatatgggatacaaatatcttcagtttttgaccactcagagagttccatccacgtacctcttccccagatttctttgtcaccaattttccagtcatgcttcttccaagtccctgaccatccagccaaaccattggccatagcctgtgaatcagtatgtaatcacacatctggccatttctccttcatgcaaagtgtacaaccaggtacactggtcgaagttctgcccactgggaagatttcccttcactgctgtccttcagggatgtcctagaaagggggtgtagtaggctggggaagctggctcatgcctgtaatcccagcactttgggaggccgaggtgggcggatcacctgaggtcaagaattcgagaccagcctgaccaacatggagaaaccccatctctactaaaaatacaaaattagccgggcatattggtgcatgcctgtaatcccagctactcgggaggctgaggcaggagaatcatttgaacccgggaggcagaggttgccgtgagctgagatcgcgccattgcactccagccttggcaacaagagtaaaactctgtctcaaaaaaaaaaaaaaaaaaaaaaagaaagaaagaaataaaggggctgtaggggctatagtgctggagctgtccgccttcatttggtgcctgcatatggtgcagaaccatctgtgaaccaggctctagtctcctcttcctctgtcaactgattgtaggaaactcctgatgagaccataggtgcatgctgtgggggagaaggcagggtggcaggagtggagatgatgggcatttgagccacttcctcatgtaacttacttgtgcctcaggacctgcttgagcctgatcacatatatgccacttccatttgatgatggaatgctgctgggccccagtttatggctagatgggtcagaaagtacccatttcacaataggcagttcaggttgcgtggtgacttgacccatggtcaaacattcagtttccagtaaagcccaggaacaggccaagaggctgtctctcagaaggagcgtagttatctgcagaagacagcagggccttgttccaaaatcctagaagcttctgctgtgattcacctatgggtgcctgccaaaggctccaaacagcatctctatctgccactgacacctcagacaccattagatctgctggatcatatgaaccaagtgacagagcagcttgcacagcagcctggacctgttgtagagtcttcttctattctggaccccactcaaaactagcagccttttgggtcacctgatagatgggcagagtaacacacccaaatgaggaatgtgttgcctccaaaatccaaataggcccactaggtgttatgcttctttcttggttgtagaaggttgccaaatgcagctatttatcctttaccttccttagagggaatatcttgacaagccccacaccacaggacccctagaaattttactgaggtagaaggtccctgaattttagtcgaatttatttcctatcctctggcatacaaatgtttcatcagtaagtccagtgtgtttgctacttcatgctcacaggatccaatcagcataatgtcatcaatgtaatggaccagtgtgataccttgtagaagggaaaagcaatcaagctctctcagaacaagattatgacacaaaaccagagagttgatatacccttgaggtagaacagtaaaggtatattgctggccttgccagctgaaggcaaattgcttttgatgggccttatggacaagaatagagaaaaaggcatttgccaaatcagtggccgcataccaagtaccaggagatgtgttaatttgctcaagtaatgaagccacatctggtatagcagctgcaattggagtcaccacaacttggttaagcttatgataattcactgtcgttctccaagatccatctgtcttctgcacaggccaaataggagagttgaacggggatgtggtgggcatcaccacccctgggtctttcaagtactcgatgatggcactaatctcttcagtcactccagggatgtgatattgtttttgatttactatttttctaggtagaggcagctctacaggcttccatttggcctttcctaccataatagtcctcaccctaccagtcagggagccaacgtgggggttctgccagctgctaagtacgtctgtgccaattatgcattctgttactggggaaatggccacaggatgtgtccggggacccactggacccactgtaagttggatctgagttaaaactccattaattacctgacctccataagcccttacttaaactggaggaccacagtgacatgctgtgttccctggaatcaatgtcagctcagagccagtgtctggtagttcctgaaatgtctgatcattttttccttcctccagtgcacagttaccctggtaaaaggctggaggtctccctggggaaggataggagaaagagtaacagcataaattgtcgatagtgtagtggggtcctttctcaagagcccccagctttcccttcattcaatgggtgctgggtctgtaaactgtctcaggtctggaaattgattgaagggctgtgattctctgttttaataattcaaattagtcttttttccactcaacctggaagttttctgcttatataaattaagaatgcagtaggcgtcctatcaatttcacttctaggaacactgtgattaattagccaatgccagagctctacgtgagtcaggctattccgattgctgctttgcctctgctgtccattatggtagctatgcccaccttgcctttgatggttgagtgctgcccttggctcctgccaccttagtatctaattattccagttgcacagatggagggctgaaaggctaagccagtctagtcttttcatgttcttctacctgcttttattctggctgtgctggcagcttatgagattgtgcccactcagattgagggtggtctgcctttcccagtccactgattcaaatgttaatctcctttggcagtacccacacagacacacccagaataatgctttgcatccttcaatccaataaagttaacactcagtattaaccatcacaatatgtatattctcccattccttaaagggctcttcaccagtttttattgaatatgtgttataaatcacagtgagcatggaatcagacataattaaatcctaaaattatttacaataacagcagataatgaaagaaacctgactggtggcatgggtagttggagggttggagcttgtctgatgtgaagaacttattgcctcaccatgctgtttcccctccttgggaatttatcattctggagactttggttaccatttgggttgtacacatctctgaagttagtgttaaacctgtgcatctgggaacacaaggataccagacgctcatttatctgataaagacaacctggttcctcttaacataaatgatctcattctcaaataaattgtgtgactataccttaaagtggtcatcctactctaatattttaaccaatctcagcctttacaaaatgaaacacaaagagcaacaccttttatcactgtagcatggagatttgcttatttcaaacttaattagaaatgccatctgtaatagctattaataactttattagcaaactccaccattgcctactaagggtgattttgggaaccagccatgataatctccagcaccttgtgacactgcacaagttacttaacttccataaatctccattttcttattagcacaactgaaataaaagtatctacctcataaggttgttgagtggtttggatgagataatgcatctataataggatgctaaattaacattcttcatatctttattttgcctgtggtactaataccatatatgtttattatcataattatgagataattatcaatatctataatatacaaagaaaagggaaaagaaacagttttgtatgttatgagccccaatagagtgagaaggcaaaggatgatctgggaagaaatttttttttagagtaattcaagttttcttgatatttagtttaaatgacaattgaaaatctaacactttgtggaagatgtgttctataggaatacatttaaccgaggaggtgaaagatctctgcaaggagaactacaaaacaccgatgaaataaatagatgacacaaacaaatggagaaacatttcatgctcgtgtagcagaagaatcaatatggttaaaatgaccataaccatccaaagcaatatacaaattcaatgcaattcctatgaaattaccaatgtcattcttcacagaattagatttgttaaaaagaatagtatgtcatttttgaatctcaggtgggggaagattatcctcatggaataaaatttaaaaggacagtttatcagttacacatataagttaaacatttaacacagtacctggcatatggtaactacttaatatatgtgtactattattgtcatagatatatactactatttgtattttatgctgagtttgttcttatgtttgttaaaaaaaggtatttcacattttctatgtatttactgaggttaaaaaaaatatgcttcctactctaatggagtttatattctattgagaaaaataaacaataaggaataattacacaataaaatacaacttgataaatgcctcaaagggacatttctccttgatgtattgatataatattcctatgtgttttgctgtctcacaaaaccaaaaggtaacctggtcaaaatggcatctgaaagataacacagcctttatagtcaatataatctttcaaatacagtttaattcctttgaatacacatgcaaagcacacacacacactgattaacaatgggctctatctggtgggattatctaaaaattgagattaacaaccacgttttacaagtgattgccattcatactgctattgccaggtgagaaaaattgggcatctcttgtcttttagcttataaatactaactaatataaatctctctaaatggaagaaaaagtgaactaaatcctgcttataaaataacagttaaagttaaatgaaatatgtaatataattcattgaaagaaggtctactgaagattcatactgaagattcgtgcctgtgaggaattgagtaaagaggcctaagagtaaacagtgaaattaaggtgctgtcttgatccaagggaaagccacttatacttaaggaacttaatatataaatcctaaggcagggagttggaagaagagcctggcataggataacaggatttccttccttctttatcttctccatgctgactttcagtaaactgagaaagtacaacacaaattaattatgcctttgaatttctacagtgctttgtgaatggcttcagatgtcaacctatataacaaggggcagttggttggtttatagctgttactgctaggcagtgtttagcagtcttttgaggagcataaggtttctggattagtctaagaaatgatacatgcaagaatatcaaacaatgagtagctgaataagactgaggacccttaataacagatgtgacttttacccctaaatatagagatggtgttagggtaccaagtgtagattgtggcaatatgaataattgcctgttaagtttgggtacctgacaatcattggagaatcgggaactcttataagatgatacatcctttaaatgtaacttatgcaatgctttatatggtcacttagttcttaaactaaacgtactgggagtatcctctttgggcttcagcagtataatgcatactgctcacatagtgcttataattttgactagaagtgtattagtccattctcttactgctataaagaactgcctaagactgagtaatttataaagaggtttagttgactcataattctgcatggctggggaggcctcaagaaacttagaatcatgatggaaggggaagaggcacgtcttacatgacggcaggtgagagagagcgagagtatgaaggaggaactgtcagatacttataaaaccatcagatcttgtgagaactcactatcatgagaacagcatgggggacaccgcccccatgatccatcacctcccactgggtctctctattgatacatgtggatcatggggattacaattcaagatgagatttgggtggggacacaaagcctaaccatatcaagaagttattggtttatgtatatttcctgggagcaaagaattcattttgtgttcttctcatagtcctggtattttttcttgtaacattaagagggtttgcaattcaaaaatttggctattatttattcatgtaataatttatttaataaatatctaaaaagaacctactgcattatgagtgcactcttctagctagtcaattgaaaatgccatgaatgcaaggaccatggctatttcctctgtctgtctgtctgtctgtctgtctgtctatctatctatctatctatctatctatctatctatctatctaactggggactttatagagagacaggatgcttcaaaacaaaatcaggctctgtggtaagaatttagctacatatattttaaaaattgtaaccttaaaacaattacaacttaacccatttcccgtttgccctaaaagtactgtgctggcagccagctgcactttttttttttttttttttttttacctatacaggaaatgggttaaaaggagctttctcttcaaatggctgtcaaatctcagcatttgtttttcttactccatgagactcccataaaatactcataaaagtgatgagaaaaggtgaactatgagtagatgagatgtttatagcagatggaaaggcgaatatagcgtgcttttccacataagagcttgtcaggtaggcatgagggtgtggtggtggagtagagagctatttgccataaagcatctttgtgaagacttcaggctcagagacatcagattcaatggagctgaagtgagagggagcacttcaagttggcatgttcattcagtatttgttgacacacacttttacatcactcttcttaccattcccccttcctctttattgccttgcacacactaaaggcccaagatttaaatcctaggtaaatatcaagaagcaattcagcacactgcttgagcaaaaatcagatactaggagtaggtgcctccccactgtggaacccccatccataccatcctaaagttgagcttcacacctcattcatcctaaagtgaaagctatccattcacatactctattcacaaatgtcagagatacacttagtatctaccagagcagcctatctaaaatgatctacgtggaaacactcaccagccacacaggaaaatccactgattggttgctcattttaaatgtgaatgaacaacaaaacccaaaagataggaagaaccacgataaaccaagacacattgaccctggaaataagagatcattcaagagcagaagaatgcttaaaaaacaaacagaacaaaatgccacacatgttgctcaagtttagtataatacttcctgaaatgtctaacccacagggaaatttgttcacccaaacacacaaatattctgtgtaaaatacttttttaagtattaaagttattaacagaactcaagataaagagaaagctctgggtaccaaaatttatagcattgaagtgcttcgacaaaggtgactggacaaaatacaagattatatgaccaaactcagtatcacacacttgcctacaggtatggtatctgggcaattctccaagccaggaaataaaataacctgatcttaggcattaaaacaaaagctgaagtaaaagtgatgaattttgaaactacaaagaggcaaccattaaacttacctatgaggaagcccatacagccatggggatgcccaaagatgagtacaaagattataattgtgaaacataagaggaactccaacaccattaaagatgccaaggaaaaggggaaaaatgtataagcttttggaggttaaaaaataaaccaggtcatatacaaaaaagagttaactgcctttatagttctcatcagcaatgatgaactacagactgaacataaactacagttgatgaatgccttcaaaattttgagatttctctaaaaacaaaatagaacaaccatataatccagtagtcccactactggtatttatccaaaggaaaggaaatcagaatatcaaagggatacctgcgctcacatgtttattgaagcactattcacaatagcaaagatactgaatcaaactaagtggccatcggtgcatgaatgggtaaagaaaatgtgcatatacgcaattaaatacgattcgcccatatgaaagaatgaaatcctcttatttgcagtaacatggatggaactggaggttattatgaaataataatcatcatcatcatctgcagtaacatggatggaactggaggttaagtgaaataagtcaggcaaagaaagcaaacatcatatactctcactcatatgtgggagctaatagaattgatttcatggaggtagacagtagagtgataattaccagacatggggaagggtgtgttgaggggagagggatggaaaagagaggctgctcaatgggtacaaacttacagttagatagaaggaataagatctaatgtttgatagtagagtaagtatactatagttaacaacaatatatttcatatttcagaatagctagaagagaggacttaaaatgttcccaacatatagaaacaataaatacgtgagataatggatatcttaaataccctgacttggtcattacatatgctatgggtgtaacaaaatagtacatgtacctcataattatgtataaatattatgtgttaataaaaatatacagaatcaattatgagcaaagtaattttgaaaccgcaattctgtattcatctaaactatcaacttcaaagttctcagaaaacctgcattttattctcgttctgagaatgttatttaaggatatatgcacccaagaaaactgaataataatcatgtagtcaagacaaataataaacaagaaatagtagaactaacccagaaattcaatgcaaggaagtccctgaatgacatgtgcaaaaagaagtttgttcagattaaaactggaggtcatttccaggaggctccaataagaaagtctgtattaagaagaaggtcatggattccaagaaatatccaatgactaatgaatgagttacatgacatcatagacttgttaaagaaaggctgtgtcttctttcaacaataaaaaggggcaattaaaaattgataaaaaataaacttaaaaaaatccttgtccaaatgtgaagcaagaaaaaatatgatgtaatttaagtaactgatacagccaattgggccataaacttaactacatttttctctgagtgcctgacagtgcatctatagaaaaggaaatttaacccttgcacattattgccattttcttggttctagggtatttagatgtaatgatattgtaaaagttgcttattggttttcaatttttagaataaaccctttttttcatttaatacttaaaaatgtcaacacaattgaatatgaatactgtgtctgcatgaaaataaaggtaaaactgacagatatgggagttgaaatgctctggagagggcagaggtggagggataggcaggaatatgaatagtcttatgtaaaatattgaagagttaaaagattgtgttcagattttaggacaagaaatagaggattaagtatgtttaaatatagaattgtagaaagataaaactattggcttctgaaaccaaaatgatgtaaataaagtgagcatcttgtctttaatcagttttaacaataggtaatattttaaaattagaaaccagtagataatattacaaataaagcagtcaacatatagagacaaattattttaaaattaggatgttttccattagaacgactaagaaaatatctaaaaataaggttgggaagtagaattgatactgtgggaagaagggatatgaggagaaatcaattactatagttatgcatgggaagctcttatttattttaatttttatcatatgcatgcattaatttgatatcctttaaaataagaaaataaaaaattctatctaatatttcttttattaaattgcaagtaaccaattttggtgtcttctggggccttccataattggtattttagcaatcagaacatcaaagagcagtgggttcacatggaactgtaaaagccttgagttctctttttatactagtttctctttcctttctcttcatatattaatttttcattgagcttccactatatgacaggcacttaccaggtttggggagtatattgcttagagcatagtccctgacctcagtggccctctcaaaagagtccacctgatttcttttgtgcttttcccttttatctacatctgccctgggccctttcccacacaaggtgaggaacacactttcagagacctctacctccacttcttaaccttcaatgaaaggctttctgtagtttcttctttaattactccaaaagaggaaagaaattgccatagggaaacatttggacaattggacaggttgacatttagcactaatgctcaacagttttacctggcctgactttttctggtcttatgaaggatagagatgagaataggcataaaacagaagagagactactgtctgccattgatgagggaaggataaacaattctccctcttaactaccgaaaaggagacatatgacttggggcattagatgcttcagtttaatgccttagagaaagtctgagaactaatttcttcttactgtggatatggagtggacattagccgttttaatcatctgtgcaatttaaatcttgagaagagattgaaaggacacaattgtgtgtgtgtgtgtgtgtgtgtgtgtgtgtgtgtgtgtgtggtctgagctaacatgccaatttcttatttctaagaatatgcattaagaaaaatttggaaatcatggtgagaggctggattttcagtttcaatttctgcctaatatataaacgaccaaaaaaagtctccttgattctaaaacaggagttatgacgaaacataagttctataaaaaggaaagaaattaagttggtaaatctaacatgattatacccaataatatttcttccaaattagtccatggctagaaatattagtcatttagttgcatttgaaagaaatttctattcttgaatcaggagaaactaaattaacatcagggctacattttcaaaaataatcatacaaattttatgtgtaatatatgcttacaactttaatatagaacttttaaaaagatgtgtaactaaaggtcattttaaggggaaacatttacgcttcaaagttcatttagaaaaagatttgatattgaagatttcagtatcacctgttttatctcagtaagttgttctttggtatccttttaaaatgcagaatcatactgcagtgtttttgacccattttatccagtgaatgaaaaggttgtccttattttggttcaatttaacagaataacagaaatctcagacctggaagagggttcagaagcaaacaaaaatctctcctttcacacactgttgatcagagaaggaaacatgggtattgagatctgccgaatttcttgcctttgaaaccctttattatatgcagatggaagagcttgaaactcatcttgtaccctctgaggacaagcatttactcagtccttctacttattctgtctgcagtctgggctcaaccctaacaatctaaattttaacatattcctgagtccacattccagagttgtgccttgttttggttattagatccatttccctagatcttgtgaccaaatctgattctgttgcccaagtcttcagaactgaagcttttgcttgccgtcaccagtccctgtccaggagttagatagaagctggatccctagatactgactgatgtcaactactgtattggaaatccagatactaccttccgtatcatacttattcatacctcgtggggcatttctgattcttactgctattctaggtttattgtatttagccatcttctttgtatgtcttgttttaactactgagctaaacttgtgcaattgtgtcttttttaaaagcacatgtttcatcccaaagggcagatctaattttaattccagtaaacccttctgaggctgctgtgtaccacatgagataataattgtattagtttccaagggttaccataacaggatactgcagactgggtgtcctaaacaacaggaatttattttctcatagttctggaggctggaagtctgagatcagggtgttggcagggttggttcctttggaggaacctggggaaggatctgttccaggcctttctccctggtttatggatgactgacttttctctgtatcttctcatgatcttctctctctgcatgttgtgtccaaatttcctcttcttgtaaggataccagtcatactggattaggaacctccctaatggcctcattttggtttaattgcatctttaaagactctgtctccaaatatagttacagtcggaggtaataggggttaggacatcaacagatgagtttggagggggacataattcaactcaatgataatattcataggaggaaagagaccaagtcctgtagatgtttgtgtacgtacatgataaatactgattttggcatttgtctccatggttgtctatgaaaaacatgatcatgaagaaccttattgagcagttgctttatgaagagggtttaatatcccagatcatgaggacataaataagttttaggcatagccagagactgataacccaggacatgttacttaacccctaagtctcaagttcaatcgttttagaacctggaaataataattgcacataccgcatggagtagttgtaaagattaaatgagattattcatggctctgtgtgccttgtacctgatacatagcaagtactccataaatattctttctttctttttttattttttattttttgagacggagtctccctctgtcgccaggccggagtgtggtggtgcgatcccgactcactgcatgctccgtctcctaggttcacgccattctcctgcttcagccttccgagtagctgggattacaggtgcctgccaccacatttggctaattttttgtatttttaatagaggcggggtttcaccgtgttagccaggatggtctcgatctcctgaccctgtgatccgcccacctcagcctcccaaagtgctgggattacaggcatgagccaccgcgcctggccccataaatattatttctatggcaccaaataggatgcatagataatatattttacagtagtgaggaaggaagcttgaatgccgacgtttaatattagagctggggtagattttgggcagaaagaaccaatgtgtcattctagtgagggagactggcatgaagaaggaaagacaagcatacacactgttctaggaagaataagcttatagacctgtagagagaaaagagcccagaggttacaggttgagggaacaggttatcctagttctgtcaagaactgggttaccttgggtaacagaaggagagggttggattagatcagtgatcctaaaatttttatgtacttttaaaattatctgaggagcatttaaaaatatgtgctggagtagcaccaaaaactaatctggtttagtcaatgtggagcagtgccccaaatttattttaatgtgtagttgaataagttcagtgcacgttgcaatcacttgagggaggagatttttgaaaaacctgctagtattcaggtcccaagcccagagattttgattttagtgttatgggttggggcctgagtattgttattggcaaatctcaaacctgacccttcataaattatgaagtgctagtcctcccatgagaatttttttttggtatcataagatgagcttccaataaaaagttgaatattaatttgaagacacatttgactgggaaagtatccaaaatgatttaacttatgtttggggaataaaatacagagttatatgaatccaggtatgttttggaacttcttaaccttcactttctgactgactagcaggtgtgaattctgcctgggatagctctgtagtgcttgggagcacataaatgagggagggattaaggaacagaagagtgactttgcatatatttggaacagaaactgaaagtcctgtctactttgagataataaatgggaaagtattgctcagagtcttgaggatcatacaaaggtagtaattgtaactgtcctaacactttgtcattccagtcggtgcggtggtgaaactcctgtagattaggttatcattatatacagaatgaaatccaaaaaacttcagccatgcccttcaatcttcacagtgtcttgtgtcttgacacaatcacctctagaactctgttcttcctgactgattagcatttatttcctgtatttcacacttaccatacacttttccatctccattatttggcagtgttctgcctttttaaaatgtcctctatctctagctgtgatttaaaactaaaatcaaatttcgccttctcctcaatcgttctctttgaatacccaattttattcttaatgtttgcatgtgctttcctaagggaaattaattataagcataaacggagaaatcatctttctacatttatatattgttttatggttactaaagtgatagtttatagttacatacatggaattatagttgttggattaagttgtacattgttgaatgtttcttttttaatttatagaagtaattagaaagtaagaaactaataaattttataatttcatagggagaaaagatgtatataaaagtactgctgaggatgattgggtttgaaaaagggtaacttttcttgtcttctaattcttggcatatctgttaagtttattgatttaatggccatgcatttgggaaaaattacttaggtcaataagtaccttttcattggatgacaagacattatttactttgtttcttgtgtaattacagaaacttctcctaattacagagaagtaattacttctgtgttctcaggattctgtttctttaattattttagtaatttggacattaatttttgaactacaaagaggtaactgtaatattcctaccattagacattaatttagtgtgtattctaatgacagagaaaaaaaattatgcatggaaaaaactacctgagttattaagagagaattgccattagatttaagaaagaaataaagcaacatcaataacatcaataataatagtgaaacacaaaacaggttaggaagctcagactgacagctaagtgatcagaagggaaattttaattggcataatccccagaaagaataagagctctaaattaggtgtaggggctgccaagacagctctttctttgggaaaccatgagttaggttagaaattagggactttggggaaactgagttgaattgagcatgagattgtatatttcacaattaatgggggaactagaatagtgattagagtggttcaaactcaaccaagcctggtgtttggaactgaaatcatgtaagaacttttctgtaacccaaataatgagtcaacttgtcaaatttatttaatagctgcaatcattacctctaactgacttatttataaatttagtttataaaatgtgattgcatcacaaagagtatcttggcataataaatactttatgatagatatggacaagtattttttatgataacaaactctataatataaacactggaagtcagcttagtttccaacaataagatactggttaaaaagcactgattataggaatattgtgtagccatgaaaatcttgttatatattgttatatttaatgacataaaaatatatttgtgatacttgagggaaagggattgctaattatatctatactatatggtatgtttttgaaaaaatgattacatatgtgcacagagaactaacaggatatataccaaaatgaatatacttatatttttttctgttgtctctttctgtgtgtgtttttaaacccctaccatagttatattctcttgtatttgtatttgctcaggttttctatttaccattcattccttggctttgcttttttacctttcatgcattcttaaagaccgatcaagttgttttctgtgtctcttcatttcttttagagcttaaggcattatgcatttcatttctatcatttaatgcaaaccttcacttttcaatgaagtacttaattttagaactttttagtaaaatctaaaattaaatcatatgtctatgaaagaagactttagcatgctttcacttttctcaaaaatttactgtctttattctatcttctatgatatgatttggaatttaagttcaacttgtgtttcaatattcacataaatagatatcagtgttattattatagttaatacttaattgccaacatgtttaaatgatttcatttttcttggttacttctcattttccctttctgctttatttttcttcttgtcagggcatgctttgttaattttttcagtgagcgtctgggggtagtaagaagccattagtttgttatcatttcttgaatgatattctagttgcgtatatagcatagacttttttcttccatagtttccagtaccttgatcccaagtcacaggtatagcacattgcaagtggcaaccctgggagagattgactggggttacttttagcctaattaatgggaggagctttaggcctggactgacttctctactggcaggacaggacattgcagcgacagtagcctctacccatctgcactacctttcagtgggttgggtggcttcagccactttcaccactttgcattttaaagattccagttctgcatttatcttatttacgttttgtagtatgactatttattttttgaaataaatattgttttagaggtagaagactatgtgtatttatatcttgacacaaagttcataaatatttttaagaaaaatttttgaaaattatttgagagaggaataaacaagcaagaagtagtctggtcctataggcaaggtataacccagagaaagtactggcctttatgttatttggttagaaattcagctgagatagaatttagggagccttctattctggaaaaccactggttttgatttgttttgtttaattcctaatagattttcaaaatacttctcacatagagaggacaacaggtggatacatataaatagaaaagtagaatgatgtgtagaaataatagagtgagacatacgctcctgtgtagcatttaattacttagcttgtacatcatgtaaatgatcttgactctacttgactatgtgctttctttaataacttggtattttaagtcttatcatattttgcctaacatttctacttagcttctttaatttgttgattttttttgtggagaaatagctgatgtccatgactatacctaggaagcaactaggtgtgtgggcaataggatgataaagaaggcactattacttcagatagcattacttgaactgtagttctgtgaggacaaataaatatatccatttaatggcgtttgaactgacaaatcagatttaaaactgtcaacatatcaaagggaagaaactaactaggacaccacttgaaattacttccagtttacactaacattgctgccaaggctgaggaaattaaacgtaggcaaaacaaacaaacaaacaaacaaaaaaattctccccaaaccccccaaattccactgagaaaaacctataaatgattcataaagataacattttttaaggcatagtggagtttgtgtgaaagaggaatctctaatctccaagtgccagaaatgaaatgagaaaattagatctgtaagtatgtgaggtgatacttcagcaatatgcctggataaatcaagacttataatggttgggggcttgcatttttaaaccacacagggccatgagaatgtttccctcctaagaagcggaaatggcaattttttaacctcttttttaaccttgcatctttatacaagaccaggacactcagagtgctttctccgtaatgaaagaaggatgaatataaaacttgacacagcttaggtaaatgagtaatcttatttctgtctgaaccgtgggtgaaaacaaaaacaagcaacaagtctgttgtaataaattgaagtctcattctgctcatctgttcattaagtggattttatagactgaatttatattgcctacattgtaatgtagtcccgcatcaagaaaataacattaaatttggtccttggtcagtgatacctcattctataatacctttcccatccagttttaagctcaaaactttttccattcccgtaagatcaattattaaagttacaaagaacaggcaaatgctaagaaatggagctcagagagctaaaatgttggctttgtaaattggaatcctttttcttctgacatgttttttgtcttttacagagaaatacagtaatgactaaaacatttgtgccaagcttgaggctgaaattgtcaacttctgattatcctttaaatatctaatcaccatgaaaagcactcaaaaggtctcctgtaggtaatgtgtaagatcagtcagaagttaaaaattggaggagagacattccatggtagtaggtgaatcaggtttattaattaggcacactacaaacttaccttttatatctttcttgatgttcctttcctacccaaacgtcttctctccaaatatcttaaaaatattatctctgaaaaattccctactcaaccctggctcacatcctggcactgtctgacattttgacatgtttgctattctgatcccctttattccatatccagtaattgcctcaattactccatatggttgggtcagggtctggaagctttagggctctgtagcttagaagacatcacaaatcaaagcaaatgatacagaccagttctcattgaagatctcttttaaacatgcttttcctttaacacactgtaaaacaaagaatagaattcattggatactcatattcatttatattataaatggcatcattactacactttgaaaacaataatttacatacctgtaacttaatttgaatttgaatttcagagcaatttgggatccagagcccccttgatagatagcgtcaaatactttgaatcttttttaaccttttaaatttttccagttaggcattttataaccggagttgcttctaatgtccaaatcacccttgtgggaagcctgtaaatagtgatataagaggcattgaagccttataactcaggaaattgtaattatgaaagaggttctcaatcctggaagaaattgaactaaatatattaatttcccacatcctaacattttgagaattcttatgtcttcgaaactaattttgccttctatcttgttattgttactccacaaattgtgtcttgaatattgatttattctgtttttagctgtatgcaatcggaatttactgggctatgtcagttggactttgtcttgaaatattttaagtttcagcaaaagaaataaacacaggccgggcacggtggctcatgcctgtaatcccagcactttggaaggccaaggcggatggatcacgaggttaggagattgagaccatcctggctaacacgatgaaaccctgtctctactaaaaatacaaaaaattagctggatgtggtggcaggcgcctgtagtcccagctactcgggaggctgaggcaggagaatggcatgaacccgggaggcggagcttgcggtgagctgagatcacgccactgcactccagtctgggcgacagagtgagactctgtctcaaaaaaaaaaaaaaaaaaaaaaaagggaaagaaacataaaacaaaaaacatttgcctccatatgattatgtagagttgaataaatggaactttggtacagaagctgtccatctgggtcaggaaaaggagagctgagctgatagtttgtggtagctgaatcacagatatcccagtgacagaacaagacatgagtcccttttattacagaaactacccaaaggaacaacatggtcctaaacatcaactcttaatctatgaaatgggatccaatacttctctttcttgttccttaggatagcttaacaaaaatcagaatacacagtattgataatgcaagcatttttccaactatttctgcaaaatagcaggcttagtaaatatttccaaaaatattgtttatgctcaagtaagtttagccagtgctaactttagctaaaaatgtcctcaatgcaggacttctgaccaccttttctggtaacgtgccttgttatttttctagaaaagaatagaatatgcagtgtgtcctgaatacatgtgattggggcccttttattttaaaccatctgctaacatctctgtaaactggtgttgtgagatcaagacatggcagagctatactatattctcatggaggatcttagccaacagcaaaatgtatgttctacttagtgcggatttatttgcctcaatcacaaactgccaagaacacagccttgaaccagatattaagtgagagtccccaaatttaaggaagtggtaatctaaagtgatattagctttgattattattgcttttgttgaattcaaattctggtgttgccactgacttgatatgtcatttatcatacctaagcctcggtttcctcatctgtaacatgggaataataatagcaataaacctttgaggcacagacctgttctatgtattttttcttttactccagtgcttagtatagttgatactcagaatttttgtttgatgaaagaagttctgaatgcatgcatgcagggatcagtgaaaattggaagaaataacagaatgaaatattatgcaaggccgactgtcccttgaagacctaaagggaagtgctaaacaataaaaagattaatgtgcattgggtttagtcaatgaaaacctctcagaggaggtatcgtgaacctgaacatgtttttatgccataacctttcataaatattatattctactactggttgtaaagattaagaatcttggtattactaaaaggatctggagtttccacatgtacagattaaaagacaatatatttgccctcttctgtccagagtttgtcctgctattgtttcttaagtgccaatacattaatacaatatagcagggctcacacagcagagttagccagtaaactcagtagtaatgtgttagttctacctgggcagtcttcattctgtagtcccataaagaatgagatgctagatttacatcctatcaaagtaaattatgtagacattctcattatttaaaatgattagcatatttgtctatatggaagtttacattttttacaagatataattgtgagcaacaggatattacataagtgagtcagctgtagattagtagagatgtttttcagcttttgaaagtactttggaagagtttggaaataatatatacatttttcatatagtacttcagtactgtccttaatacgctggtggtgtatggaacttagaaaatcaatacattattgattattacttcaaaggatacttgtaggagatttgtgatttgaaagtcagattaattttgcatatggaattaataggactatggaggaataaaaaggaatttctaagatattatatgtgatcaatatttcaacattaaaaatattggcatttgattgtaataggtttttatctgtactttctggctgtcatattagtaccaaagtttaatttgaaaatgaatgtttggtgaagtagaagccttaggttagtgacttaggaatttcatttccaggataaaccagtcttggtaatactccatgtctgtttctctacatggttgattctcttgttaatgctatccatctttgttacctctcagattcattttgaagcatatgaatattatttaggaagtatgaaatataggcaaatgcaaggtgattgtgttatttttgctatttacaacattttctgtattgaaatccaaaacaataataactacctgcaggaaaatatgcttacattaaaattacatgtgaaatttttagtttgtttgttttagtgaaaagactacagttaaggtagataaaaatatataatttttttcataaattaggaatatgcatctcatttatcagaaggtacagctcttcatatttcagaaatgtgtattagttttgtagcatgtcacatataataggaatctatatataatatataatatattcacatatatatgtatttgcatctgatagaaaaataataggaagagggaagctaccttaaaaagtttatgtaataagaggtaagtactatttaaagaatatgtaacagttaaaaatacagcctaagttcaaatatttcaagaagaaacaaaagtgtatttcttcataaatcaaagatataataataagtgctcccatttaattaattttaatggtactgaacaaaagcagaagagttaggttaagaaatcattctatgggccaatggccatttcattgtcataaaaatcctttatttagccttctccacaaataagctcacagcacgacaaaggacactagttagagtaatttgggcgataagtaaacagaaggaatggctaggagcatagtgtcatctggcagagagcttatttcctgaatcctgtggatctggttaaaacccaacagagatgccaatatgcttctcctcagtaaatgctaccagtccccacaccaccaggcccaccgaagcttgtctacagtattttatccaagcagtcctttgggtaactgcacagtgcctgcagtgacctgagtcagtcatgcaaggagactttcttgttctcacaccaatgttttatttcagtttccattttctgctggtcctgttgttcaatgatataagcagagtgatgaaggaggcgcttcacactcttcttagataagatcttgagcagcagagagtggtttaaacagcaaggcttaaatctctcaagctggatttatttccaagtttgctgtcatgtgtgcacctgggattcatgtctcttcagaagggtgggaagaagtgaggtctgttgattccgaagagggaacaattgaagctcgacgagcagttgctggtaagcaatagataatggtaatcccacttcattttgtcccagttgtacctaaatctatatttaacactccctctgtatctattttccagtcaaaatatttctattctctgtgtgtcaggtgcacagtgttcttaattgaataaagtttccagttaccaactttatctttaatctgttactctgaaatgagattgtagggtttataatatagctctaaagattttaagatgattaattatgtttatgattgattcctgtgtaatagccacatcaagggagatttgaagattagaaaatcaatgttctgtgaaaataattaaaaaaaaatagcaggctacctaattgtgcatgggtttttttttctgtaaatgtgttccatgctttactatctcatacaaagaatgagaaatacatgacaaattgcagtaatcattagtggaatgtcaatgcaaaaataggaagtttgtgtcacttttttaaaataatggttcctgggttcttgcgaaagtaccaaaaccttttcacaaatgcaggccttgacctaaactacaatagcacaaggtcaaatggaatatatgaagcaagctcaaaattgcatttgatgttaggttttatgtattctctcccaagggaaatcagttttctggtctttgatatagctgtggaatcacaactaagtatgaggctgtgaaatatataacccagaagaaggatatatatagctcaagatggaagagttgtagaaatattttaaatgagtaaatattgttaacataaattttggaatttaaaaaatgaaaatagaaggattttttctacttttacctagacagtggctccagtgaataacacttactactatgcatgaaagctcatagtatgtggtacccagaaataagtaaggatattttagaataaggtcaacattaatctcttctaatattgattctctgctttgattctgtaattttgaaatccatgaataccattttgattaataaaccctgtttagtttattaaattgcatttctaacagaaaatacttaataaaccaaacagggtttggtaacaaattgcatttctaacagaaaatacttaataaatccaaacagggtttggtaaaaaattgcttttctaacagaaaatacttgataaaccctgtttggatttattaagtattttctgttagaaatgcaatttgttactatttgataaattttcttatatcaaggcactttggggaactcacggtaattatactaaattaatataaattcatgagatggaatgagggacaaatattagattaatgacattcaaaatgactttataatttgaagtaagcccatactggataataaacaagagaaaagaaataggaatagagaaataaatatttttttaaatctcaaaactcaagcacaacaatagacacatgcagtgtattaaaatgttttatttcagttgacttgagcctacataggcttatatgattcatgcattctttttttttttgggagatggaatcttgctctgtcacccaggctggcgtgcaatggtgcgatcttggctcgttgcaacctctgtctcctgggttcaagcgattctcctgcctcagcctcccaagtagctgggattacaggcacccaccaccacacgcagctaattttttgtatttttagtagagatggggtttcaccatgttggccaggctgtttcaaactcctgacctccggtgatccacccgcctcggcctcccaaagtgttggtattataggcgtgagccactgctcccagcctgattcatgcattcttaaattctagtcaaagaacattatatggtagcgatttcaaccagacaaaatgagtatattggttgttgaaagttttgactccctttctattggttctcttctgtatacttgctggaccagcagatctatctctagaccatgccatctgtatgtcttcttaatgaccatatcataatggaagcaacttaagttcagcaagtataagacttcagccccaatagctgctccggaaaatcttcaccacctcaaaacatgggaaataaaagtatatcattataggccccccgctgcacctccaacaagtcacgagtactttcacaaaaactgacataactttgaagtaattcaacaaaataattgcagtaactcctaactactatggtgtagtgaaaagctcatacatggctttcaaaacagacaaaaccaagttcaaatcccaactctgctacttataaatcatggacttcgggcaatttaattaggttttctaaaccccatctctaatatgggataagtgttgttgatttttccatatgcctatgagaaataaattaactaaataaaattaatagacagtataatatttggcacttaataagcattcaattgatgtttatttcccttttgcttttcccaacaataacttggtcaggttttgactacagccagctttaagcataggcggaagtttgggaaaagaaaaaaaagcaaacagattctgagtgagaccgtaaatatgttcttttaagagagaaaaattgttcaaattagtcatttcatttaaggctgatattttgcagttgtttttggtaatgagatgatccatggctcagttttaattttttttctcatgagataattatttttgacaagtacatgtaatttaagtaaacacagcaccatttgttttaaataaatgaaagatgttcctaattttctctctatcctcatttggccatttcattttctaaaacaaagtagaagcagtccaccttgatttttcagcaaataatccctagatgattagagaagtgtatcattattcattgctgtttctgggatctgaatgttgtactacaataaaaatgtaattgagatagtaacataatttcaaatcaactaattttgttgttactgttgctgttgttctgtaacacaaaatatgggtggatgaagtaaaatgtaggtgacccaatgagaggataattattctgtgtctcagtgagaaaaaaaaaatctattgtattatgaattatgcatctacagtcctcaaaaatatgcatctttaaaaatatcagaaatacgagccaccttctcctgtccccagctctctggcaaaacctgtttgaggttgtccttttgccctctggagatgagccaccgttagcactaggctggccgtaccagaaaagcctgaagaagcacttttgcctgtgttcccaacaatcaattgtgtatactcttggtttatgctttctggtgccagttgtcattgagctgagtaagattcctcagttagggaaactgcagaggaaatgatctgttacacagggcttggcaggaccattgccagtgattgataatgggaccaaatcatttcaggtgagttttctgtggtctgacaggcatctgctcaaccttgtcatcttaatccatgggtatcccagtgagtgtcagtgggaacaagatgagctcctgaacatttgcctgagtcttttcttctgtgttagctttaaggaccacaacgtttcatctctctggcttcaggaaggtagcagcttctgtgcattgttttaggaaatggttaattgaggagctaaaagagctttagtgtatgctacactgggagccactttagtacagcacagagcactatagattaatgctgtaatcaatgagaatctgttcactgcagagatctgttttgatgacagcagcacttatggccttgtttagtgtcactgttgtataatgttggacactgcaggcttttttggctttgatttagaatgcaaggaccacagggaattttatttaaaatgttgtattttggtggattttttaattgtgttgtgcatttgctgccattgctagctgaaatttaatgatttgatgccagtggcatttagttaaccactccgatgctgctgttatgtttgctgggtttctgcagtttctactacttcatacattgcactcaggaacaggtaaactaaattatattaatctatggataaatgtaaagttaatgtaatttattgtttaattatccaaaagagtaagatactaaaatgtttcatttagattctatcagtagagaataaggatgttttgctttatataaatatgtaattttaggatgcaataatgattacttgtattacataaagttatttttatgatttaaatgtttatctgaagtacacattaaattatatacattttagtattacatttaagtcttaacttgagatatatagataatatacaattaattcagaaagatacatttttcttctctgatggatcaaagagtttgctttccctatttagtgactttcactaaaattagaaaatgtcagagcttaatcttcttgaaaatacaaagatttaagtatatatagattgttcttttcaagtgtttagaaaaaatgctgaccaggtttggtttctcctaattgacagtcctgattatagaacacattcgtggaaatgcctgtgttttcggtgatgttaagctgtggactaaaggggaaactgttcagatgaggggaacagagagcccaagacacaaagaaggaaagagaagtgtaatcttttgcatcagagatttgggtgtgtgaccttgggttaaaagagtaactagtgactaaccccttctggcccttgtttcccttctgccagtttggaaaaagactctcctgttattctctgtaggaatggcaaaacattttttcagatgctcaagatcatctattgatgattttcatgtagaaaaaagacacaattattaaatgttcaaaggtatgcagttttcctaatacaagaggtaaatacagcggtttttttgctttttttttttttaattggcttcattgtaactattttgccaaataggcattgagtaagtttgaggtgtcccaagggcacctactattaagactgcactccttgggagaggaaagaggcatcacagttgtgctgcagcctgatgaggacctggacgcagagaggcactggggctctctgaaagtcggccagggacaagggctgtcctcactgctcacttgctccccctcaggttcagtgtgtattgctgagggcagctgaagagagctcctgccttcttttctcagcaaatgtttttcaagaggtctactttgtgctgaaggcaagctcaaaatccaaagggtcagaggcaaatggaaaagtagccaccttccactggcaaaaatatgaatcagattgctgcctaccaaatactagttaatgtttgtgagtctagcctaattaaatatattttttagtgaggatggaaggattttattgtaaattgaacaatgtgcttacagagtggctaataattgccagtttataatgatcatgaatcttctgttgatgtttatacttgctgtttcttcttaatagtagacacccaccattatgagaggaaggctgaggcaatgatggttcatgttcccagatatatgtacatgagagacgaaagaaaaagagaaacaatgtgattgatttctctgtctagttctgaggaaccagtctgaattatagtctctacacatatatttatgagggcaataactttattagtaaagtgattatgaattccatagaagtttgtctgctcaagtctcttccaacttcctgattttatggggtgctgctgtttattagtgcatagttaggaagatcttcaaggagaatagatattttcattttgaagtattacctgtgaatgttcctggcaaggagggttctgttagagaaatgaagaagtcatttggaaaacaaaaacaaaaattaatctcaatgaacagcaaatatatattctcccctatccttccccaggtcatctgtaaacacttttaataagtaaaacaaatgcttgccattctcaattttctaaggctagggagattgggaagaagcatgtcaatttatcaaagaagatacattaatgaaggaatttgtaattatttgatactatgataattgtcaagaaaacttttaaatacttatcatcatgcctgtaagttgtaggctaatgaaatggtttcagatattatataacctgcttcacgtaggccaatcttttgtctttaagaagggaatcatcataattatattatgagtgggtcaattacttgcagaagtgtaaccaaaaatcttgattgcgtagttaatttaaataagttttagagaaggttttacgtgacttctatgagtcttgaatatctgggaaataaattcttatgatgaactgtaaacattgaacaaatttcaaaactgacttcagaaaagggggtatattgatataatgactggtgagttttaacaaatgtatttcaatactataatatctgtcttatattttaggcttataaatagctttgagggtttttttttgtttgtttttgttacaagaggctgttagccctgcaatgtttgtggtttttctctctagagaatgcttagcccttgaaacttgttcttctgagtaggttcaaattgcaacaacttttttatccacttaattttttttttacttttatttcaggattatgttctgtaatcacttatttagattatataaagtttgttattatattttctatattttcctatttagcatatatctgaaattgtctaaggtattcatcagagaagagatgttagtacatttgtgtgtgatatttctcttgcctattctatattaaaggcttttgaaaaatataattcattggagtgttgctaggtcatgaaagtgctttttgaggtgagttcccttgctctctatatgtactcacaaagctcattttctctgagtatggttttttgatttcctaagtgcctggcttaaatagtgatcttcatgaaagcatactgctgaggctgaggacctgcaagagaggataattctgggagctaaaggtaaagcaacaagtccatatcataataccctactcagggtcactcattcctttagtccctttaaccatttgttcttaacttggagagagatcagaggcctttgagaaataaaggaagcaatggactcttgagggaaaaaatacttttgcacacaaaattttacttgcaatttaaaagagtgtgtggatcccctaaatgtaattatggaccatgtaaaaggacttgcataactcaggtttataatcctttccttaaaagtcacaacaaagaagtacttgacattcagtggtagaaaaagtcctgcctacacaaaggtacaccacttctcatctatggttagtggataaactcaagaccagcttcaaattgctcttgctaaaaaaacaaaacaacaacaataaaaaaccttagttactagttggtgttttcattggctctgccattttatatcataaacaaatacacccaaagcttaaatctccaaaagataaatatgtgatgattagacagatcattggcataagcaaaaacattaggaatgactgcaaattcattgagcttgtttctgtttagaatggcttgacagagactaggtttctcttgacaataggcttctttgacaaatacgttgtgatttcttgatttcagaggctagttttgttttaggcagacatttagttatagagatctctatgtaaggtttgttattatgagattttactgtaatcagagctattcaattaagacataaaagtgatggaaaaattaagcacagaataaggggctctaaaacatctatttaatctgaaagaccctttgagtattggtaagaaacatgtggtttgtaacaagaatagtctttctgaagtttttgcttgaagctgtcccctttgagtttgctatatagagtctttaaacgtaatatctttattctccacagatttcctggatggtttaacaaagctaaattgcaatggatacagtttgcatacttgtgaactaagtacacatccatatgtgcgatctaaaatgtgatacagtgataattatgtcagagattatggtaggcccaaagatctggggtgagtgtgtgtgtgtgtgtgtgtgtgtgtgtgtgattttttttttctcattaaaactattagtacatcactttgagaaacaaatagaaccatagaacttcttggtaataatggaaattataaaggccaataagatgtttttcagtgtttttagtccctttcaactgtaaataatgcaaaatggctagcctagggtagtaatgagtttctcatttgaaaactaagccattagaatacagttgcaacaattatcacaaattatttacaaatatatttcaaacgtgaataataaacattttatttataagctaaatgctacttatggtcttgccagttaaaaagaaactgaggttgagtttaggaggtgctattgactggctcttttattttgaaatggagatcagactttagttttatttatagtatacctgtatataacataatgccttgttttataaaagataaaattaagctatgatattttttcttaatactgagattattataattactataatttggtatttctcatggattctatatttctccagctcaatcctgctgtgatcaataagatattttagctagcatttgggttggtttttacggaaattaggtgaaatagaatgattttatattgttaagattggtgatattattaggtcagtcttcaatgtgcacatttttattgacagaactgagttaaacatatttactgtctttgtgagtgatgtcaccttatgtctcaattgggaacgttttgttatggatttataaaaaattataaaatatgaaaaattgactttttaacattactgaaataatattcaatttaattttttataaatgtaatctttcaaatggtaattttaattttcagatttagtgttattgaatagtttatcagtgctaatggtttgcaattttatttttttgacctaatgtctcttaatttcacaatttaattcagttacataattctctaaaaagatagttttgttcacttggtttgctctttcttaaaagacattgatttaagaatctttaaaagacaattcagctactctgtgtggggagtattatgcaaagagcacttgatcttttccatttttttgtactgcattcaaaaaatatcaggaaatagaatatgcaaagggataagagttattatttacagtgcatttaatctttaaattaaattcatgattaatctgaagcaatatttaataaacagttgctgtatgtttctgctttttgttgcgttgataaataatgacttaattgtaaaaacttagcttctgatctcttcttatttacagctgagtttttcgatgtgccagatatttgccaaccagcttattgttatgattattgctatttgtttacattgttttaattaaagtttatctcatcagaattataatttaccaacctttgtttttaattaggagggctataaagggatttcatccttgtttttataaaaatttacatgctgtaatatttttagttgttgcctaatggatattgttttaacatcaatgttttgccctttaatccagttgttttcatatataactgttcatgcactccttaacacaattatgttcatagagctacacacagtatcacagtgttgagggcacatagactcttagctgatttgtttgtttttgtgtatttgtttgtttaggtttccctgcccactttcttgttaataattattgctgtcaatgtgcttgtttgaacaaaccattttcccatttacagtgtgcatctttaatggttttgtggggttgaataccaaagaaactcttgtattattgtggctataaagttatgagcgaggtgctggtgtgtttttctaggaataaagtctaggagctcagattttgttctattgctttttgccagatgagaagaccttttcacttacttcccatcctttggcaagactctcaaataaattaagataacttgctatttactgtaaagtaatacctgcacatcagttccattttgttgttttctgttgaatcaaagttattttgagtttgaaggagggaaaactgcattttaatgaaaatagagttacaataaatatactaaattatattgtgtacatatcatttagtaagattttaattgctatgttaatatcattttaaagcctattttaatatcaaaagtgatttacagtagctgcgaaaatgtaaaaatgtagccaagtgaaataaatttaaaatacatagaaaagatcagtaaggggaaataagggtaaaaattaggctgcatatttaatcacaaatatcccaacacaaaaaagtgtaattcattacaaatgcacaacatctttaatacaaaataagccagttgcaggccaggtgcggtggctcacacctgtaatcccagcactttgggaggctgaggtgggtggatcacgaggtcaggaaatcgagaccatcctggctaacacggtgaaactctgtctatactaaaaatacaaaaaaattagccaggcgtggtggtgggcacctgtagtcccagttactcgggaggctgaggcaggtgaatggcgtaaacctgggaggtggagtttgcagtgagccgagatcgcgccactgcactccagcctgggtgacagagcgagactccgtctcaaaaaaaaaaaaaaaaaagccagttgcgtaagtgcacactaattattcctgataccaacaccaaaagaaagtttcttttctgttatttcatagaggagattatcagcaggagcagaagcagcatgatccatatgagaatcatcgtcaccatgatccatatagtaaacaacctgatatagtaatgataaaggacagtacaatgaaaggaactgtaggtgcagtgaggggagagggactgtctagaaatatagtgtgttccaggtgcatggttgtttgatggtgggaattaattcgtagttttgttttagaaaatataaattgatttaccacatagccctcacaaagacttctgtatatattgttgctttgtgttaaacatttcaaaaatttgtagggcagtatcttcaaggataaactctctaaagtgtacttgcaggtagttccatgcagctagttattgtgaagtcatatatttaaacagccagtaaatctgggaattggattctcttgcatctgtgacaaagccaagaaaccagtgttgaacaattttagtctaggtcagtgaggcttacttattttttaaagtaacagttccaacatgaagatatttttaaataattatattggaaatatagatttaaaacggtttattcagtcaaatatttaggacccctggaagataattcctttcttgagtcaataagttagtctttgaccgacattaacgtagtttgctttttaatgaaacatgtatatacaatctatatggatttgttgatattgcttctttatcctcatttttttgtggtttatcttatttcagttatttacttctgtcacatggagttggagtacagttgaaagaacatgactttataaagcttgaccagtttttcattgagtcagagatttagaccagtgactgcaatgttttgcaacctgatttcctatagctgtagttttggagttttattaatatggctatctagaagttttctcaacaacaatgcgaaggcataaaataaaatgttctccaaacttctgtgtctggtgattttccactgccagtcaaagaatttccaacttaaaaataaagtcctttaatgtatctataaattatttgtttgcatagccaaaataaaaacaaagacaaacaaaccaaaaaataagtagaataaaacagaaaagaaaggcaaaaacaaactattcatagtcacttgagggatctctggtgtcaaaacttgtttatattacccactatttgctacagtataaacttttctacttttttgtagattaatagtatattttaaaataagaagtatcagtcccacataattacttctgttttgttctacatatccttaaaattcatctttattatcattttactattttcatttatatcactaaaagcatgtatccatctttacattttttatttccttgtctttgggatatagaggcaggtaaaaattgatttgacattcagaatattatttcaacttaatgctgttttgctagtattgcctgggtctggataaggactaatattttcctttatcaaagatatttatatgtagagtttgttcttgtaatgtctttgctgtgaacttgcccagcacaacaatttcttaaacctatggttaacatccagtccccaaacaatgaaaacaaataaaccccaattttttccacagggtttcctggctggttattccgagactttgcacttgacaacctgttctcccacgtgaatggaatactcagtgtcaatgtggaagcctggtcagttggaaagttgcagtaaaatatttccttctgctgtacagcacttcccaaattcttatttatgaagagtcattgtgttgaaacaaaacaagtatccctaagattgtcaattttgtgatttgttatccaggttatcttactattctatatttagatcctgggagggaaatttctcagttattaggcctcaggtcatatttacacatgaaatttattcttctccaaactgttttgtgtggaaagcattttggccattatcaatgaccttgaagacttttcttcagatacattttcattgtcatttaatacagataatacagtatggtctagatttcttgaagaccatgaccacattcttattttataatcctaaggcactaagttgtgtgcgcatgcatgtgtgtgtatgtgtttgtgtgtttgttgttcaagttttccggaattttaatttataaaatttatctaaggcattatagcaccaggccaatgtagaggtaagaaagatggcattgaacatcatggtgttttgggaatgtttctggaccccaaagcttcatgtgatctcaaaatctaaatttatataaatgtacataacttttaaaactaggaagaattaatctgatgactgatgtttactgtctccaatttcttttaatttctcaatatcgattacccttttcaaagcaaacccacaatgttttctgttttctcaaagccccattatctacggtatttcatgtttaaaattacaatagttattttcttactaccatcaatcctgctattgtttagataatttttaaaggaatataaactaaaaaaatgaattaccggaagttaggaagcttacaacctattagaaaataaatattaaaatatattttacatctaatgtctactaaataatttttaaggtataatacaagctgtcttcaaggaaacattgttagggatatcttgaacaatctggccaattaataatttttacaaacaacaggacttcagcatttttctaagcccatttcaaagcatgttttgcaaagattacagatattacatctattttggttacaatcactaattaactgtaagtctgatctctaacaccacgatttcatattcttcatctcaattgtgtaatgagacattaagctctatttctaaactcctttacaattcacaatactgacatatctcagttaatcctcatgaagtgtttgtgaggaaaggcactattcttattttgtaaaagaggacaaggttaatagagatgaggagatattatcaagagaatgcacctaatatggcagatttaggattagtcacaagtctccaactcggagtacaaagttctttttactgcataatcgctgattttataagtgttatatgaatatgattataaatattagcatataatgttgatggagaaattaaaacataatgaagttttgttgattactcaagatttcaaataagtaaactgctgggtagaaaaatatatttttcttagtttgtacgtgctattagaattgacagaaatgcttataattatataaaaatgcaaaatgtttttagtatacatttttatactctgacaatgtggatttctgtggtgctctatagttataatgcagtttcgtgcacattatctcattctaccctcagaagaaagaggggttctatgagagttagttaccttctgagtcgaatgactgagctcatgattcagccagaaattttgattctgagttccatataactgctttgtagagttgtgtcatggtggtgtttgcatcccaaaactttgctctcaaattcaacaaactatacacacaaccagaaaaagtactgcctctaccaaatatgttaataaagtttccctttcctggaccagctactgagtttccttgcctgtgtcctaaaattataaaacataaggatggcaccacagggcttcaaacaaatatttaatcactctctggggtagttcaactccggaggtttcattgagtacgaatattttctgaatacaaatatctttgtcacaccaataacttaataaataataattgatgcatttacatgaatcaacttaataatacttcagtttacctgaattatcaaagttacatatcagagagaaagacacaggggatgttcttggttttaggatggaagcagagtgcaattatgaacaaaggggaacttttaaaagggaaatatttttctttttttaaaaaccacttcactgaggtatatttgacatagaaaaaactgtgcatatttattgtatacaacttaatgagtttggagagaaatatacactcataaaactagcaccacattctgtgccataaacatatccgtcacctccaaaacttccaccctgtttattattatcttttttgtaataagaacacttaacgttaagatttaccttcttagcaaatttttaagtatgacacacagtattgttaactctagacacaattctatacagtaaatctctagggtttattcatcttgtattactgaaactttgtaccttttgacttatacctccccgtttcccctgttccccatctgctagcaaccaccactctattctctgtttccatgaatttgactattttagattcctcatataatactacttatactcctcattatgttcctcatataatattttccttcttatctggcttatttcacttagcacaatgttctgaagtttcatccatgttgtcaaaaatggcaggatttccttctttttcaaggcttagtaatactgtgttgtatgtttataccacgttttctttattcatttgtcagtgaacattgtttcaacctcttggctatagtgaatagtgctgcagtgaacatgggaatgcagatatatctttgagattctgatctcaattcctttggataagaagtggtattgctagaccatatggtagttctatttttaattctttgaggaaagtttatactgttttccatagtgactgtactgattacattcccatcagccatgtagaaaggttccaaaatttctccacattctcatcaacactgacttctttttaaatttttataataggccatcctaacaggtatgaggtgctttctcattgtggttttgatttgtatttctttgattgttatttatgttgagtatctttggtggtaaacatagctgccatccaaactgaaatttctaacatgcatttagaaaacaatagcgctaacaaactcctaatggctagagataatatgcaactctcccaaggatttataccttttttttttggtcctggaaccaaaaccagaaatttgattttaagttacttaaaattgttaaagaagttcttgctgaagcccagtggtctgaagaggcctctagccctgctttgggccttgagctcaagggacaaaaatctgtattacctaattttatgcagtgtttgccttcagatatgtttagggagtgaatattggcctgaatttagaataaaattaacagaaagtatttgaggaccagtattttcactatactaggcactttgacaataattcaatcatgaatgacagtaattcagttgtgaaagataatttatgtaaattttgcaacagtacacatagatttatttataaaatacactttaatattttatagattgtatgattaatgattaaatttaacaagtatgtcttcgcattttattgtaatgcctagataataagccctattaaataatatttatttcttatccctgacctgtagttaggtgaaattagactttctaggactttgctgtatagcaaattattgcttatttatcccaaagttagctcctctattatgtataatttagggtaagtggaagcacacttttccattgcaggcatggaaacatcttaaatagacttctaaaatatgaagaaacatttcaaaatatattttcagtatattaatccagagttaagagtttatcttagttcttagacttcagattttaactcttgtgtatgagactgtttcccaaatgaatatccctgtaaaatattaaaatgtttatatttttaatatcacagtgtaactaaaacagtatttaactcacgtatgctgaccatggtatgtgtccacgtgtcaatatcttaccttgtctcaacttaaaaacctattcttagaactcagttggctttttgtgtatgcagtgcataaaaacattcaataaacatattttgtacaatgcttcattcagttccaactcacatcctgctatagaggactcaaaaaagtaaaagaggaaaatattttaagaggttcaggaaatacctgggaaggataattgtgatttttggtctgtgaagtttacatttttttgaatgaaaatctattctattaatatctagaaagaacaatctctttttgaaggtgaccacatgtatgtatttgaaattgctattcattgctgtgttgctgtgagccaatcttagaattggtttgaattccatcttttactattattcattataatgatgttaaaaatatgctgcatattacttctagagatagtcaagaagttcaaattttctaatacttcaaggctttgggacagataagctttcctttactacctgcacattaggtacacattccacttggtcaagtagagctgtcatgtaaattgctaaatagatatttaatatatgaaattagaggaatggtttttttatatttttaacatacacatgctcaatcgtgcctgtatattattttgaagggatttttgtttaattggcattgatcgatcttattgaaatccattgcgctttaacactagacatcatgatacacaattctaaattatagagatagagttacatgtttatgccttgttacatactctaatcataatgacctgggtttaggaaacactggttctctttagagaaaatgtatgtgtaatttagctgacttttatttctgcactgatagttgggtgtttattaagtttaataacctactttttcacaagggatagtataaaaattttaaaatcgctcacaaaatataatgctcaaaattataacacttcattgaacttggctagttatgaacttgagacatttccatagacacaagcagctgacgtatttcctgattctaaattaatggtaatagtgaattagttcctaggacgttttattgactgtgaggaccaaggtgcttttgtattgactccataagcaaataccatgaatttatcattttgcagctatgccacctggcagccaatatctttaatcaactattagaaaagtgatcaaggaaaatgttttgtgttaatgaaatattagactctgaatattttaggagcatgttttgttgagtgttgcttattccgttaataatagtgaaatcttagttataaagacaaattaagagtgcttcaaagttcagtaatatctttcaaacagtaattagagggatagaagaaacaaaggtagtttacaactaagtatttagattttagattttattttttgtaagtctttaagcaaaagtgttatattttaatgggtaatgatgaaattagtgataagaaaactattagccattcagaatatgaaggaagtataattgtatactaaaatatatacaaatattgtatgctaaaataatgaatgtgttttttacatttacatttgttagcaatatttagtagatagctacaaaactgtgtatggccaaagttggaaaaaataaaatttgtttaagctgcaatatctgtagcatccattttattacgggatactgtatgagtcctggctcctcactggaatcatctgacagactatgtgtaatatttatccagtaccaaagcaattaaattagattcttcattcagcatcattattctgcaaagcttatatatcatagaatagcactgcttgatagcactgttttcataataaagtgtgttgagtatcaccattgaatcttacccagaaacatcagcttttggtcctttgcctataagaacagttttttgcagatcgaatattcacgaatatatgtatctcatatggtggttcaactccatgttttactcatatttgatttataatattaatagatttacttaggataatatgagcgaaacaaggggttgaaccgccatatgagaaattggggcatgaaccagagaagaatcctgaggagtagttttcaagacctaagtcaggttattgagggatacaataaacttttgttttcttgaagtgtttaaagtagaaagaatttttgtcatttttttaaacttcaaagactttttaaggtagcttttgaattaatgatcaatttttctttttgggggaaatataattttctttctcttcaaatatctcagtgtttctattaattttcacagaatttcaaaatgaatcagcattcaggaagtcattaggcatttttactaagtatatgaaattataggatagagttttacaaattgcaataattaccttttgaattataacatttgtgttagtagtaatttcaattttattaatatagtttttctttcagaacaagctgtcataatactaaagagagagctactttaagaatagtcgtgaacttttacaaatagtaaatatgaaagagaagaaaagttcttttctgacttcctaatattccattaactgaggtggcccagtaggagtatagagatttatcttttttggcatcaaaccatgtatacatttttaaagtatgtgatttggagagagatatggaatctatgtgaagtaaattttaacagaatatagttttttctaatgaaatttctaatattaacccctgcatagaatatactactgtaatctacatgaacatttgaaaaatgtttattgtagtacctgtataaataacgtttaaggaaaagggaagcagttcctaaaaaattgaagtgtatggattgaagtgtatggaattgaagtgcctgaatattttaaatattattaaaaattatttcatgtagcattttgtttatagtgcctgtatctgcagtgcctgtcatgtacatacaattctttacctatgatctttacaggcatcaaccaagcatattttcccaacagttgatagctcattattaactagcatgctttactcactttatgtttttctctttcaagatctatgcagagaaaaattttattgagttaatctgatgttgaaaatttaaaagggaattattcccctgctttccctaatatctcttctcatgtaggttacccaatttttctccggcctttcatcctatacaaatactgaaagcactgatactttccattgaagttttttcagtttttctcagatgccttctttagcattatattgttaagccaaaagatcaaaaataaaggttcataaacacatatttacaaagttagaacttttgagtactctgtcatttgtagccagtcttttggaaaaagttatttttcatatttatttactcatcactgtgtcccaaaaaatgtatgttatgttttttagttgatgagagaagataaagatcagataataattttgaaagatattatttagttcagaaagtataaagagagacactatattttagtacttacctcatgtcaatgaataaaattttagccagcatcactagatagcaggttgtggctgggtatggactgtcctttaaggctaggaggggcagattaaccctgttttttttttttctgtacatttatatgtttccagactgatttatgagagaaaaaggtagtcattcattgtatgaagtgcatttgtagcatacgttcattccagtgattcaagtcacaacctttgcaacacaggtgtgcatcattctgcgatgtacacgctcaagcttatgatattaaaactctttatagatcgaagaagtaaagcttaaagtgatacactcttctctttaataccattacacttttcattctttttgtattgcacaggtgatttggattattactggttggatcctgccacgtggcacagccgggagacatcacctattagttcggtaagttttctggaaagtgtgtttggagtttagggaatatgtgtgctcgttaattgtcctttgtctgatatgtgatatctgctctattattcatttggtaagggcaaatattgatttcatttaagatagtacaattttgaagaaaaaaagttattactggataattataacaaattttaaattaagtaaaaaacaattattaaataattactataagtaagattgagatgtttggttatggatattgacattaacaagtcaacatacagaatcagtttttttatgtaagcagatatatttttaaattttaattaattccattttagaactatttaaaaatgtatacttatttgccaaccactttaagaaacttttagtataaatttctgctacaaatgaaatatagttctaaatgaaaatttttataagccaaggatggagtccactgaaataatttcctctagagtgtcttttaactgaagaaattgcatcatgctgcaaccaataacttgtgtctataggaaagaaagcaagttgtttatttttaaaaaatttaataggcctttttcgagcagttttaagtttacagaaaaattgaggagaaagtacagaattcccatacacttccttactccacccctttccacctgtttaccttgttattaacatcttgcattagtgtggtccatttgttacaactgatgagccaatattgatgtattattattattgactaaagtccatagtgtacattagggtacattcttcatgttatacattctgtggtttttaacacatttataatgtcatgcgtccaccattacagtatcacacagaatagtttcactgatctaaaaatccctggcaccacttattcatccctctctcctttcttccccactaagtccctgacagccactgatcatttagtttctatagtttttccttttccagaatgtcacatggttagaatcatacagtttatagcttgttcagatttgcttctttcacttagcaatatgcatttaaggttcttccctgtctttttgtggtttgataatgcttttatgtttgtttttatcactgaataatatttttgtctggatatgcccagtttgttcatcaattccttaggattttaaaatatttttaggttgatattataaatgaaaatatttttcaataatgatttctaagttactctgccagttgttcctattctcttttattttattttttaattgacacaataattgtacatatttatgcagtgcatagtgatgtgtcagtacctataatgtatagtgatcacatcagggtaattagcatatccatcatctcaaacatttatcatttctttgtattgggaacattcaatgtcctccttctagcttttggaaactatatattattaactatagtcatcctataatgctatagaacaccagaacttattcctcctgtatagctgtaattgtatattctttaacaaatctctccctaccctttccttctccctaccttcccagcctctattatcctctattttactttgtactactacaacatcaacgtttttttagcttccacatgtgagtgagaacatgcagtgtttaactttcatgcgggaactaacatgttcctggcttatttcacttaacataatgttctgcagttctatccatgttacctctaatgacaagacttcattctttttatagctgaatgcattacattctgtatatattactttttaaactcattcatgttttaacagcatcctgtaacgtggcaaccatctaaagagggggaccgattaattggacgtgttattcttaacaagagaacaaccatgcccaaagactcaggtgcattgctgggtctgaaagtaagtatgctggtttaaaatgtttcttaaagggtgaattacagtatggtctgcattcatcggagtttctggcaatgatttttaaatgtcatttaaatattttatataattttattgatatagcatatagatatgttaggaaaattgaataaaatttagggaaactaatgtattctgactataaagttcaggatgattttttgcattaaaaagatttaaatggaaagtagcataggtaatgtggacttttgttgtaacttaagcagcaacataaacatcattaaagggatcactttctaattacaatagttttgtaagaattttttaaaaattaatgtacttaatagtgctgtcttattgattattaccattaattactcctgctatgaaataattctgattacctccactaatgggtatgccactaagaattgtggatgaatctcaacttttggtgatattctcttcattttaaattatatatatttgagcccctgcattggaagaacttaaacatagattttaaaatattctataataaaactcagactttgatagtcttatgggcatagatacatgtttcagatgagatggtcagctgcagagatgcatttaggctattaagctttgcacaatggtaaattgcttcccaaaggtgtcattttcttgctttgaatctacagtctttatagtcatagacctacattttactacacatatacaaaagagattaagatctgatcaagaactgatcttgacaatgggatattatcttcatgtagaaataataattcaactggtacacatgaatttggatgataaagaaaaatgaattttaatgtaaacagtgtcaaacacttgctgtttgatactaagtagggaagacctggcacctgtcttctatgtatatgcattatttatggtgcccttttattgttaggtcactttaagacagggctatttaatcttttagcttccctgagcaacattggaagaagaaaaattgtcttgggtcacacttaaagtacatcaacactaacaatagctgatgagctaaaaaaaaaaaaaaaaaagcaatgttttaaggaagttaacaaatttctattgggccacattcaaagtcatcctgggccacttgtggcccactgacagcgggttggacaagcttgcttttaagaaatcactacagcctgggtgcagtggctcatgcctttaatctcaacactttggaaggcaaaggtgagagggtcacttgagcccaggagttaggaaccagcctggtcaacatagcgagaccccttctctacaaaattaaaattaaaaaattatctgactgtagtgtctgcacatgcctgtagtcccagctatttgggagcctgaggtgggagcaacacttgagcctgggagttcacggctgcagccatctatgatcacatcaacacactcctctgtgggtgacagagtgaggccttgtctcaaaaatagaaagagagagagagagaaaaaaaaaaggaaggaaggaagggagggagggaggaagggaaagaaagaaaagagaaagaaagaaatcagtacacaaacttccttaggacacatagtcatctcaaatatgagatgttttgttttcaaaactgtgctcccagctactttaatcaaaaatgtaggtgaagccctggtggctcacacctgtaatctcaacactttgggaggccgaggcaggaggactgcttgagcccgggagttcaagatcagtctgggcaacatggcaagaccttgtctctacaaataattttaaaaattagctgggcgtggtggtgtatgcctgtggtctaggctacttggtaggccaaagttaaaggatcacttgagcctgggaggtcgaggctgcagtgagctgtgatcatgccactgcattccatcctgggtgacagagcaagatcccatctcaaaaaaaaaaaaaaagtgcttcacttcattaatgtttctacatgcaatttcaagtgtatcataaaagaatgtaggattaattcctcaaactaataagcttatgttttagtatgagtcttggaaacttataaatttgtaattatccaggttgttggaggaaaaatgactgacttaggacgacttggtgctttcatcaccaaagtaaagaagggtagcctagcagatgtagttggacacctaagagcaggtaaagtttctttttttaatatttaaacagtgtgttctccatgcatgaacatgaattggtggttttcaatttggggttagttttatatatacatacatacatacatgtatgtatgtatatatcaattaagtcactaaattttaatgcacgaataaagacttatttcctgatataaatatttaccaattgcaataataagtaactctacatcagcagcaatctggagagtaagggtaggaatcttctttttataaaaataaatagatgtaaaatatagaagaattactcatctttgtagatgatgtcataatgctacaaaacttgaaatctaaaacaatttatctttgagaaaaaaatcttatatcactatttagttatttagtttatattttaagctacagtaattaccaaatttttttcagagtggtcctaaaacacttattcaggggcagtgttttttataaagcataatcataatcacatttcttatacagattgtataataaaatattagtaaatttaaaagtgactcatgtagatgtgctaattcttggtatttagaaatttatttttgttgccctataactgaacatgacacaatgaaattatttaatatatgtaaatgtatcatatattaaatagtaacacattttaaaatccatttttggtaaattgtttgcttttcatttttgttaaaatcacattaaaatatttcttccagttgacttgactgcagagcttagtagaaatcttttggttagatggctgtttatgtatttgccagacaactataaaggaaacagagttggctgagctgtagaattaaagattaataacccataacacaaagagtacatttccaggtgatattcttaacttttaaaccttaagtttgtgattcttgaaaactttggcaaaatattctaggactcttaaagacttttcagtatatttgtttaccaggatatcagttcaaaatcattttcattttttttttaatttgacaaggacttgctgtgcaggtgtataggaagaaaactctaatcggatttttctccatttgctatacaactttgaatatgtatagagatatgttacactgttatttcttatgaaggaccagttatgattcagtaggaaaataactcaatcagggttgactctgtcagtaaactgagtgtgtgtttgtctaatgactcaaaaataagcctcagaaagtctgagaatcccttgttggctaatgtaaaataactttaactacagaaacctgagtttgcagaccacattataaacattatatacacattataaacacattattatgttttaataggaagttacttaggaagtaaaagaagaggggtgttctatataaaatatctgttagtgattcatttcatttaacacccttatgagccaagagcctgagaaacttaaatctgaaatgttaaaagctcaacttaaagaactataaaacagacaagtgtacttttcattctaagcaatttatgtattcgaagaaagtgaagtgattttgcagactcaatcatatatcctatttgatttacattataatttaggaactgactaaatatttgcatttatgcaaatagaattatttgcatataaacatccttagcctataaaactacggtgcaatcaatgtgacttttatttaacatttgcaatcttgttttaatcttgcaatatctttatccagtcctgccccgctttaagtctgtgcactctactgctacttcatttaaccttctaaaacacaaaaatgacactgacactctgtttattatgaagatccttcggtgtttcctagttatcatttgttcaagtcaaagctctgtagccttgtcctctactaacactttcagctgtccaggatgttggtccacctgtaggttcctgtcaggctgtttcccacctagaagatgtggtcaatgcctcttgtctacctagttttctaccactcctgttgaaggcctttccatccttcacaattcatctgaagttgccttaattctgaagtggttcctaatatctcacctggaacaataactaactactatgtccctggcaccacttgactctatttctggtcctcaaatgaacttctattgttgcatataaaatattttattagagttgtttctttatcatttcttcatgaccaaatttaaagacagataaaatgtcattttcatctttgtaccctcattgtctacatccctgcttgattatccatacataaataatgtaaaaaaagcattatggtttaggaattattaatctgtaaataaacgtatgtattaacttaatttgatattaaaagttatgcgtccaggttgccgcttataaaaaggagagttttaaaatgcagtgcttttgcaaactgctggttgcagctcattattgggtagtaaaatcaatttaatcgtttgcatctaccactttaaaaaattgaagtagaacataatagaatagaaaaatcagggtaagtattgtttcataaatgttttttagtgtatatatatatgtatgtactcatataatatgaatatatatacacacgcacatatatacatgttcatattatatgtgtacaggatcatgatgtcaactttgtttcttggtcaaaatattttgaaagcactcttaatatattataaatttgtaattattatatttcttttttcttttttttttttttttttttttacagtgaagtatattcattgcctatttgaaaagcttttctaggtaacagcttagggcagtctattagaattggtggccgggcacggtgactcacacctgtaatcccagcactttgggaggctgaggtgggtgcatcacctgagtttaggagttcaggagacctggccagcctggccaacatggtgaaaccccgtctctactaaaaatacaaaaattagctgggcgtggtggtgcatgcttgtaatcctagctactcaggaggctgaggcaggaggatcgcttgaacctgggaggcggaggttgcagtgagccgagattgcgccactgcactctagcctgggcaacaggagtgaaactccatctcaaaaaaaagaattggtgattaccatagtattttaccaaaccaaagcagcatcatgtactttttgcatatttactttttactcttcagtgagcaaacaattggaaaaaataattactttaaagtaatactagcaaagcaattttcctacttttatttaaaaaattctaggtatacattgaaaagattttatgcttatacttggctataaaatgtatactgatgatattgatccagtatttcaacacaaatttactttgctcataaaatgttctagacactgagaacaacaaaataagcatgagcatcaacaaattaagacacctcagtgcatcgaggttgaaatatttcagctgagactaccattttgaagtgaagagtctaaggcagagaaccgtttggtacctacaacttcttaaatatttatgaaaataaatactttttttcacgtgacctatggtgtgaaaaccctagttaaaataacaactgtaagttgttagcctgtatttttttaatgcaacatcttttaactccccttgattaatcttagaatatttaacaactatgtactgtattaatgtttggttattttaaagtgtgttctaattgtactttaatgttcacaatatagattatgtatagtacatatgtgttttgaacatctggaagtgggttgactgtcatgcaacagttttacatctgcttgctttgtaattttgccatagctacctgcgttaactgatgggtgtgaattcaaatcctttcatgcatttttattctgttgtgcatctggtgaagacactgaagcatgacttgtaattgggaaattcatgctaacaaatattaattgctctttcttccaaaaataaaacaggatttatgcacagtttaataagaatctttcaaaaatagagccgcctacatttattatatggagggcatgctgctaattattattttttaatgtttccaaataggctgtgctaattccatcccatagcatgagattatttttatatgatttctggtatatctcaaaagataaaggtagttttgtattgtactgtttccagtcaccagtaatattctgggggaaaaaaagaaaaacaaaagaaaagaaaaagtgtttagaagaaccatttagctgacattatatggcaatcaatttgcttttgaaagcagagcctagacaattaaactatttgtatatgttttgcatttctttgttaaaaaagagaaaagatacgaaaaataaacagaatatataaggtaaaaaaatacccttttttttaaattcaaggggatgaagttctagaatggaatggtaaacccctgccgggagctacaaatgaagaagtttacaacattattttagaatcaaaatcagaacctcaagttgaaattattgtttcaaggcctattgggtaaggctaaaaaaacttacttcttaagtttagtaaattacatgtattagtagggttttaaaaagaattttatacattcatacagtacatgttaacatggatagtttttgcatcaattatgggcatacatttttagattactaaaaatttcttaattttttaactggaatactgagtttacttcactacattttagaagctccacactttaacaattgtaatatcaaaaaatatcaatatgtactttttgcaagtgaaatataaagtaaaatattttcttttaatggcagatatatttaagtaattctaatttaataagtagtatttcctttaagagaggcactaacaaactcctcttcttgtgatatttaaaatattaatgatttcatatgtctacatgaactttttattattctacgaaagaataaaatattttttctgtctctttaaccatgagtaatttcaacttttatttaaaatcaagcaagaagtattaaatattttaacattttaattggtcataatgatatttttaaaacctcaattttcagtacaatttaattatctatagccagtgggatattttctatgtatgtatatagatttccccatatcgttgcctttttctggcaaacccacatggtccaaaataaatattcattttgccagtctataatttttaagggcattttgaactgttttattatacttggcttaatgtttgaatgtgttcttggaaatgattctttttttccctattctccaaaatttaatacagccattatttcaaggctttttatgttgaaaaaatgctaacctttaatttgtatcggcctcatgaatatatgtcaatgcaaaacatacaagaagatataattatcataattctcaaagaatgaaaatgtatgatcatatatcaaataatattaatatataaaactctaaaataaaggcaagcttttaaccaattttaactggttattattaagagtgaacactgaagacatttgcaaaagtgttgtacatttccatgtagatttttaaaataacaatactacaatttatgctagttttacatgacatatgttctagtgctgaggtaaatataaggctggaaaagaggtaagtaaattggaaaatgaatcaaaagtatgaaagctaaagtttagaatcaagcattgtgcacttgccaaatactttcaaatatatagtggtttaaaagtaaacagcaaaaacagaattgattcatggtgacttaaaaaagtaacagacaattaaagtagactggaataacattatttttactttttatgaaaattaattaagaagtaatcatctgcacagccaaattctaaactattatagattatagaattgaaaggaacatggaatacaaaaattataatttaaagattatagaattcaaaggacatggaatacaaagattataattgaatcagaatcaaaggtagtatcaactttctttctagtgaatacattattggaatcctagaaaaataattttagctgctttttttttttttaaagacatggtcttgttctgttacccaggctggaaagctatgttttaataataatatttaatgtagtcctgtttaacaactataattaaaggaaaaagaaaatatttattcataatgtagtggcatagtgatttcaggaatcattctaaatataacttacaagcacattgatcagtacacactaagaggcatcagccatcttgaggtattgactttttttgtgaacccaccaaatacaatatccttgacctttatgcttttaattgttattaaaactactctactacctaactggtaaatagaactaataaagaattccactggatatgtaaacatccagtggaaatttatgcctgaaaatattgctgaagcaattaacataaataaattttaactaaaagtcactttaacatattttcaacaactttgccaccattcttttttcacaggcatgtaaattccaaagtttgtacctggctttagaacttcaaattctgatttcataatggactatgaggctgattttttaagaagtcatactatctaaaaattgttcctggatttttttacaatttaattttatttgcttgcattaatttagaagaaagtagcagaatatatagttttttctgtgttttgggtattgtaaattagtcttttaattcattcaaatgattttatataaatgtatagtcatacaaaaatatataataaaatttataaaatacacagcataggccagattgtcatttttaggaagtataaattatagttggttatgagaattactttgcacaaaatagtcaaaatgacaactgcagagaacaaacagggaaaactctttttgttttcattccccccaaaagtgaaaagaaaaagtgaagtcagctcataaggtaggtggttagaaattcttaaaaaatatgcttataattttgttgggactagctaactccagtctgctttaatatgtcatgttaatatttgcatattgttaatcttaaattgatattaaaacgtctttggaaaatgagaagtaaaatagtcctatgcagtataatacctaaaccaaggtgatctagggttcttaaggtcatagtgggtaatggattaagttgagattatagtacatatatttcttcagagtaatttgtcagtgtggcaggaatgggtggtctcacaagtcactttctaaccatatggtaaatagtcatatatttagctaacttcagtatagagatatgaatctctataaagggtatatatgtgtatatatattatatattcacatatataaaataatttggcttttttgttgcaagcttgaaccatttttactttccaaagcaactcatccttttcatttaactttgcccatgatattcaccacatcattttattattgagatgttcccatccctttcacttggtaaactctttcagatgtgtttgtaaagcatattactgatgtgtaaaatttgtgtcattttgatttcctataattgaaggaaagtattacctttaacattttttatttccaaaacctgctgttttggtagtaaaaatattgtggtgattttaaccacaatattagtctgattgttgtcatgttaaagttttgctcttaaatatgtaaaaacttttttattgcagttttttttgtgtggtgtttgacattcatgcacattagtagttgccttaatagtaactcctattcatttccacacctgtaaagacccagcaggatttttcacatcacgtataatgggctatgattgcctcaggcagggtcatttaactaatgggattttcaccatatcctgtttcttttagtgacattccccggattcctgagagctcccaccctccactggagtccagtgagtataaggtttctttgttattataaaagtattgaactaattgaaagtaaagatttctaattttctttagttatttgatataatgaattggggttactatactaaagatgtctccattggtactagatgttggcaatgatggcaataactggaaatccaaagaagtcctacttcaggatttttcttcctctacttttttatgtgattaaaaaaaaaatctttactgggaatactcttcagcatcataacagtcaggacccttacagagcttaatatatcaggaatagttctagttacattaacatttattgtgatactggattattcagtttgattgctaagcagctcagtctcaagagcagcctagtgaagaaactaggtagacactttaacaaataattgtattactgaataacaaagtgtgtggattgattttggaagtgaatgggtggagtaaacttcattaaacataataggtcaagagattgtgaaaccagagggttgaaagaattatctatatgggaatttaagtcgtttctgtatgacagaagatgatattgtgtgcaataaaatatagacaattaagttttcaatgataatgcagaagtgacccaaatatttactttgcaatggatgggaattaagttaatacttgggcttgattccccaggtgttcttacagaacccaagttaaagaaatagaaaataaaaggtgatttaggggaaaaccagtgatagtgattagaagggagaagaaaatatgaaagtaggataaacaaggaaacagacactaggttatcatataaaatgcataccatcatgttctgctagaggtggacccagttttggctttgagctttctggtgaccaatacaaagagggaagtgggactaattgcataatttatattattgatatgattaaaaaatacactgattgccataatattacaaacaagcattattagaaataacagtgttcctgttctgagacttaaggaaaatgtattttaaatatacctgggaaaagacacatagtaacaattttatatagctgttttttatcactaaatgttttcggagggcacaaaaggatgacatgagaattaatttgtacttatagaaaaaaatgtgcggattgcacatactcaggcaatgcttcataaacagtatttctcaatgaagcattggctaagtttgaatggtggtgagttcaaggttgtacttgctggatcaatagccttctataaacactctgtattgctctctgtgtcagggtatacttggaacagtgaagaactccaccaagtggctgagaggagacccagcctcctccatgtgaagttgaaacaaatcactagtggtgaattacttgaagcagcattttcagaggttcaggatactcatttataagatcaaaactaagatagatggggaggccgaggtgggcggatcacctgaggtcaggagttcgagaccagcctcaacatggagaaaccccgtctctactaaaaatacaaaattagccggacgtgttggtgcatgcctgtaatcccagctactcaggaggctgaggcagaagaattgcttgaacctgcgaggtggaggttgcggtgagccaagatcatgccattgcactccagcctgggcaacaagagcgaaactctgtctcaaaaaaaaaaaaaaaaaaaacctaagatagatggtatatctgattttaaaacagtggcaaagtcttggcttagatgtggcttataaattatattatgtatgcattcattttaatttctcagtaaggacagtttataatagatgatccattagccaagataattagtgttaacaggcactatcttccttatctctgaagcagacctttacccatatgtgaagtcatgcaagagcctgtgcaataccatgcactccagaaatgtagatcaattctttccagttgaaataagcataatacttcgttatatcattcttaatattttttaaatagacaactaaagacaatctatcccattaaaagtaggttctgttatcagtgatagtaattatggttttatacaaataaaggatgcatttaacattttattaaaaatatttcctacacttacaaatattacttacttttttttctcattttaggttcaagttcctttgaatctcagaagatggaaaggccttccatttctgttatttctccaacaagtcctggagctctaaaagatgccccacaagtcttaccagggcaactttctgtatgtattttttgtacatgttggaggctgttagtatttgcatacactgtctgagtctgtctttaaatatgttcgcctttccttgaagcctgcaataaatacatagtcatttaacaccataatctacttcattagtttttcatgcattttttattattcctttattcacatatttattcagaaatacttactgagtgcttgcagtgtgccagatactctgaacattaattgatgaatggtaacataagtaaataaagagttcatattttttgtgtgctatgtaaaagtttctaaggtaaataattgtttacacataatattaggagttcataccccatttatgtaataaccttatgagcctagagcctgaagagcctaaatttggaatattctttttaacttcctaaggcatttggcaaaactcttcgttgccactgaaagctctctgaaaaagctaccattttctcactattgccttattatgtgatctggggaaacctggagtgaagaaactagggttaaggataatgaagaaccatatatttgtagattatgatggaaaatgtgatgttgatattataatttaaggacttcaaactatttgtttcaaattgttacacaaataatgaccttttgctcctctgataatgtgtggatttctgtggtttgcctttgtggttttctcttgattttaatgagacagagaagatatatgtaagcttattgctcaagggcttttatggttttaacttttatttttagtatattgaatatctttgtaataccctttgggtttatctgccggccatctttttcttcagtgtatgtgtaaatctctcatattctccacatattttgaaagaggatggaaacccattctggttctgtgaaaccccatcttaggtatcaattgggaatcagagaaatggatttacacagatccaggtttgaattcttaatctgttccttaccatgaaaagctaatcctatgttaaattagtttattttgttttaatgactctcaaatatgttctaacatatacctattaacagcatatgcttacttaaacataaaatgaaaagtaacttctaaattaaaggaaaaaaattaaagttaacattgttaaagtgtcatcaccactgccagggcagatactgtaataatgactgataaaattccaattcttgtgagtttgacaataggattttagtacgttacttccccattattctttggtctactgtcatgaaatcttggttaatagaaatatcatttggccttcttgtagtttgaagatgtcatttgtgtattgtatccttagttttttcctccttctctcatgaaaaataacctgtaatagtttaattctaaaaattaaatgacggcttggtgcagtggctcacacctttaatcccagcactttgagagactgaagagttcaagactagcctggcaacatagcaagacccccgattccacaaaaaatttaaaaaactggccagacatgatgatgtacacctgtggttccatctacctgggaggctgaactgggagaattgttggttccagcagtttgaggctgcagtgagctatgatcatgccactgcattccagcctgtgacagagtgagaccatgtctctaaaaaataaaaaaataagtgagaaaaaataccaggaaatactaaacggtgcctgtataaaataggcccacagtaaatatgttttatgatctcttctaattctttgtatttcttattcctaatatccaaactcttgttttttttaattttaactacctgtgacaccagagaaagcatttagtcacgctataataatttagacacatataatcttcaaactcttatttttaacatttaagaacaataataatgattttatgtctccctcttcccttagttttttggaaaaattattattagttttattttataaaatgatatgtgagaatatacagtaacactgaaggcctgccagttgtaggttatgtttaaagtactcaaagagaaaagtaaagttctgtgtgtttatgctttcaaattggtgtgtttttagaaatatctgtaattgcattatattgtaattcaaaatttcctcatttaaatataacttgaattttgttttatgtaaaattgtaatgcctcatgatttttacaaataattcctttcctcattgctcctaggtgaagttgtggtatgataaagtgggacaccagctgattgtaaatgttctgcaagcaacagatctacctgctagagtagatggacgtcctcgaaatccctatgtaaaaatgtattttcttccagatagaaggtagtgaataattttagaaaaaaaaaatcttaaaatctgtactaatagaaaaggtagaattttctcttttgggatgtttttaaaaaatataatagataattctgaggagataaaagtacattatctctgaaaaaagaagtccctcaagtgttggaaattgtgttggaaatatttgaaaataatctgtcaattaaaaaaatctattaccttgtttataggtatattagtctttgatagcgacacatcatttagaatgtacctttgtatgtgtccctataattacaatactgcttatattgtaactgaagttagaatattattaaactctattatctttttatagactttccatgagttattagttaaaataatataaatatcaatggcagttttacatgtaactacagtagatggcagcatgtacttgctttttcatttacaaaacatacttatttttcagtgataaaagtaaaaggaggaccaaaacagtaaagaaaatactagaaccaaaatggaatcaaacttttgtctattcacatgtacatcgtagagattttagagaacgaatgttagaaataactgtgtgggaccaaccaagagtgcaagaagaagaaagtgaatttcttggagaggtgatgtatattttaaaaactcaagtcaaatagttaataaagttttgtgatatttattatgattactattacattatgttttgataaaggtacttgatttaatttgagaattaccctctcagatcctcatagaattggagacagcgcttttagatgatgaaccgcattggtataaacttcagacacatgatgagtcttcactacctctgcctcagccatcacctttcatgccaaggcgacatattcatggagaaagctctagcaaaaagctacaaagtaggttaaggtccttttagttgccacaaagtaattatgctgtaatgatctaattagtgattaataattcaagatgttttttttaaatgttttattagagatcaaaatactggaaaattgttcatctttatgaagcaacttggcaaaactgtttctacattttcacaatgaaaataatgtagatagcatagcagagtaattgcagagctgcaagccaaaaacctctgaattaaaattcttgcacagggccaattgagctgttggttattgactgatggaataatttctgtcatcactggtgagttgccacctgtgaagtcttaataactttatagttcaaagattttttctccccccaccgagagagagtctcactctgttgcccaggctggagtgcattggcgtgatctcggctcactgcaacctgcacctcccgggtttaagcaattctcctgcctcagccactggagtagctaggattacagaagtgcgccaccatgcctggctaatttatttttgtatatttagtagagatggggtttcaccattttggccagcctgatcttgaactcctgaccttgtgatccatccggctcggcctcccaaagtgctgggattacaggtgtgagccaccatgcccagccagttcatagatattttaatagttattcataagaaatgttgtttaaaatattagaaggtatgtttattgctattcatctagtgattgggaaaagctatttttttctgtacttattgagtaatttttgtgtcataactacatttctaagttaacagctgaaagaagcctcattttggtaatctggaactaaattatttttctcacataattaaatatttcatgttgatgcttccctgatcagtaatttcctcaaagttaatgtttaatgaagtataatgactaatttggggagctaaacataaatattttataaagggccctgatgttttttcattaatataggctgaatagagctccagccaagaaatgtctctgaacctttccactcagccctattctctctgaactgcagaggaaagcacttaattgtgtagaaaacaatgtactgtatatactgtgctgaaggcttttagtataatattttaattaaagaattaatctgaaaatcttattctgtgaagtccccttgtttctatatgtctttggtgtaatgaggaaaaaaatactgataaaatgttatccttagagaacaaacatttcttttaaaattagctcagtgtttactgtattagtcttcataagttttcagtaataatgcaattcactttttaaaaaaagtttgacagtgctctttacgtttcataaaccaaccagacacagaagtatctctttgccttactgttgtgcaggatctcagcgaatcagtgatagtgacatctcagattatgaggttgatgatggtattggcgtagttcctccaggtgcgtgggtgaggagcatgaccctgcttcactgtgctgctttgcttgttttctctgtcagcttccggacctctttaggatactaaactgaagatttatagcacagagaaatcagtattatattattccatggtgacttacatttcaaattattaagaaagttttaaatggactagtctctactaattagcattcccatagtgaggttcttccgtagaaacatgtctaactagtgaaacaaatcattatttcacaatgctctgagcgtaagtgaaaatacgaattttattttgaaaagatggggttattaaataaaaattccatttttctgtgttttatatttgcatttctatgattttccttccaccatttctgaaaataatgtagccctccatggaatatactgagaaaggtgcatggcggggtttaaaattgcatgtggcatggctgtaacttttaaagcttttgtgatgtgttcccactgattatacctagaatgtgtgtatatgttttaatacaataatatgtttaagaaagattaagtattaatttgaagtgaacatctctttgtcattgtgtaagttagtaaaacttttgtgatgttgtagggtttaaatgtttctcatctgacttctgtcagaaaagtgtaaaatcaagtggtaaagacttactttcttggcactaattctatactttttaaaaatttactaatgagaggagaagtaaatatgcaaataagaagaaatgaaagagacagtcttaaaatgtataaatatgaattttaaaggcagtttttaaagacagtatatatatatatgcccttgatatatatgccctttatttacataatttctcagatggcagtgtacttaatttgagggcaatggttttgctcaaattggtagattctacgatactaacttcacagtttggagagatgcatacaactattaaaactgggagaaaattatggagagttctctaaaatcaggtttcatttgttccctataattcagagaatatatggtatttatttatttatttatttatttgagacggagtctcactctgctgctaggctggagtacagtggcacaatctcagctcactgcaccctccacctcccaggttcgagtgattctcctgcctcagcctcctgagtagctgggactacaggtgtgcaccaccatgtacagctaatttttatatttttagtagagactggatttcaccgtgttggccaggatggtcttgttctcttgacctcatgatccgcccacctcggcctcccaaagtgctgggattacaggtgtgagccaccatgcctggccaaaaatgtagtatttaatcactgtgtgaaagtagaaaatattgttaaatttattattataaatctagtgctgtgaaaatctatatacttatatattaacctttgatgtcagtgtatcagtgagagatttagatcatactggagagaaattcacttttgctctctgtttttatttcttagaaggccatagtaattacacacattctcaacagaaaggttcacacaaaatgtaacatcatattagtttgtcatgaaattcaaagagtaaagtgattataaatttaaattcatttgggatattcaaataggaattagattatacctggtagaaaaatcatcacctctaacaggaatcttaactattagtcagccttaatgttgtcattaccaatttatctaaatagaatttgcttcggtgagtggttcccaaatttcattcacctgaaatttcatatttttagttatgagacagggaagtaaatgatgaataaataaatggccaattaaataaatgcttgcacaaatgatgagtttcttcctctttctctgagagagcaacatggataacgccttgtgagaagtcaaagtgagttatggaatccactagagatgggattagtgcttgagtaccaccaaggagcactgaattctaaatatacttatattccatactgaaatataccatgtccctcaaagtgtttgcaaacatgcataatctctgttatcatacaaagcaatatttttcaaataatattgttcatttttatttagcatttaaaaatgtaatgagtcaaactttaatagaatatgactagtaacttataaaactgataagtaatattttatgtttcaaagatctcctcataaattaaaggagagcatgtaattcattaatattttcagatatactcttcattgatccattgtaattatgtggtagtatttgtatggcaaatataactagtcacatagtaacatgcaatacattttaaatgaagaggaaaaatgagtcagtaaaataagggcaagaagctaaaataaagtgaggtgataagttagcacagtgcattcttatgtacttttagatgttggttacaaatttgcgtctacgtttcctagcatccaatatgaagaaaaaatttgtttagatatggaagtcgtcttctatatatgtttaatgtactcaaggaagttcctggttgtttattatctagagaagctcaaaagctctgtacaaaatgttctactacagccaaaacttaaacttcctaatgccttggcttttctagaacacgaaattctctgtttttatttgatgtgtttactatctttttccagttagggaaatgtagcaggttttcagcagttgagactgccagagccacattttattaactttgtagttatagccttattgttatttaaagtaaataattttagctagttaagaagaataaaaataaccatatacagaatgccctcatctgaggtgaggaatctagcaacttcaaccagaaaatgagaaaaaaattctctaatctctaaccctgagtcaactaaaacactgggattaccataaaatagtttcatcccagccgggcacggtggctcacgcctgtaatcccagcactttgggaggccaaggtgggcagatcacaaagtcaggagttcgagaccagcctgcccaatgtggtgaaatttcatctctactaaaagtacaaaaattagctgggcctggtggcgcacgcctgtaatcctatctattcaggaggctgaggcaggagaatcacttcaacacgagaggcagaggttgcagtgagccaaggtcatccagcctgggtgacagagcgagactccatctgaaaaaaaaaaaaaaaaaaaaaatttaatcccagtcatggttctgaagatagagtgcatgttgtcaacaataacgtaaacataatgtgaagaaaatcaaattttttgtaaaaagcaactataaatgtaaaaagcaaagaactttttctttgtaaaatgcaaagaactataaatgtatatttatttaaggtcattcactatagagtcaaatgttaaaactttgaatattatagcatatgttatattcaaaatgactttgagtcaccaaaatagtacacattgccgtcagtatactttttgaattcagaactttctaagttacattaaaagttgttaatatgttaaaagtttcaagatttcacttgtttccttaaagtcccttcttaaaaggataaaagaggcattaatttctatataaccacaaagaatccaggaaacaattatataccttttacagcaagatgccaaaattctctaaaatttattctgtaataattaattatacaaaatctatttatataccttgaatactcacttaaatctcgaaatagggctcataagtcaatattggccttccataattattgtgtaattgataccagatagcaattaaaaatgtttaagtaattcagactatggattaattgtctttataaatagtcacccttttttttttacaatgagctatgtattaatagtgtattcactacatgttaacttagttggtctctttctagccttaatattataatttctagtcttaaaattacaatataatattacatctgaataacagactttttatacaaaactcaatagcttagttgatattttgataagaaaaaattaaagtatttcaaattataaattataccatttatgaatattaaacatgtttttatagagtgacaaaatgtttgtatttctttagtctgaatattgtcaaagtacacttaatgaaatgtttgaagtcccttaaaattcggcataagatcatggattcacaatatataaactgctagggactattagcctgcctttaatcatgatgtttcataacatatttttgagataatgtgagagttgtcaagtaaaaaatgaacaacagttttagcttcccagttaaatttaacatatttatggtttatgtatgttttatgtagttgtaaatatagtttttttttttactttggccacataatttttttattttccttatgataataaaaaacagttacccttgtgaaaaaattttaaactctaaactcttcttttggttttgagattactgtcttatcttaactaaatcgcagacaatataaacctttttacttcagggaaaaagtgactgttataatttattttaaattgcaatatgttaactatattatcttagttatgctaattaaaataattatggagtagtttcagatgtgtaaggcagatttggcgattggttcttcagaagggtgcattttctctacattattgtgatagtcatcttcagtcatatactacatttgaaaattgcagtattatttgtggtttgcaaaattcacaatgagtataatggtgaagatctgctactcttctttgttaattaaaactggaacaatatatttgttttcttattaaagaggccacctgcaatccaactaaaataatttattctctagaataaaaatcgaaatgaagaatttatttaaatttaaagagactccaaacttctaagcattgacttgtatattaactatagtttcatgtcaagcacttcatttgtgttgctaagtcacgaactcgttcattatttaaattgaaacagtatcccaactcatcgtaatgtctgaggcatcaactgtcatattcatattattatctccatggttcctttgagcaaaactgtaacctgtttcaatgcatgtatatgttacactctgtgtaggtatacttaatatttttgaagataaggctattaataccgattgcatgacatttattcttcatagatcaatggctgctttagaataattttatattcctgtgttaatgtttgcattatagaagaatactgactaaattttttctgtgtgtacttttgccagtaggctataggtctagtgctagagaaagtaaatctacaacattaactgtgccagaacagcaaagaacaactcatcaccgctcacgttcagtatctcctcatcgcggcaatgatcagggaaagccgcgttcacgtttaccaaatgtgccattacagaggtaggctttgaaatgggctcagtgtccctgacagtacatttttattataatgcagtgtaaattgctgcaaaactaactgaaatgaaaaaatagtttggtcaaattatttttttcagaattaattgtaggcaaaattttttttattctttatccaacctatgtggcagtctgttgtttaatctgaagaaatttcccagggagcagaagttgtttatgtcccaggaatagtttttgaataattgtcttgtattctctttgctagttttctttcttgttagaaaaaaatggtaacaaatcagaattgtggagagaagtggcgaagaggataaggttaagagacagaatggactttgaagagatttaggattgtctctttgaagcactttaaatgcttggaaacataaataaaacatatagtgctctacttcattttactctgatatacactcctgaaattgtaattaattatgccgataaaaattgattttgatagaagtatgaaagaaggttggagaaatgcagccacaggcaaaaactcatagaaaacaaatacccttaactcattgataagtaggttttgattatgatgcaaatacttttcagtgtttatttgcatattactctcagttccttcactttagtctgtctgcctgttttgggaagatgatacaatttgacacataagaattttgtaatcattttaggagtttagatgaaattcatccaacaagaaggtcacgttctccaaccagacaccatgatgcctcccgaagtccagttgatcatagaaccagagatgtggatagtcagtatttatcagaacaagacaggtatttgtcaaaattatgatctcaacgttatgaattttttgttctgttttaatatatacagatattgtggcatagcacattagagagtaaaagtatttatcactcaaaaatgagctgctctcaagcaacaactgttaacatattgtaatagaaatgtaactctaggaaatatttggctaatattatattgttataattatccaatttcttttacaaaatcagaatttatgcttagacagctttaaaggtacagcttgttgacttagatattgacctaaattatagaagggagtctgcataaggagttttcaaatattttatttattgtgggtcacaatatttgaggtatgaagtaatcataaaaattatgttatttatataatttaaaacattgtggatacatgccatttgaaagttaattgcagagtttctatgagaacttcaataataatgtttctgttatatacttcttttcataaaatctctttctagaaaatgtctatagaatacaattattgagatgggttcttatggggatatgtgcttagatttaattctgcatttgtgaactaatatttcacggaaataattactataagtctacattatgaatctgttgctctgcgtgcccacagactttcttcttgaagtaaccatatacctgtacaattagcctgattataagctcaggatctgatttaaggttttataatacccaccttgttgaatattctcttctggctttttaaaatggagaaactttcagtgaggagaagggtcatgatagtggtgctaaataatttttcgccatggagtcaaggacacaaagtagaacttcttaacctacctaattgccatcctactgtggaaagtagcgttgtgaccttcaagaatggagtcacaataggtactaggatgaagagctgctctgaggaataggattccagacatctcagcttgagttgaatgagggctattttatcaacattcatttgggccaccatgaatttaggtgaggagggaaaacacagggctacttgaccagggcagtcaatatagtgaaattaatttggatatagataaagtattaattgtaaaataaaaattctaatcaattatattgttagttggttaataagaaacataatatggtattgcattttcagtggctataaaagccaagaaaactatcacgctttaatttgttataaagttataaaaatgttcagaattcccattagtatcaggccaaatttatagtattaaaaaaatactcagttgtctataattggaaacagagtcctatatcttatttgaggaatatttaattttgttttgttttaatattctataaaatcattttgaaatacaatggcaaatcagcaacagctaggacttcaaccataatatttgtactttattgtttaaattttttaaatgcttttatgtttatttttgtttaacctctcaagcaaatatgctagtgcagacaatctggtttcttcccttttcatgttttcattggcataccattggcataacccatgtctcataatttatctgtttcactcaccacccatcctgtctgtgcagtgagcttcttatgctgcccagagcaaaacgaggacgaagtgcagaatgcctacatactaccaggtaaatacagggatttggtaatggtgactgtgtgtgatgactctctttccattctattattcttccgtctctcccttagtggtattattacaagcaagtcaaataaatttcccaagtatttgaaatttgttttgttttatattgaggttatggaaaaggttccaaatatatttcagttccgattcaggctgactgctttgccatctgtagattcaaaaatccagagactagtgggcctctctgggactgtttgcgttcctaaaactgaggaaccagtttctgcaattaaaattctaaatgctcactgtgagtgcccccaactttcccacacatattcctgtctagtcacaagaggtctaatctgtgtatggcagtgtcattgtttcataattgtaagtttgctctgttttagccttttttaatttccttttagaatttattgttgtttatattctgtttgcttttgataaaatctttaacagttcacttttaatggctgagcttcagcttctttcttgatgaaaagtgaagatattcaacctgatcttaactatcctagcccaccagttgtcagaaatgctgcagtacaaactttcccacaaaggcatataacagtatgaatgcctctttagaagcgacaaaagatataatttttgcttctaaattggagcttagagcctgatgctttatgttaatctcattacatctttaatttcatatccaagtaaaacttcttacagattactcatggaacatattctataaatacttaatgtatatttgaaatgaatatagaagttaaggaagtagtaagtcagtgaaacaaactaacacaaaataatcgaactcaaatattttagccaataaaaagcaagaggaaagagaaagaaagaggtattaccgcagtacttgggatgcaaagacaaatgcatgatttattatgtctgtgtgtaatatgtagttctgcccaataatgcaaacaaaattgggctaataaaaattgtttgaactttttacagtctgaagttatactactcataactactgccatgtttgcttggagtgccacaggaaaaaatcgaggaaatattagttctgcttgctgagaaaaaaatgtaaaatcatgcatattgtaaaaacctactgaaggtcaaagcatgaactatccaggtttattattacttgttcttgacaaacagtttcttaaaataatggtttatttactaattctgaaagttttctcacactcctcttgatgtgactaaagcttcaaaagaaataaaaaacatgcacacaaaacaaacacaaaaaaaatccttatattttaagctacttagtgtgtgcctggcactcagtgtgtgaatatttctaggatactcacaccagtggtctaaatataataactaaaaatatttttctttcccttattttgtacttgtaaaatattatatacttatataatattatataatagttgcatcattttatataatcttatacttaagattggtgctttgctaataattctgagctccacaagtcctatttaatagtctctgtatgttgactttgcatttcctgatttaagcaaataatcatatttgtatgtatacaatttaaaaataaatgagtattcagcgaggcagataacatcctgtggacaggtactacgacaataagatagggagtggaaggaagctgagctagccaaatgtgtcagtgcgaaacatatgtcaccagtgtcttttctccttcctgtctttcattctctaatgtgtaatgctaaaagtatggagatagagacaacatgagttcaaaaatacgtgcatgtatgtatatataatctcttctgtgtttatattcatgtatttataaaaacattaatttatatctgtataaaaatgaatgtcaaaatgtgtacatataaataaccacaactttatatggatatatcaataatatagtttggtttcatataaactatggacacttattatttctataactatccatggctaaaatctaaagctttcaaaatacatcataccatgttcacttaggacttataaaaataaaatctgaggatttactagtctctagtaaacataaggaaaataacatttatttaataacaagcacagtgttaaatatttaatgtactttgtcaatttcctgacaataattatatgttatgaatattattatcctgattttagagatgaggaaaaaagctacgaaagtttattttacgactaatagagtaaggattcaaaatcagatctatttgatatcttctgtttaactagtttttccaaaaatatgaaaacttgtcctatgagatgtttcaccaataagagtttttgtgagtcaaatacattttggaaactttgcaactgaaagtgtctaccttgaaatttaatacacacagcatattaaagtcatgttctaaagaaatctgtatgtttagtttcttttctcccaaattgtttaatttcccaacctttttttagtaaaacgtgtctcgaggaagtggtagtatagagaaaatgctatagttgccttactgtatcctactgtgtcctaaatattgtgtacatgttaccacacacccctgttaagtggaagttatttcccacattttgtggatgtagaaacaggcttggagacttaatcgaattacccaggtcacagccaataagtggcaaagccaaggcaggaacttgaacattcagactataaattttgtgctattttctagctgtttcccattctatgttgatcccattcttgaaaaaaaaatcacttttgaagcaatgcttagaaaagttttatagcaacctattactaaagatatttgcctgaggttaggagttgaaaagaagagtcgactgtctagaaaggaggctaaatccttagtttcagtaaaatttgtcctcaacttgtacttaataaggaggaagctgaagcgggcagatcacttgaggtcaggagtttgagaccagtgtggccaacatggtgaaaccccgtctctactaaaacacacacacacacacacacacacacacacacacacaaattaggtgggcatggtggcaggtgcttgtaatcccagctacttgggaggctgagagaggagatttgcttgaacccaggaggcagaggttgcagtgagccaagatcacaccattgcactccagcctagataacaagagtgagactctgtctcaaaaaagaaaagaaaagaaaatggcattttagttcattttttaattgaagttttaagggatttcctttgatttgatcattaatataaacatgattaaaccagtgaggtgtttgatgtttaggaagcctttgataaatgtttattcccttccctcttgattatgctttactgctagctgagatagatgatggattttcataattagtaattaaatttatagaacattattaaattatcaaaaaaaatatggctggacctagtttgtccttcatggcatagacagtccagaaaccctcacagattttaaaggaatcagatgccgttgggccaattttctgccaattcaaaatccatattctggtttgcatctaatgcctatcttaccctacttccaaaggaaaatttcctgtggttgggtctggatccagacagaagctgataagtagaaagagcttgctcctttgcaatcacttcttggcctttttctgtttcctttttttttgctgcagtctggtactatgaccagctttgtccctggaatgctagtcaacactttgttttgttttagaacattaaaattcttttagtcatattgtaactctaaaattatataaattagttgatttttacttttagctatgagtttactttcgtagaagtaggcataatattaaatcagagattaagtagcacatttacatattgatcaatgataattcatagagtttggttagcaggtatttttctaattcagataattaaataataattttgagtattttatgaagtcaagtgtctatgatttcatattttaataattgtagtcttcccttcaaatagttattgtggttcttttgagaaaaaaatgaccaaagatttatctatatagctttataggcctcctactttctgaatatcttaataaaattggtttcatatatatttttctgtttcctgcgtgtttgtgttgctacgttccagacatcttgttaggcactataaaacattacctcccaagatgcctttattacagagcagttctcactggaatatttacaggtaagagccctaacagtgagtcccacccagttataaagtaattcctaatcccttgcctactaaaaatagaaaattcacattctaataaaatattaaataggaaatttacattctaataaaatattcttttgaaataattatacagtgagagacattaaattaatgatatctaaaatcgttttaactataaaacttagtactagaataattctctgaatgacatctactaactcaaatgtcagaattctagttgctttgtcatttgtatattgttgtacttgttgattttaattataatttattttattttatttttgtgtaattttaatttgtggagctcaattctgcctgcacatactaagaccaaatcagtgactagacaggacatttcccttcatcatgaatgctttaactcaacagtattgagatttactgatgaaatactggttaggtaagaacatttggaagtgatatcttccgtttcccttgtttattgttgtgaaccaaaaaagttgagttgtaaaattatttctcctctgatgtccttcattttgttttggtgtggcatctgttcctggtaatgaaattttaggcattttgttttagtgctttctgtatccagtttttttcataagtaggtgtgatttagtctcatttttcagtctgagacacttttaaaaattatgcaaagcaatttaagcataatctttgtttagcttcattttctaaacaaaattttacactgtcattctgtcaactctctcacacccttatgaactgaatcccagtgattctacattttgtgtaaaggggacattattttatgctttactctctaacatggtcttcctttctttgttttctctgtctttctcttctaccactggatgcaatgcactggcactagtgaactgcagccctttcttgacagggctaggagtgctagtaccaactgcttgagaccagatactagtttgcattcaccagaacgagaaaggtataaaataaagactttcttaatttcttatcatttgtactagtgatttttttcagtcactttgttttgtttcatgacagccttacaggtttattcattcatgtatactttgctaactgtctacatttccccttcccttattatacatgtctatttagagatatgcgtatgtggataaacccaagggtacacatacacatatttctatgaatgttgttgcaaatggcgtggtgtaatttgtaactgcttctggctgctgcttttccccttttgttgctgttcagtcattttattgactattcaggaaaccttcagtatgctgataatgttataaggtccagtgaattatccgaaggggaggatcactttcctcttagtaccactgataaatagtatttataggtttaacaacaatcttctataaactcataacaggaagtatttttaaatagaatacttcctttgtatatctacattcatttttaatcaatctactctttgatataatgttttaccttaaattatactttgacaacaaaaaatgatgttattcataaatttcctgatgcctaacaaaaagaaatacatatatatgtacacagacaattttgcttaaaactttaattaataaattctgatatattcattgatgttgtgttacactatctcctagctgtaagcatctaatttttccactgtgatggaactcttttaatagacttagttataattttaatagacttagttataattgatagtcttgtttataatggctatctctttttaattagaagtcattcagaagacatttgcatactacctctttacaaatcctgaagaaaaatatttagttgtactaatgtaacccgctcctccttcttagtaggctacttaaagcttttctttaggtaactttctaatctgagtctattcatttatttatgagatatttatttctggaattgaacaataggtacacgtgtgtatataccttgttttagtgccttaagaatttacttttaaattgtgtattcttttacatttgtaaactgtgtaatagaaaaaagtgaaatttaatttctgtcttgtatccctttacttttgtaatataaattttagttgaaaggactatagagtctctaaaatcataattggaattgttttatcattctctttagtcaaatataaccccttccccaaataatttcaagagtagcaagaaaattttaaaatatgtttagttattattttcttatatgtttctggttagtagtaaaacaaggatagaaattctcaagttagtggaatcttctgaccatagcagcctgacatttttaatattacccatatcagtgccatctgatagaaacataatgcaagctgatactttaatatttcgtagtagccatactaaaaggattaagttaattttaatttttaaccctgtatattcaaaatataattttcacatgtcattattatacaaactattagatattttgcactcccttttttacagcataataagccatagatactaaagatagtttgtacttgcaccactcccactttggactaaccacattacggtgctcattggcttcatgtggtttgtggctcctgtactggacagtgcaggtctattcttatggtgagcctgtctagcatatgttcccttgtgacactgaagccacagagtttataaatctccatgttggcaaatttaatctgtcagataatacccttaaagcaggtcaaccagcaggcaaataatctagggacagttattgtacagattgttgtaaagtccaagtgggtgtatttaccttgaataaaagaagaaaaaatattgaaaacatatattcactctacatattgaataaaaaggaatttttcatttaaaaactcaatgaaacaagtcttggtattatcagtgatcctaagtttattgggatcactttattgccaagaagaacagcaattattttatgtaatgtaaaataaacaattattttatgtaatgtaaaataaaacttagataaggtttcatcaagtaattacagaagctgtagatgcttattggtttggaggatagagactacaagtaccctttgtgaacacgcctatgaagcagctttgaagcagaagataacaatatcaagagtggtgactttgttatctttggagagtgcatctaaagcccctagacagtatgcggagagtatgagaagggaggcttagagggttttcgaggctacttaatttttctaatttaccgcagggattattgtattaatgcctaatatatacatagtagataaaatgttagagcaaatgttttaaaaacttaattttatattcttaagagatgaacattatttctacaaatttgtcaactatgtatggtcaaacgattttgattaacatttacatgcctttataccaacttaactcctaacctttaacacaagttttctgttaagataaagggtgaaattgtcaaagcacactcagtactcaatataatacttttctaatgattcagaagataaaagagcagcattcttttcctgaaggaattgaaaaccatcagatacacctatcgtttctcccttgttacatagtttggcctactttaacagatgagttttgaataatgcatgtaaaaagcagtttggaaaggaaaccgttttagtttaggagcacctccatttcatgttctgttgattacacagatggaaaacatgcttatgggttaccataattcagtgaattattccaattcagttatgcttcttaaatcaatatatttgaggtttatttgtaataagaaataatttatcatttatatcttcccatttcccttgcttccctgattggcaaggagtgagttacaggcctgctattaacctttgcttttctaggttttcaaacaaattgttacttacatgttcagaagcaatgatttttagagccactagagaaaacttacttttcttggatggtttaccttcttccttggcctttcagagcaatcatatccttgatgaaggcttatgaaagggtagtttaaacttaccgcctgcattttttaccttccagtaattcctgtaatctgtagctgtactgaagttcttctgtggtttacattggctccctagttgttcagcaacatcttgcaacattttacattacccaccctgtcacttgaatctctcttccattaagtacctctacagattttcttaaacctctgttatgatgtctgctttgaaggcttgtcttactccgctgtcctataaagataggtatttccctagctccacctccagttttcttcttttgccccacccatactgtactgttccttaaattttatttctataaaaggttcccactccaatacatatgaagacaaccctccactatgattgaccagaccctgtcaggcctaaatttctaaatgatgatgtctaaatcaacttcattatccccacttcagtccctttacagcaaaatccttcctctttctaaatttttctctcattttatggttttgacatataaccagccacacaatctgcaactacttctcttcctgctccgtcacaaattcagtcacaataaattcaatcaattccttcggaacaggtccctcaccttgaatatattaatagatagcccttctccagttccagtgacactcctgctcccattaattttcttaagttctaatagtctttattaacttatatctcattttcttcctattaaaattaaaatattcttcttcctttgttgtctgattaaaaattctgctcactgttcaaaaatacaggttaaataccatatctttgtaaaacccttcttaacctcctcccctgtcctcagtcccgccaccaacacacgcacatacttccttttcttttgccagtcagaattatttactatcttttctgggcccacctaattttatatacttctattaaaatacattgtattttatttagtactgtagtatgtttgtgtcttccactatattgtgatattcttccacgatatcaccatatagtggaagaaacacacacactagccttaagggaaaggaagttcttggctaaaaatcaacagctataaattgaattgaaatagatatcataggtcttgtttcagagtataactatgtgtattaattaaaataagttaaatttagtttaaaacaatattgggggaaaaatatttaaggactaaaatgaataattagaacagacaataaaaatacatatgtgtgtaatcagttatctcattttgtttggtttttaatgttataatttctaattgagggcagggataatatcctatttctcttttccatctatagtgacaacatgatgtattttttacttggtaaatcgttcatttggggagtttaggggcttaaaaaacaccttctacttttcacttcaaagttggattgagctgtgagttagacccaggtactagaaagatgggagatttaattttcaatataagtactttgaacagaattgaaagctgtggctttgagtctgcaagatggctaataactaatcccagaatcagccagattcactgagccacacaaacttctgctacagggtcaggcctcagatctcatcactgctttacaagtttgtttgttgtgctgtttgcaggcatcataatttggaaaaaggaatccagaaagggctaagtttcctgtgcccaattctttaccatggtcacctatcatataagccactctttcttccttggggtgcaatgaggaaaggcttacttgaatgaatttccctcaaaatggaaacatgagacttaagggaaaggaggttcctacctaaaaatcaatagttatatatcaaattgaaatatgtatcatagatcttgtttcaaagtagaagtactgccgtggtggctcatgcctgtaatcccagcactttgggaggctgaggcgggcagatcactaggtcaggaatttgagaccagcctgaccaacatggtgaaaccccgtctctatgaaaaatacaaaaagtagccaggcgtggcggtgtgcacctgtggtcccagctactagggaggctgaggcaggagaatcgcttgaacccggggagcagaggttgcagtgagccaagatggtgccactgcactccagcctgggtgacagagcaagactccatctcaaggaaaaaaaaaaaaaaaaaatatatatatatatatatatatatatatatgttaattaaaataagtgaaatttagtttaaaataatagggaaaaaattttaaggactaaagttattaattgaaaacacaataaaaatatatatgtgtataatcagttatctcatttgttttggtttctaatgttgtaatacctcatatttttaatttgtgctatttatggaattaatgacttacatttttatttaatgccttttttagatagttaagcttcttagccatgttctgccaagagatatgcaccattgaaagacgtgtgtatatgcaagtacaggtattaataatacacatatacatttgttttaaagtttatcaatgcctgggggagagggaagagctgcaacataagtatcatttaattgctttctgaggcctatcaattctcaatccccttatgtcaatagcactgtctatttcttggttaaggttctcattattctttatccccaaagccaatagccttatgtcattatttacttaaacattcacaaatatttgtttattctgtgctatgcataatggatgcaattatcaaaaaacaaaaaagcctcactgtatttccttctgcagggagttcacagcctttttattcaatcctgtagcctccagagtgatctttcttcttttcttctgatcacagtgaaaggagtgggctcccaagaaatagatgttcctcaattaatgaatttagaatacctgatactaaagtatgaataatttactaagtaactaagcaatgaacttttaggtaggctggtttggaaatacaaatcaagaaaggaccggtttagttcaactttatgattaaaatctccaacgtagcctgccatattagcttgtaaaatgaaaatagaaatgaaagttgaagctatgtatatttctcaataaccagagttgggaagagagataaagattctaattttggtcattccttgtaatagggaaaaaaaccagaagtagcacctattatagaaagcatataaaatatgctagtatatttaaaacttacaaagatgtgttattaaaacttaagtgacatcttttcttaggacaaaagcttggatataaattgatcctgctctcgttgtatccactgtatgtgggaaaaagcaaacagatttattatattggtactacatatcagcatattcagaaggactctaagtgtacaaatatacgtgtattaaaccaaatattcgtttaaaattaccttttaatcgcttgcattcacaattgcttgtttctaaatgtacatctttctcctccacagctttcactgcatgtttcataattatgccatttttacttgctttttctttacttttatgtttaaataagcacaaggactggaattttgccctaggaagcaaggttattcataattctgtccagttaatattgttacttcacagaaaaatactaagtctatatttatgtttccaaataacaccaaaagttttaacacaactgagtatataccttaatgtagaaaatgctgtcgtcgtaattcttttccaattattttacaactatttcttcattttatctataaacaaaagccagtacagtgaaaagaaactttttaaaacattcagattggattgaccaatcctttaaataatttttaaaaattaaataaagttaatgcaaaatgttatttcatcaacatttatcacctttaagagtatgttccacacatttttatcttctgctcaaaatctgctattcagtattttcacttgcttcatggcttcttcaaagcctgacttgaatcatgccaagtttgtctatttaagatagattaaacaaaggcttccagagaatttcagaattgagtatctgatgacctcgcatatcctgagtgacagaagccctttgctatgtttggccagatggtctaaaatattcagtaaaccaagttatatctggcaagttttcaaaaagaaaactttctttttgaaatggtaggactagactcctttggataattataaaatcttatacctaaatgagtcctttaagactatccagttattccttctttcatacaagaaagccaatatctagagaaaaatatcctgttagaattttcatatataataaataaaaaattttaattctgacccattcagtgtcttatttcctcagttttaactagatgtttgaaatttgtgtctgtgcacagacagaatctaaaggtagcttaacaaaggaatgaaacagttttctaacttgtgtttactgttaatcgcaagaaaagtattgtaaatgctgagctaaaaagcatccatttaattgacatacttttgcaaataaaaaccagtgaaactaaaaaaaattaatgctaatttatcatttcatgtatctatgttctttgcttttatttatcagtatcgtttacttacagcttttaaagttcagtaattagccctgtggtttttgacaagaaaacttaagaattcacttgtagttttcccatgaattatttcttcatgtcacggtttcaacactgaagaacacttttatttcttctacttaactgtgctccttactttgtattaaattcacacatccccacctttgcaactctacccagtaatttcaaggcctggtatcacaaaatcattggtagcttattaaacctatttattcaaacataagccatattcctaaagatgcatctttaagaacttaaagttacattaatatttgtatatttatagattaaatatgcacatagaagcacattttggaagaaaaaaactacacttaataggcggattccaaacatcttcccgaataaattgtttctttattcacttataagattataggttttatgttcttaaagtattgtaacttatctttccaaggcttataacagtgaagattttaaattatggagcaaagaatctacactttgcctttatggggtgcttttccagtcctcttgttccatgtattcttttattttaggagttactaaatgtcctgttttttcctgtcttgttcactgggcaaacaggggtagatggtccccctccctagataggagacgacctcctagtcccaggattcaaatccagcatgcgtctccggagaatgacaggtactagtcaactcctcctcacagacaagtggcttctagaagcttataggccaccaactgaaggataaccaagagaaaagttgaatatgatgtactttattccaggagccagagccagatatgttagatgtagccaactctggtaaagcacctcagaatatttactgaaatgaggatagcatacaaatggcagagtttaaacccagtgaagtcaggatccattgaaaggatgttctgttttgaagagcatttgattgtgttttgaatttctggaaacaaatttaaatactgtttttgttgacaagtaaataaaaattctcaggtgctttagagtatattaaaatctgtcacagagcctatttgttatattggttgatggttttatctcagttgtcttgttttgctgctgtgtacacttgttaacaatgaagtttaggctttgattatattaaataatgtctgtcttattaagtaaaatacctggtttttatatattttataaatattgtattgttaaacacaatattgtccagggctaaggggtcagtccccaaggtaggtttttaaaaatagcatcagtgctttgaatccactttatgctgatatgtcagaagtgccacaacatatattttccattactttgttattcttctcagtgtgaagttgacccagttttcctattttatggtatatatatatatatatatatatatatatatatatatatatatatatatatatatatatatgctttatctttaaatgtgttttcctgactggtcacaaaggtttttgggtgtttgagatgcttctcttctggttcaagcagaaattcagccaacgcattggtaatatttattcagcagataagtagacgtggtatctcagaagcagcataattagtcatgtaaatgtacagattttttttagtgtgtgtgcgtacggcagagtaatttaagccctagttaaccgtgacacaatttattttatgtatttgtaaacaatcaagatatcctcaggattttagcttgaaagaaaaaggaaacattgtcaccaagaaaaaaattaaggttgttttacaaatactggaaaagactacaaactgatattttatgaaggtttcaggaacattttagcatcttttaatctctaagatacttgcctcaatatggtttacatttacatatttggaaattaaatataattctttctgctactgtctgatttctaggatagaaattctgggactagaaaaactagtaaccaatctaaaaagtattacaaatgtagagtcttctcaaaaaagaatataaaataattgtgtaaattcaataaaaatttatatctatattgctactcatttattcaataaaaacttattgtacccctactatgcaccctatccaaatggctaggtcacaacagtgattaagacagacaaagtcctggccatcagggaacttagaattttcttttagaaaaaatacttctgtgccaggcatggtagctcacacttgcaatcccagcactttgagatgccagggccaagtggggaggattacttgagcccaggagtttgagatcagcctgggcaccacagtgagactgcatctctgcaaacagtttcaaaattagctgggtgtggtggcacatgcctgtagtcccagctactcagaagggtgaggtgcacacacagtctgtgagcccaggaggtcaaggttgtagtgagccatggtcatactactgcattccagcctgggcaacagagtgagaacctgccccctccgatccccaagaaaagaaaaaaagaaaagataattctagaaaacctttgtatgtattccaaaacaaataaaatagtagatttcatcttctgtattgattgagtataggaaaattaaacatgatgatctttgtaatgaatataaatgtaagtttatctgggcattgattaagcaaaatggaaattcaaataatactttcagttcttacatacacgagatgttattagcttaatttagtggtatatgaattattccatttgattgtctcgatagtatatgtaactataagagtagattttgggaccagaaatgatccttttagataagattattaaaataaattattattaaatacataattttgaatacatattttgcttttttatgataacatatttatagataagtcctatgttcgaccaaaataaatacactttacatctcttgatactattatttattactatagagaatagagaattatttacaatacaattttattaaaatataagacaaatatgtacgtataaaatgagagataaattatgtccactaatgctacattcataggttatatgtcaaccacttggcaaatcgtaatgaacgttggcatttcatttctcatcagctttatttactcattcagaagtttctaccaatttctaaatgaagtaaatatggcatcagatttggatatagtgaatgttcataagaatttcagcgttaggtgacttttattgttggacactggtagccaggaaaatattctaaagttaatgacaatttatacaattcaactttggatatcttctatcagggccatagttgattattttgaaaataacattgtaatgcagaacgtaaattattccttaagagagttatccagtacattcaaataaattgaaaagcttttagttgccctcttgtttcccacagcatatatgtgtacacagacacacaatttttagagaaccatttctccataatttaacagtaagcattctcagtttttctcaagtgataccatagatttatttggaattaacatgaaggtacttttatctaagaatattttctagaggccgggcgaggtggctcacgcctgtaatcccagcactttgggaggccgaggcgggcggatcatgaggtcaggagatcgagaccatcctggctaacacagtgaaaccccgtctctgctaaaaatacaaaaaaattagctgggcgcggtggcaggcgcctgtagtcccagctattcgggaggctcaggcaggagaatggcgtgaacccgggaggcggagcttgcagtgagccgacatcgcgccactgcactccagcctaggcgacagagccagactctgtctcaaaaaaaaaaaaagaatattttctagaaattgaggaaatttaaaacattgatgaagaaaaaatacataaatttggaatcccaggggatgttttcgattttaaaattgtagtgaaaatttccttgtagttttatttctaaaaatgttgacccttaaaaaatcatcattccaataacaaagcatctctttagaaataacactattttaatacatgaaaatgctaatgaacctatatatacgtaattatatgagtgtaaattaaatgtagattgagttgtagcttgaaattaaccaaaatttgtaagtagccatttagaaaaaatatattttaatatggccctgaagcatcagagttctgagtttagtgcttacagtttaatcaatcgtctttaagaatgaaaggctagtgtaagttattattaaataaaactttaaactattttggtaaatgttttattcaagaaaatgcaatattttcattgggtacattttgaggtatattttaacatgtcactggctttacaaatcactgcagttactatcttcaatattttgattgagaatggtttttaatctatctatctatctatctatctatctatctatctatctatctatatatgatttttaagggtacaatttagtagtgcatgactcaaataccaaaaatatttggttaaataatcttatttccagaactttaaatttttcaattaagtaaagcatcccactatgtttaattcctgagttgttctgctaaagtggctctagtttcttttgcagataaccaaatttgtgtagtttcctatacctattagttggtagcagctacttgtctataagaatcctcaaccaagagtatcaagtgatttcttttgatttaaaatgaattaatcttatttctcctttgaaaatattctgggacaaacaaatcacaaactttttgcttccaggattcatggcagttgccacatattttcaaagttagtgtagaaccacttataaataaatacagtacattacttattatttctttttgttctataatatcctttattatctgtgcttttcaaaaatactctttctttgaatgaacaaagtgtatccatgaactaaaatatggtgagtctatttaatagctacagtcgtatacataaatatcaataatatacaggaaggtaaatgtatcttaattgcatgcatccatcttcactgcataggaacatctcttatttaggttgattctattcaaatttaatttttccttcccaaacttaatgagtaaatagggtgatagagatttgctttgcacattaagacagtataagccatgtaagtagtaagccaaaatatagacatattcttatgatatcagtgttagctctaattaagtgaaaacattatgtagtagacttttgttacagtatttccaaggcagaacagactatgttttcattgttataaaatagtcttaaataattatgattttattaattttgtcctttaataaaattttagtattttatcctttaataaaattttaatgccttcagaaaagctttatttaccaacgtctttagagagttaccctaactgaaattagttattgaaaaggaaaagaaaacacatagattttaacaattacctctgtttttcatcagttcattttataaatcttcacactaaattaatagaaaggaaataatcacagaaaatggaacttcaaaagaattggggtttaagtagaaacatcccattttctgatttttactctagctttgatttaataataaaataattgcttttataccttacagttgaatgtacttttatagctttaaaagaatttctttagtacattgtgaactagaaagcataaggccaaaaatcacacaactattaagttgtgaataaagggagaaaaactcaagatttctgattcttgcatgtttaaaaccaagtaaatattctttatgaataatattgtaaagataaaaaatttatgccagaacaaaaaagcatgtttaaactaaaaataagacataatgaaaacactgaaacagtgttgtcttgttcactcgtgcccagggatctctcaaataaacatctaatcattcaaaatgaacatgtggcagagtcagcagagaacttaagcacataggggtgtgatggtgttatcctcatcaacttattaaggtctatcatagcttggatgagacacttaaacttttgtggactaagtttcctcatctctaaacttaactggttatacatgggatagctgaattttaatgtcctatagactctaaaattgagtctatactgccttgttgcatcatgttaaaacatccattaggccctggataatgactgacagttcattatgtattattcagtaaaccaaaggtcatgttgtatttaagtattttatattttgctgaaggccagaaaattatgcagttttatttttaaatttatttcatttgaggcaaactagattttatagccctagttagttcttttttattgtaatttttgggctttcaaatttaatgataatactcaaaatattaccttttaaactatccattcaacaaataattattgagcaactaccatatgctaggtgttgatattacactgataatccaaacagacacaattcctgaccacagggaacttaaagtggtataaggtagaaagtaattcattttagtatgatctattttgtgattacacaattaatagtttcagtagtatggtacatgaatataggtggattgttctaacctttcctattttatatatctcaatccaatttattctaagacatggctgtgttaaaatatacaatattttggctataatttggattcaaaatagaaaataacattagaattttctattttattctctgctcctttacagaaaattattgcaattaagtgcatatcattttaacttaatttacgtattcttttaaggggttagaagaattataaagacatatcctttgtagttatctttagaagaatctttaatggaggtaaatttcattgctatttgaagagaaaaaaggggcatcctcaataagagggttaaaaatgaaaacaaaaattaaaaggttagattatgagcctttgcatgaatatttgttatccagttatagagcactggctctaagttttatatttttatagatgagtaagaaaaccctttgccttcaagaaacaaatatttaaagcaatattttcatagcaccacttgctaattccaagtaatgcaaaaaacatagtcaattctagttctgtgtaatactacaaatactacaatactgagtactactgaaatatttaaaattagcaaaacctgtgtgtgtgtgcagtggtagtggtattattgccactttttaggtaaaagaaaactgaagcacagagacattaagtaatttcaccaaaatcgcctggctagccagaacagagctgagattacacccagttcattattttagccatttatgccagagatacaacatgattactgttgttcagattatggactctcagttcacctcctggctagatgttgaatgaccatgtaagcgagaacaaagtgttctctaactctcaattttcttattcttaaaaaggataaaagagtagtacctacctctggattggaaagaagattatatgagataatgcagataaagtgaacatgctatcacagagaaagctctcagtaaatgttatatattattaatatcataatcactgttacaacaatcattgattactgtgataatctaatatatgaatccattacattttaggagatgaaaagaggaggaagagtttgaaagtttcacagaggaaatgaaatatcacttgggtctagaaattaatagaagttgccagggatcagaagaaaagcaggctatttcaaaaagatgccaatagccctttgattgtgcagaagttttattcaagggtccaccagattctacacaatttctctgccttctcctgcaaaatttttcatctgaatcatctctcttgacccctgccttcttattatttcctattatttcttcccttttcctgagatactttttctctaacaatatacatggctatctccttcactttacatctttgctaaaatgtcaccatttcaataagtcctttccaaccaccctacttaaaattgcaatatgctcctgcccctaaactcccaccttcttaccctggtttacttttgttgttgacatgtatcaccttttcccatactacataatgtacttgtttgagctactttttgttgtttattttttgtcttgtatcaacaaagtgtacatttcttgaaggtagagagaattgtgtttttttttccacagacatattccaaccacctagaacagtgcctagtatatatacatgcacaagtgtttgttggatgaatgaatgaatgagtggaaattttaatgacagtaagttttgtgggtcttcctgaatctctccactctcatctgctctacttgtgctgaagatgagaaaaggagcatttgatcttccagtcagttgccttgagcactgtggggaccaagcataaatttcccataactatttttattttgagctccaatacctcctgagcctgcagatctaattactaatcctttcttctccccttacttctcatcttcccactatgcttatgccttcttccctgtgcttcaggaacaagattccattcccaacaaccatgtctcattgatttcagccatgaaatcaatcatggaatctctgcccccctaccacccatgatcccctctcctgaccacagaagcaataaagtaaataagaaccttaatgtcagagagagagagtcatctgttagtgatatcccagcacctgatttcatggtttcatttcttccttccagaacagatacacacataaggcatgtgccagaatctctctcttccactctctttgctgtatagtatagaacagaaacagcttaggagccagataaacttagattttaatcctagctttgccactttctaactgagtagcctttccctgagcctgtttcttcacctataaaatggaaatgacacattcttaaaggattttcatggagtttaagtaagttcatatccccctcagtgcctgacatagttatccctcaatatattgagtacgctcttttccaactggtaagggaatatgatgtctcactcctctatttcttccttttttatcttaaaagtggtatgtcagattaacatgagtctgaaaacacacagctgaaaccctgaattgaaggggcaagagagtgtgaacacaatttctggcgaaagcggaagagattgggagagatgagcagtcccagaactctgtaacagcctgtgaaggcttgtaccttgatatgtgttcctagtgcctagcagaacttggtatatactagatacttaattaggatgtcacacattaataagtaaagacagatatttttctcaacattgttgggagaaagggatatcagtaaagaaaaataagcttaatttgtagataattaatattaaatacacattcctagggtttctctctttttttttgtaataagtgtgagcttcttgaccacaatattttacattacttatttcaaatatatggtactgaagacattttaggctaattagacatatgtaagctgctgtggggaagcaaactttttatagaaaaattatttctgtgggaaaaatgcatttcaagtgttcagtgcacatatgtacttttaaaaagtagaataaactggggaatatgatttgtaatgtgattaaaatgctgtgtgcttttaaaaatgctatgtaatttataaaagcatctttatgaaaaattttaaaatgattttaatactttatataaatactttcatttatataaaacatctttaactgtagcatttttcttctcttttcttcacaatttgtgggggacaaatcaaaaaaaatctttgtagcaccaagtttcaacttgtaaaagtagggggcatttcacccctttgaagcctttcagcacctaaactattaccatcatcacatttatcattattacacttcaccattgcatttgtttgctcatcagcagaggccgagttgctcagtaggggttcatattagatcattgttgtagacgtacttgtctagactaatgaaatgtcagcttctcgtgtcttctattgggcaacttgtgtcttccacttggcaccaattctggttttcattttattcattcattcattcatttatttgtttatttagttttgaaaagtactgactgacaaaatcatttaggtaatatagttgccatttttcatgtctattgtgtttatcattgtatgatgttaatgtagctttattcatcatatattttgtgtttaacatttcattccacaggcactccagaaagtctgaaagatctagcatccaaaaacagactaggaaaggcactgcctctgatgcagaaaggtaggcttggtgttgtggtgtgctgacatcttccattttaggaatatatttaggggtgctgtcactctcattttacatgatcagttcttaaacacaaattgtgatgtttaaaggcattcatgtaactaaacctacccctaaatggaaatgatctcattgaagaagtaagagaaggataatttcaaggcggttcttaaatcttagggtttaaaaaataattatgtatttctcttagtgatcattctgattactaataaggattaaatccatactcattcctatatacatattaggacattaatattttgtttctgatatcttttaaatgttaccaatgaatgtagtgcctggaatatgcaaattattgactgtcttatttatctaaataatgccatcttttaaaaaaatcacttttctacaaatatatattctaatattctactggtatattataaccaaggatatacattgagttaatgtaaaattataagggattactaaccttttgtttgcaatttgtccaattccacaaaggttttaagtatttttaggtacaacatattgacacttttttttttaacatagtgttaaaagacctaagaattgcaactaacatatattcattcacccattcatttatccaacaatgactgagagcatgtaaagggacacagatgtaaatgaatgagtatattcaagtatcatagctttcattatagaggcatgcacaggtacagtatgaacacaagaaaagttgtgcagtaaggatgaaattaggaaatgcttcataaacagatgtcccttgagctaaatccagatacataaaagtatgtgtgaagagtggagtattctgagaggggacaacgtgagaaaacactgagattggaaatactatcttgagtttggggaaatggtaccagttttgggatggagaacaggattcagtggatagaaaagaggcctgaaaataaaattggagaaattctgagaggttaaatgaatgacatcactatgccatgttaataccatgctaaagaatttcaacttctttattgatctgtgagccacagatgtgctttaaacatgggaggcagaggatcagttttgagttccaaaattatagatcactttgactgatttttggaaggtagatcaaaggatctaggggtagatgcaaggcatcagccaggctatctcaataggcctagtagagatagaatttgtacaattcagtgattcattcagttaacagatatataccaactatgtgctaagttcaagtaataaaatagcaagtagcaaaaaagaaaagctttccagaggatgttaacactgagttgagatctgaaaaatgagtaggtgtgagacatatcaagggatgtggtatgtaaaagggagatgaaatttatttctggacagtggtccatggagaaattgactatttagggaacttgattcacaatggaataaggatacaggggactcatgaaaagtgttgagtagtacaaagagttggactttgaggaaggaaattgatcaatcgatagatagatagcctttgatgaaacaatgtttgtattttcacattctttaatcccagctcagttaactgcagtttctttaccatcattgtaaataactataatttcttagataaattttcaatcttcaaccatcattttcagccccctctacacaatttcaattattttgacatgattaaaccttttccttgaagttgtattcttttaattctattcagtattctttcattcattttttaaaaatactagttgagtctggtcatggtggctcacacctgtaataccagcactttgggaggccaaggcgggcagatcatctgaggtcgggagtttgagactaacctgaccaacatggagaaaccccatctctactaaaaatacaaaagtagctgggcctggtggcacatgcctgtaatcccagctactcgggaggctgaggcaggagaattgcttgaacctaggaggtggaggttgcggtgagccgagattgcgccattgcactccagcctgggcaagaagagcaaaactccatctcaaaaaaaaaaaaaaattgctagttgagtgactactgtgtgtagttatatattaaggatacatcagtgaacaagtttttttggcaataagatactattttagaaaatgatagatgatgccagtgtcagctggaggtgcttaactccagattaatgatattgaggcatctgcctttgcaactctgaaatgtaatctgtggataaacacaaatcctccaatcagaatagcaaggatttgattgactttcattttcaaatatatgacacttatgaatcatattcatagtactcttgcctttcctttgcttatagtttaaagtagaaagctgtaaccttttagatgtgtttgattataattaaagcttttcattgatttttattagagtgtaaactacatgcctagtttctttgtgaattgttgaatagcaggttacaaaagaagaactggcctgggttttctaatttatgttagctctgaataagagctgttaagaagataccttgaatttacatctagctacacgtgaaccgaagacacagtataaatgctttggacactgactcctggcctttgagagttgataacttcccaaaaggagtcatactacacagttttgcactggtttctggcgaaatttgctgtttaatgatcataattttaaaggccttttattgccctcaacaaatgtaacctcatgacagatagccttttaagaatatattttgaaagagatgatgaccagttgtcattaggagacaagtagaactgatttatattttttgtgtcaagccacttaaagaaatgtatcatattttctttggaagcttcttgataagataaaagtctagcttttcatcttcatgtgaattcacccttgagaactgctgcccatcatttctgcattccattctagtgacttttcttcctgtagaaactacactctacattctaacttggggatgctttatttctttatttggactactatttagaattgcttacatatgcattttatggtgtgttattgcaaaagagcctgtgcaggcctgtaacggaccagcacagtaggaaccactttgaaaatttgaccttaaataccacatacatgtccattctttaacaagttgtttaaaaacaaaaacaacagaactacattgtttttaggctttggtagaagcaatttactgcaagtccatttgcagcaacaaaaatgtctgactaaagacgcaaatttttattgagaagtatgttttacttaagtgtaaatcaaaactctagtcttagatgaaggagagtaggcatggattgaacttagtggtaaatgtttagatacatacttgaagatggtaaacttagggtcaggcatacataagtttgaattaaacttttgctctgcaaacttttttttttttttttggagatggagtcttgctctgtcacccaggctggagtgtggtcacacgatgttggctcactgcagcctctgcctcctgggttcaagtgattctcctgcctcagcctcctgagtagctggattacaggtgcgtgctatacgcccggctaatttttgtatttttagtagagacggggtttcaccatgttggtcaggctgctcttgaactcctgaccttatgatccacccgcctcagcctcccatagtggcatgagccaccacgcgcggccgcaaacctcattttttaaaaatgaggagctgtaaatatacataatagagtaggtatttgttaaataccattgtccatatattttgattccacaaactctcaaacacagttctgttaagtcctgccaaataatttgatacttggacatatggtttgtgttaaaagattcatggtacatcctgagatgtgaaattaccacttttttctcatgatacacaaacaatcctatctcactagacagaaaagagagcaagcattggagctggacagacctgtgtggatcctgcctctaccacattttagctgtttatctttctccaggtcactctatgaccctcagtcataataaaataaaataaaataaataaaattaaataaaatagtagtaataacgcttcttagtgtgtgagaatacaaaaaggtacatatgtatatacttgtatgtataaacctatagatacatatatgcatgaatacatgcatgcctgcatatgcgcacaaacactttcagttcttggcatgaatagatgaccctatattgatgctcagtaaggaatagctgttactgttatgttatttatccatcctacactccctgtttcattctctaacaggttgttctaaatctctatcattcttcttacatccttacattcttagcacatcccatttcattgaaaagatcagggcacaacagcctggattctttcaactttacactctgtacctcagaatttcttgattaattgtcctttcctcttgcctaaaaacaaactatacttggttctatcatctctcctctgcaaaaccttgctcttctctctctaagctctgcatttttcctctacccagcttccccttcataattcagcattgctaccacattcctttcttcctctggcaaagtggctttctacgcttctcctttggtctgtgatctcatgcttgttacagagtggctgggggcaggaactcttttattattgagggacttttcatgtcaaagaaaaaaaacatatattgtgctaaacgattaacctcaaacattacaggctattttcagacactgcaagccttgtggctcaggagatggaacactatatgtggttgagctgtgaatattcacccaggaagccatttatttgctcctgaaattgctttttatacttttgccatttagtttgatgccacagaaagttcaccgaaattttttacatttcaagtcacatttgagtttttcttttagtgcttgtgaattgctttaaggaatggagcaagatttaagtgaaattgtaatatccgtgaaatttctcagtactaaggtgaaaactgtataattccatttgcgagccacgtttagaaagagtatcttgaacaaagattgaagtttattgtcatgataatgacttttaaagagtaatagataaaactctcatcactggaaaggacttgatcatttactctatcccatagaaattcattctatgtagttgagttaatgtgaaaagccaatttggaataaacagttttaatatatagaaccctatgagttactttttattttaatttggaaattgaggtaacagcccaggtttcagcgtttgaattatgacgtgataaagcattaatttatagctcaagaaagtaaaatacgcctttattaaagacctaagctgaacatctttttgttatcttcaacctgacattttcctgttttgttgttcttgaatgaataagatactcagaatcaaaatcattatagctataaaaatcattttacttaaaagaaaaattgccaatctgaatagaagttgaatgacactcctttatgtgcttttggtgataaatatgtattctttattctcacacatttttagtcactaagtgaattttacagtattgctttaaaaagggatgaggtatcattttattctttctgtcaaaataatacctgctaggtgttttaatcatgcattttatttaaaataaataccaaaatcaatgaaaaaggcaaaagcatgcattaaaaaaataagtacatctatataaacatcagttgtttatttttaattcattaattggctttataataattttaaacgccatagtaatatagttgtcaaaatatggacacatacattttcaggtattgttatatctgagagaacatgtttttatccatatttcagccatttatatttaatcagatgtataattaatggagcattctccaccttatattgttttaatttttgtctacttagattaacctcaaaaggcaggcttctttcgttgtttttggcatagtcttgcttattacagagtaaaattatgaacattgtaaaaatatagaggcctacagtatttcttcttgaaggcaagcacttgaagctttcctgtattcatcatcctaattacagtcactcattcaagcaacatacctttattgagctcttgctatctgtgcagctgtgttgtaagcacttgagatacagctctataaaacaaaacaaaacaaaacaaaacaaacagacaggagtctctgctgttggtggaacatacaagaggtttattacattagagcaacaccaattagtctttaaaaaccacatggcgttcacatttgcaataataacttgtcagtttgatttgaattccatttcaataattgcgtgatgggttctcttctttgaaattactgtcatgtacgagtaaccaggttttccttggacaaatgtgttggtatcaaagttaatgtgaacctgctgactgaagatcttttttggccctaatgttttagggttctcccaacatgtctttctagaaggggacacgcagccccaagagcaactgatcagccagtcattaggggaaaacatcctgctcgctcaaggtcgagtgagcactctagtatcagaacactgtgttctatgcaccaccttgtccctggagggtcggcgccaccttctccgcttctgacaaggtcgctattcagtgtccccctcagcattcatgtcctgcctccgggtgttggtgtggtgttgtaccttcctgagcacttgaagctttcactcattttgacaccataacttttaatcctttctttgtgacacttaaatctctctcacatcctctattacttgcatctatcttcactgtgctggtggtatactatagtttctgccaattagctctcattgaaaattaaatttggctgtgttatgtcctttcatctgtttgtggcatattcatatataatttttttaattatgtgaaatttttatgataaattacctggagttaaatgtgtgcttactttaaaaagcataagaggaaattttaaaaatcttttatatgtgttcagtaaagtgttaagagtgttttaaagttcttcagtttgaaaagtgtttaaatgccaacagatggaagtccgcttaatcctgggcagtagtaatatatcggcacacttctcaaacttttatttgtaattttaatgctagcaccagtgtatttcataacatatgtccaggattattttaaatatctttcaaatttgttcctatttagaaataaagtacaagtgagtggtaatttataaaagtctgcagctagaattcttatcagttataaataattctatagtcaatatcaatttaagagtagcagtttaggcaacagcctttcttgcctcatttatccatattgttaagatccagaggctgtaattagatgtatttggttcagtactgccaaaactgaataacttgcccaggtagaacaacttaatagaaagttaatgaaaagaagtgaattggattctgctcagtttaagaattcattatgtagaactgtgtgtggtgcacattgccctatctcatttaacccctttttgtaatattccatttacacatatcataaaaagtgtttgattctgctcccattggcccagtgagggggtttatgtctattttaatcgtaacagaaaggaggaaagatttttgtcagaccacattggaatttcattgtttcatgcccgctttgctttttgcctgcagaatgcaccgacagagaagtccaacacaatctcctccagcagacacatcgttcagcagtcgcaggggaagacagctcccacaagtgccagtgagaagcggcagtatagaacaaggtatccgataaagagagatcattgtccaaaaatcttggatttgagaacctcctctatttataccccttttattaaatgaatagtattttgattatatgtagtttgctgcatcctaaaaatttgattttcttacagttttatccccaacacctagtgacagtggttcatggcatgcactcagtttttgctgagtgagttttgctggatgattgaattttagatggtcatttaacagaagggatttagggctagaaacatcttattccaaagtgacaaaggaaaaaaataaaatttaaaaatctcattgcaatatggcattttatgtgttaaaagaatattttatcttttaaaagattttttaaaaattaaacacttaatcatactgaatcctttacaaattttttaatttaacttgattagcagtagcctatattttaagtttgatgatgaaaaaaatgacagaacacatgttttagtgtcttcagcagttcatattgcttaaagatttccttattttatgcatatattatttcattttctgagcaacaaagaaagagaaagagagagagaatgtatacggtctgattttagtagaaactaaattttctaaactacctgagctagatgatttagacactacgttaaaatagtattcttcatgtgacccaaagtgctatcacatatcttagtagatgacatgacttgttatcattattttttatcacatgtttttaatcaggaatttggtaagcaatttactaaaataatttctactttgggattgtaatataaatgtagtagaattacttttaagatatttattaaaaacctttatccctatgaaacaactgaaaggttaacactttgaatatttttttcagcagtgttattgttgctgatggaaaacttgcatttcattttatattgagggtacgggggtacatgtttttctcacttaattcaagtgatttactgaatgtatcacagatatgtcaaagatctcagaaggtaaatgcattgtttcaaagactgatgtggcatagattgccatgcagaatacttgattatggaaaacttagtgtagatttttaaaggtatcaacttattaatagagtaacactggtgtgataaactctgagtttatattttttaaaatacattctattgatactccatgctttagttttcagggttgctaaaatggtattcatttagtgaatcatgaaaatatgatgcattgtgaaactctgactttcttttttaaaatcgcagttaattcattggaattattcattgacatgtttaacatttttcctctcctctctgggaacattttaaaattattcataattaatctggcaataacccagatgaaattgttttaaaatttattttttaaagcaaaagttggtgtttatttaaattatctattcatgagctcctgttgcacaactgaaagaactacaaatgtgggtgtttagttacaaactcggtcttaccgatcatattttgctaaagattgatattctaaaagtcatgtgctcctaaaattctttgcatttccttcagttgcaaataaaacattttatgggttcaaaagcatataagggtactgcatataactctcctatagtgagattctgattacattatttctgtagaaataagaattccttccacaaaataagttgtattgtatgttggattttggttttttaaaaaagctcatgttctattgttaatataaatgttactgtttatgatattcatattcacagttgtctttcagagaaatcatcaatttgtaaggattgaattgaggtgggaagaagggaatgactacattggtggagttactttgatatttaatatgacaaatacactaataaacattttggttatttgagtttcctgaaatatatgatctttagagttatatacatacagcttttaagaaatgtgacaacaagcatgtattttatatatctatatatataaatgttctataaataaaagagacctggttggtgttttttatgatataaatatgtgctttaggacttttggtaaatgattataccgtctgccatcatctttttatggttctatttcaaaatgaacagtccacatgacagctttgtttgtcctaaaatatgtttaaaaaagtaaattttaatttgatttatgagttagataggatttagcatgttctatttaagattgatttcattgttgttcttaaggctgtagaattatgccattttattattttgaaattacttgttaaactttagttccatctcccatgaagattaatgctgaccacagtctattacaattggttaagcccctactgcacttgacttccttcccattttttaaaaatgtttaacaaagggtgattttctgtttagaaataatttgataagcagctgattggtaagaacaaatatttcaaatggtttagattactagatactgatacaccttcttgaggcacttataaaataattttattaatataccgtttctgggtacagttatctacattactgattttggaatgtatgccaggacaatttgactgtttcactggaagtattttttttcttataaatcaaatataccactctctatttataccataaaggcagtatctcttaaaggctaacatatcatttggaaacacatgtttaatcaatttttgaaaaggtgttttaaagttcattttaaaaattgagaatgctagcctatttgctacatagagccagattatgttgaagtagatttaggggaaaaacaaagaggtgatcacaatacagatttttgcggtagagtacttgaaacagtagccttataatttaagtaactctaatggtatgtgataattgaaagcaaagacttccacaaaatttttctggttatatttcaacacaatatcccagcatatcccttatgtagagtaaggctgaagataacttaattggttgtataaaaatggatttctgaagccaaccagtaacttttttgtgctcaactggatcttttaaagaaggatttagagatgattcacaaactaacagtaaatgatgtgttaattatgttttatatcttccattattatatcacctatctaaaactccaatgatattcctcttcagaaatacagaaacaggccattagtcctctgtaaatgatacaaaacaaagaggtggatataaagccttataaaatgtctaagaagtatagtctctacaaaacaactaattttactttggggtattttaatctaattaatttcagaagaaaaaaggattacttaaattagaattttctttcatgtggaaaatgttacagaatagtttccgtggtgcaaacaaagtgtaaaaatggaatttattttttgcttatcagataaaaaaataaatttcattttatcatatgagcctttatcacatgaactttcatttttgaaatgataaaaatttttgttatgaaaattaagtatgcttttaaatgcttttccaaaaaaaatcacaatggattcaagttaagatgttttaataaaattggtactgaaattttatacagctcttaaaaggaaagaaaaaataatacagaatatatttttcaaatgccaaacatactaatttcccaatgtttttgtttcattttaaatctttaaattgctgtattcattctttctttgattaattttagtaccatatttgggaactcatggtttttcattgcaatttatcatgtcacattatatgttatgcattttaattattcatgccattgtgttaattcacatttccatgtctaactataaatttgctgatttctttcttttgtttccatcattatgtgcatttaattcattgaagaacaagaaaaatataactcttccacaaaaggtaaatattaacataactttttaaccatttaatattgttacttttaaaaatataatatacaagagttatataactgtatttattgaaataatgagcaaaattaacaggtagctattttcctcaaatgattttgtagtgtatttgatattaattatttcatattctatgttcacatcaaagaagagaagattactttaaaattaatgttttttaaaaattttatttaaaattaatgtttttttaaaaatttatttatctatactgacaactagaaaacaattctcctaggaaaatgacattttctttgtttctgtttgtttgcatttccctgctctcatagataaaagatttaattctattcagggtaatacctggtaaaagtagaaaatctctggattttactttccagatagtggtaaccttagtgaatgttctggccctggctgcagtcatacatctgagaagctgctgcctaaatgttacttctgtttgcctcaatactgttaaaatacccattaattttatctttctgagagtcatgggagaagaaaaccattcagcatttttggtctttgcacttgaatttcaaataggttgcaggcttccccctacagtcatatgctgcccacaccattttctgttcagagttgctgttggcctgataattaactatttgaacatgagttttcagcttaatgtgataaggttaattatatttaataattatataattctgtataatttaataaaagtacattttctcaatatttgaaagtggactgattgaattaatttgttgcccatagtaacaacaaattaactcaaagctagttctgaaagtaacatcattcctattttaggaataaggacacaagttcagagagattatgacatttgcccaaactgcttgtcagtagtagactacaaacccagatctttttactttcgaccttttcctctacatgttggtgtatcctattttagtaagtacaaataccaaatatattatttctcacccttagcatatttagttatgcattatgtatctcggtattacaaagagaacagtttcaattacatatttgatctgtatttataaaaatgtatttaacaatatttatattcaggcactatacatatatatattattctggcatagtgtctgatatattaggcaatacatatattaattaaaaaattaaaaaattcagtgagatcaagatgttttggccatagattttgcatagatttctagccatcttgctgcatttttatgtcagatattgaaaacacaacattagattcagtagtacaagaatgaccaatgtactttacttaggtcagaagaatgtagttggatttgcaagataaattttagtgggctaaaagtattagattcatattagaaatgggccatgatctaattcctttatccaaaagaaagaaaaatgtaataattcttcatttagagccctttccatatatattactaggcaaaagctgtacctagctaaataaaacaaaacaaaatccataagtataacctaaagtctgcatgaaatatgcacatttagggcctctgtgcagaacatgtcagtttgtttttatacagtcagtgtgtcctggctgagaggtgtcatcacccctccaagcgttccttggaaacaggatgtagaaatgcctcacagaatagaccacatttttagaaataaccaaagaagcacatcccaaaatgcgtccaggaaggtataggtcagaaaaagaatgctgcgcctctccttagggatttaagataacacagtttagccactgaacgtggctctcaaaactttgaaagaatagaagcaaggtcaagaaatttcattaaaatcgtattttaagctcacgtaacccaaaagaaaggaaaagttcacagcatagaaatcctacttctgtgagctgaagtttgtctttgctgggatctatcttattagagaattcaggttattgtgagtacatcccggataaatgaagaccagtacacaagccaaggggttcattagggtttattttttattaactgtagatgaacttgtaggacaaccagtggttccagtttgtcagggactgagggttttcccaagatgcaagactttcagtgctgaaactgggacagttctaagcaaacgaggatggttggttaccctatagggaaccagtctattaattttacagcatatgtttttaaagtcacataaagagaagtgtaaaatactcaaagcattactaatggtagataggctatattgagcacttactatatgtcagtgactctactaaaagtgttacatatttatctcattatattttcacaacaacttgagacctaactattagtatctttattttcccgccgaaaagctaaaagttaggttaaaaacttggccccttatcagtcagtatttcattttgtaaatgatagaataggaaacgagacacagatccccctccagggaacttgttctcatccactttgctctgtagactcttcaacattcagacagcatttactgagtaactgctttgcatgcatcaccacgtaattatagtaacacatttacaactgcaaggaaggcttttttcacccctgttttattgaaatagagtgaaagaggttaagttgaatgccaaaggtaaaaaagctgctgtgaggcagaaccagattttgaatccacagcccatgttctgtgctccacaccacgttcctgtaacaatcaccactcagcactgggattttggagaagcccacttagtttctcctccctttccctattgacccaattttgcagcattcagttaaaccttctacatctggcctgctcctccaattgccatacagataacaaatcctttggcttgaaagttaacaaagctaacaaagataacacatcctttggcttgaaaagttaaccaagggactataaatgttcatagtactttgtttacattttaactccctcttttatgttgaaagctgaaagaccatatcattttagtcttcacaaactgctttataggcctattttaaattattcattctaaaagtaagccaatttttccctctctgctacatttcttggacagttttaaagagcccatgaatgtagtttgggggcatcgaaataatgatataagaagatcaaaactgaaccagaaattaaatgacttcaaggtgagaaaaatgttattgtcgtaataaatttatgatttatatgcctttagatactattttttaagtgcattaagtttttggctcttggaagcaattttgaatcataacaaaacacatcatattatctcttctacaaatatgaatttccttaatcataatagtgtgtaatttatacacatggagaatgaaaggcaattaaagtaagtaaattattatttataggaacaaagtaaatagcattttggtgctttttgcttttctgtttcactaataaaatatgtgataattattgtaactagatcatagagattgtaactagatcattaggattgtctctagtcaactatattttttttaagtaccaggtttctttaataagttctcaagtaagttaactgtgttttccttctttaaatgtcagcaagaacagtttgaatgctaagttatgcaaactatattttccatgaaacttatgagcattaactttactttagtggaattcaagtaaagaagcgaaaaacattaattttagcattttttgtacagttgtataaataaaaattaagcacatttcaatagcgtactgtggttgtgaaacactataagaacaaattatgtactctttttaaaataagtaaaccaatttttgtgtttttcagaatcagcattcttttaactgtcattaagtagcaaaggtctcagttttatttacatttttattagtagtagtagatgcatattagtccaggtgaatcattttctgttattgtgtgttaagatttcaaaaatacaagtttcttaatattcctgggcattgcttctcctgaacacttattatgaatcttaatgaatatttactcataaatatttagagctccattaggaaaagtaatttatccatctctttttttggcacaatctcataaatatattgtcattgtagccttctctttaaacttcaggatcccagagggttaagcagattgattagaaaaattcagaagtaatgcttttgaccctgttttcccatttggtgattcagatgtgtttatttatagtgtcataggcttttaaagcttcaaaggatttaacacatgttaaccaagacacaacttgcaagagagacctaattgaggaaaacaaatgtctaaccatggacaggctctttgatgtattttctctaaagttgtatatgttccccaaatattgtaaaacacaggaaaagactttcaaaaatcaaatttaaatttagcagaattgtgccaatcaagtctttcaggatagattctgtatccattagtattattggagtaatgagaaattatggctaaacattttagagatcacttggtataaataacatggcttcctcagtgattggttttgttatcccccaaagaaggcttaattacacaggttgctttttgtaaaaattgtatttgaagtgcatcttatgggagatagtgttccctctcaaaacctaaacatgcttttaaaaattgtttaactttgtataaccctaaaggacaagatatataacaaattcttttataagagcctgactttcttacttgccaatgactagtattttcagtgacactctgagaattggcagttttacattgagaaattatgtctggagttggacatcctgagcttcgttttagatagttcaatgggaataggtgtgctaaaacaggagatggtcttgtggttttggctgcagtgagacttaagtgattatatatacaaattgcctctttcacctatgccaatgttaaatttcacttatctaaacataggtactttgctttaaaagtccgtaaggcaatgtggtattttcacttatgtgttactcacttattgcattttctgtttctcatgctggtagatgtatgctttattggtagatgatgggtaaatgtttattttattggtagatgctggatagatgttcttttattgtttatattactgtagcataatccttaacatccaagagaaaaggatgttataagggaaaatgggaaactacttggaacatttttacacttacaagttgaaaggggtcattttattccaagaaagtgtgccagaactagggcatttctatgtagtcaaaatattttaaaatttaatctttatgtataatatatatgtgtgtgaagatgtagaagttggatatgcactacatcaaagtctctcactatgtttgcatgactccaaaaataaggatcaacatgaaaataaaacattgcagttggcccacagtatccatgggttccacaatggtggctttaaccaaccatggatcaaaaatgtttggggggaaaatgattggtagcatctgtactgaatatgtacacacttttttttcttgtcattattctataaacaatacagtataacagattcatgagatttttttaagttgtaagccatttaataatacgaaagggatagatttagaaaaatgcatataggcactatttacatgacattttccttgtattagctcttataagtaacctagagatgaaagtatatgagatgaggtgcttaggttatatacaaatactatgccattttatataagaaacttgagcatccgtgaattttggtacatgtggtgggtgggttcctggaatcaatcctgaacagatgttttttaaattgggaaaataacatgatagaaaatagtggtgtaaaatacaactggtgaatttttttcctcgtgatacctatagtcaattggaaaattttaaaatctggaaattaggtaataaagcaagagacaaagtcattgagattcctatttttgcaaatataagaaaagtattttaacaataccctattgaaatactatagaatcatagactacaactgctggaaggttctctgagcagtctcttctttttacagataaaaattctgtaatggagggatatatcaggaattgatcaaaggaacattgaggaactgatgaatggtgatggatctaggactgtaatctatgcctagtaattcccattcctaggttcttactattttgccacattgattccaggtatatgcagaatgcttatccatataaacaattcctatttctctaaagtctaaaaaactgtgggcagagactagtattgtatttttgaattttcaaataaaccatctttcttgatatattttaagatatagtttatacattaaatatttctgatatttaatgtatcagatctgatcttcctattcagtcttggtatagtctatactgattcaattagctaaacctttttcatcttttcttgttaatctcagctttttttttccactgcagtcaataactgaagcataggaggtgtgtcatttatattcttctgtctacctgacaacttccaaataagcggtcatttatcactgctcttcctgagagatgtactggaacaagaatgggactgcactatcatggagctctcattgtgttgctatacaacaaggaagcagagatgctagttttttcattcacaaaatatgatagcacatcatagttaactagacaggcttaaatatcctgtccaggtgttattgtgtgtcaactttgatacatatatgagctgaccttgttaaaaaataatttttacattaatatatttaataatataaaagttctacttatttctgtccttttacagtcatatttcatctaatgcttgaaaatattaggaggtttaacaatatatcaatataaattattttttgcctataaacacaaacgtctgaaatttcaaattcattttaatttcaaggtgcatagagagaaatgtgaaagatttaaggaattttgagatccaaacaaatttatttttatataaattaaatttatgaatattttaaatatattactgcaagtttaaattataagcgttctaaactatgtataactataatgtttacaatattttaaagcaaattacaaatatgtgataagtcaaagaggtttcctagaaaattactttatctctttgaaggaggttatattatagaaaattttaaatgatggattagggaagatttattaaggatttttgagggttttttaaagtcataggccttttaataatatgaaagggatagatctagaaaaatgcatataggacaaacaagattataaaatgattttagtttcttcatagatttattaaagatcattgataacactaaattaggaatccttagcaaagaatgtgaaaagagtagttattttaatatctttatttttaatactaatactttacatttgaaaattgtaataattacagtactttgtaaattatatttatttttcttatcttgcatactccagtcagattccttcttgttgagctttagaagacaagaaattatttcacagatatggttttcatttaactcttaaaaataagttccagttttatactttcttaattttaacattgaattgatttgtgacatacatagattaatattaaaaaagccatagtttggaaagaacaatgtatataaagttggaataaataaaatggatcttgttcaataaatacatttttgtaaactaataagtgctttttgaaagtaccatttttttaaaacataaggcacataattcagttggtaccttatagtgaaatatttcaacccttcaaccccatttttataaaattgtaatattacatctgaggaactaagatacatacattttgatctataatcacaaaatctataattaatgctgaaatatagtctatagtaaatatctttatctttcgactttattatacataagctaaattttcattaaaagactaaatgaaattgcatgataattacatttcttgtaaaaaatgaaagttattatttagctcttgattatgtggcatttatgaaatttttaaaaataaaaaccacagggcctcccagttttaaattttctataaagaaatagcaactggcattttaatgatttagttagtttacaatactattaacattcagaatgttcctaaaatgtgaatgtaatgctaggatttgtggggtaattggaaaatactttatttactattttagttttgctcttgggtttaaaattgttaaaataatataaaaattttaaatgacagtaatctttttttaaaggaagatatttgagctgtctgagttacagttaattttacttatactaagatactagagagacagtcacatttcaagaattcaattaacttttaatcattactactattctccatataaatcatataacttattggaatcgtgccttctggttcaaatttgtggtaattgtcttattttataaatttgtcttaatatttggcttgacacatctgcaatacagaaataatgtcattttattctagatatatagttgaaaaataaacatggtaaaatctttagcaaagttaaagaatttccacatttacactgaaggtttttcagcgattatgaaaaaacttttactgaagcacaataacttgtataaacagttatttcagaatatgcactaaggcacatgtcattgggaaataatgaaaagtactaaaaaaagtgtgtgatattatgtaattatttggctttttgctacgagtaaataatgataagctattagcattttggttttgttggaatccgagagcaagagtgaggatagcatagcaactacatctttgattgagagtcaggggagtctactcatcattttgaatcataatgttaatttggagatttttttttcctttcacagattaaataaggtcagttttaacttcattgggagtaaatatagtatagtaatgatttgagggaggtaaaatgaaatcatttagaaccatttttagattcatgttagttgtattaccagtctttttatgatttagttttacattttgcaaataaagatttaaatgcagctatagcataagctaagtaatcctattaatgtttagagaaatgaagtgttgtcctagcaaggttcagtccctagatctgtgtcagactgcttctggccagtagctattgggatataattatccgtgtctaagtaaccatctaccctgaaaattacgtggcactaaaagtgaagcttgcaaagctgtgggctaatcaatgtcaacatatttttaaataaagttaatatcattttatgagaatagttaagctaacaccatttaagtctgtttttattacaaattgagattgttttgagttgctttaagctttaattatagagcagaactaaatttgcagtccatttgacttactcagaactcaaagcaaatgattgagcgtgtacccagaagtactcacaccataggcaaaagacagagaacagatattttcacattttctatattgcatatgtcttttgtaaatataactcacatttttcaataactgtctcagtttctaattactcttacatagcattttactgtataatactccttttaactccttatatgttgccaagtaatgaatttctgaaccacattgctcaagctctccattgaactatcctgtaatggtaataatagtcaccatttattatctctgaagtcaacattattaaagcaggggtgtatcattgcttagtttgcataactaagggttgttagggatttgagattggttatctaatttgctgaatttaaacaaagtgaaacattttataatttactgataaaagtatgattaaaacacttagccacaaattccaaattttattatctcttgggctattggtctgcacttgaacacaataaaagttacagactgatttctttttttaaagtgtgtgttggcgttttataatcaaggatgataggccacatttagtcattgcaatggaaaaaaaattgtcagcaaatatctttatgaactccttgtaagagataaaatcagcagccaagtcaatcaaacatatcaacatttccattaacttgtaaaccattagtctcttggcagaagttcccactacatcagtgaccaataagcaattttccatacacacacacacgcatgctcacacacacacacacacagccctacaacttaaaaatctgaatacttgttgcagaagttgagttgtctgggaagttggcaaatgttgtataaagtaaacataagtctcatacaacataggtataagcttttgagtcgtttaccctacacatgactgtaccttagctgtttctttctccttcatttgtaaaaatgcaaaatttaaaggcaaggttttgaagtgatgttgctgatggtggattctaacttagaacaattcatactttatcaaaggctgcaattcttgccctcctctgctacttaggagattaataaaagcttaaaagtattctttacatattataaattaaagggctgaaagtcatgtattcattttcaaacttacgaatttcatttatgtggtccggatatagccataaggaatagtgagctaatcttttagtaagtcagttttaaggactgggaaatagtcatgagaagccacggacagaaattaaagatttataagaatgcctcaataaagtagatacttattaattaaaacaatttttaggtgactactgttagctgagggtgttaagtgggtgtgtgcatgcatgtaagcatgtgcatatagtgcgatgtgctaagtatgcatacttgttttctctatatatgtacatgcaacaaacagttgtttaaattgaaaacattcttacaattaaatttggtttcgcataatcatttatgaaggaaattgaaaatatttcatataaaatcaagaaatagagtatattttgttactaacatttacgttccccattctgtgtaatttgaatcatgttcatctttagattaacagttgctagtactgtatattctgcatttttgtttaatttattaatcatgtgttatttctaaattttatttaattgaagtcatttcaaaagcattgaaatcttaaaccattcagttcctgaaaggttcttcacatgttttaataggcttccattatgtgtttttgcagcaagcttagtagtggaggagcgaacaagacagatgaaaatgaaagtgcatcgatttaagcagacaacagggtctggttctagtcaagaacttgatcgcgagcaatattccaaggtaaaattagtagtatccaacaaatagtttcccttttaaaaatgtgtagtgtgtgtaccaggcaggattagaaagcaccgaattatataagagaagttatcatttgggccgggcatggtagctcacacctgtaatcccagcagtttgggaggccaaggcaggcacatcacctaaggtcagaagttcaagaccagccaacatggttaaaccccatctctactaaaaaatacaaaaattagccgggcgtgcgcctgtaatcccagctacttgggaggctgaggtaggagaatcccttgaacctgggaggcggaagttgcagtgagccgagatcgcaccactgcacaccagcctgggtgacagagcaagactccatctaaaaaaacaaaaaaagaaaaggtatcattaaatgatagtcctgcatcataatttctaccaaagccaaaaaaacaaaaaactctttcctcttgatattttcgtgtgatataacttcattgaaatattaacttggatttgatttttttctaaaaatatgtaaatatttgatattaaaatcacttaatgattgattagcattagtcaaattcacataaataagcaagatatatgaagccattttgttgcttgaacattatttaaatattccatttaagatattaaggtatatatttatagtcttaagtacaactttggattgatatttgactattgatatttgtgaatgataaaaattatgtgatttgagatttcttacagctctgtctttagtaagaaaagtaactgatttcaaacttctagaagctgaaatttacacaatttcaagtgctaataagcatttaatttttatttcaataatattttctaaggaaacaccaaggagtttataaactgctaatatctgataattttaaataaaatagcatagatttttgttcttcatgaagtaattttaaatatattatctggtttatttaaaagctttttttctttatagaatactacaaaagtagcagcagccattataggttgacctttgttgtaatttaatatcaacaaactctttgggaggtaataagctattagaaatcaaaagtaaataaaactacactaaattaatattattagcttgaaatatggacctagaaaaacctacttatttttaagcagtgtaagtggttcattatctttccagatattctgtgactaataaaaaaataaaataaaaagaggtggctacaaaatacgatttatcaccaagactaccatagagtcatgtgtgtttgatacagtctgtcactttacatgttaggttagatgcagaagggcttccaaatgagacagtgtggagggtcactgtgattcagtgatgctcaactccctaagagtcttaccaaaaaaatggtaagcaaaataacctgatgtcccgtagtattgcctatttcagctccatacaggtttatcttgtctgcaacttgttatttatggtattatcacctaatcagcctacttatctgtcttcatagatatcatcatcgtttttgttttcttactacaaatgcagtgagaattagaaggcagggtaatttggggttttgttttccctctacagttggatgcagttatttgaaagtttctttaaactggaaatgctccttttaagctggaaatttttatcagtttcttagctttatttcaaaagatgaggtcaaatagaacagcaaggagaggtagagccagtataggaaacaagaaagaggcgagtaaagaatcagggtaaaatactgaaagcctttctggatcatcctgagctgggattctgatcattaattagtcgatccaaaaaatcgacaaaatgaagtactcagaagtctaaaccaccactagtagtcatagtaaaccaaaggtaggtgtgcagactccaaattctctgactcataacttaaaaacttgaaaataactcaaaatcttctactccagctcacttatttaccaaatttatgacaactggggctcagaatgaaagaggtaattaattaaaatttgtgttaaaattagtagagcctctctgtatagtgaagaggcctataacaatggatttgggacttagggtatgactttgttctacttacatcattgaaatgaacacattactctagattgattcaaaggtctccatgtggctttcaatttacctaaaaattagattagcatattctatctttcctccctcctttgcataggcaccctttttcttttcctctctctctttgcatttgactattttaaaacctattactttcagatatagtactatggctcttactgaatagatactactatgttaaataaaattgtaataactaaatatgagatcaaagatatggtagctttaaaaacttgtaagaatataggataggaaattatataaaataaaacaaatgattagccttttcttatatgtcaagtagaagataaaatactctccacatctctaatatttatattatatactaacacatacaatagaatttttttgttttcagtagccatttttgttaattcaagccttttgcatatacttgagaaattatctttttcatttttattctacatcaagtattttataactattttataaagatctatttttatggctataattaagagccagtattggcacaaattttatattcattaaattttgaactttattctgttattgactcttttttagtatcttaatccatttgacattttggacgaagcaatgaacattagttgaaatttatgccaagccaaagttagttaactattctcaaatacttttaaccaaccactagtagaactggactttttttcagggcaaaacattgtcagacaactgtaattcctgagatgcttcttgaaacctagtatgtcttttagaagactaaatgaccctaacatccatcctgagtaaggaattaggactaactttgcttttgaaaaagcacaacaatgctgtttaggtatccttgaaatgtgtcaccattctattttttttttattggtggtatacagagtggcataccttaatgatgaagtgaaattcataattagaggtgaattcacatttaggtactcacaatttaaagaatgtttatgtttgtgtttatgtaacccaggaacagcaaccgagagtgatgtgatgggttttgtaggtagctgaagagtgtttattattacttacttctaaaaatagtagtgtttaattatttctctcacatcaatgacttatttgccctctgtaggatcggtagaaattccttctgaggaattatgttcctcaaaatatattttatgtatttccattaaaatattaaattgttacattcaaaatttaacagatcatgcctgatgaaattcagtgattaaaatgttaacatattagttaaaagtgaatataaaagtatttcactttcttcaaataatcaatgtgaataaaactgtgatatcatatcagaatgatagattattctttatctcaatataaaaaatgtattatgacataatttttgaaatccctttttgtccactttctggaataacaaaggtctgtatacaaaaaggttgaagaaaagatggcttaagtaaagccatcttttggcttatttccaactaaaaatatttttgttggaaaaatattttcatatacattcacatacctttatgctttagtgtacactgcttaatattgtcaaatatcaaataaggggagcatttgctctgggtatcagcacaatgctaacacccaaaacagggattatttcatattctgtcatgggcaaggtatcatcccaatacatttggagacaataattacatagcatctctcttttagcacagtgtttcaaaaaaccaataatacaggagttgtgtttgtaacgcagcaacagtgttaaattcaggttctactctttgaacataattgagtttttagcacatatactctgtaaattgaaaacagatctgattaaaatgaattgtgttagtcagaatcatgttattaaatataactgaatttgctggtaaaccatattgtcacattgctttcagtacattgtcttaaatcacattaattttagatcaaacatgaaatcatataaatattaatagctcagtttagatataataacatatgaatttcctttgaattctaatttggcatatgactttgagagataaatcacacaattatgaaaaatccttgggaaaactaattgtatatatatcctatatgttgggaattattttcatgcctgatatgaaattcttttatcaacacatacacatgagaggtaaagaaataaaaatcacatttagggaggccgaggtgggtggattgtctgaggtcaggagtttaagaccagcctgggtaacacggtgaaaccccgtctctactaaaatacaaaaaactagccaggtgtggcaccgtgcgcctgtagtcccagctacttgggaggctgaggcaggagaattgcttaaatctgggaggctaaggttggagtgagccaggatcgcgccactgcactccagcctgggcaacagagggagaatctgtctccaaaaacaagaacagaactcacatttaatgtttcagtcctaaactactctcatgtaagaaattattaaataaacatgagacctttctctagggtaatttttaagtgttattgtctaatcttctttttagtacctataaatccaggttgtagcatcagttaatttagtatgttttagcaagacagttcaaattcattaaaattcctctgacatggaacatcacaaaggatagatgactttttctacaggtttaataaacatttgatatttcatactttatttctcataaatctaaaattaaattgcttgctaagaaacaaacacccatatgttattttgttttacagaagaagttatagtatcttaccttccagtatctaagaaaactactcacattttaggtatctttcagttatttatagttatgtaacctatttattacaattataacatatataaaaataatatgtaatatataagctattcactgtgtggttcatcacaataagacagtgaagtagaaataagagtagcttaactgctttgacagctttgcatattttaatcttttatttgatgattcctaaaattttaggaaatgaatatcagagacaaatttaaaggcatctttgaataaaagatataatgtacaatgaaattttaataaggatccagtattctacttttgattctaagttagtaggttaaatctgaaactgtctaatgaagccatagtagaaagctaaagaccagtcactgcctctttgctcagtttatatcagcccttgtttttgaaaagttatatatttttaagaaatgttagagacactataatgtcttagaaagtatttaactaaattgactagttttagaaagtatcaaaaactatatacaggtggaagcagtctatacaggtcaagtatcccttacccaaaatgcttgggaccagaggtgtttcatattttggattttttcatattttggtatattttttctatatacattatatattttccagttgagcatcctaatctgaaaatccaaaatgttccactgagcatttcttttacacatcatgtcagtgctcaaaaagttttggattttggagcacttcagattttgaattttttgattaggaatgctcagcctatactttgactagagtagaaggtgaataaaatggacaagaatgaaaatgaaaacaaaaaagagaagcgtatgtactagaaaaaaaatgaataatacacttttgaggttctaaatatgtacaaataatttaatgacttttccaatcaggcatttaatgattgtgtttaatttatatttcagtcttcataagccatctcttaccactcaaaggataatgtttttatattggaaatcatatggtagtatttggattattttagatattacagctactcttatgaaggtacacctttatttggtgtgggctaagtagtcattcatctcaccatctatgttttttccattgtctaatgatggagctcacactttcttgtttttaatctttagtataacatacataaagatcagtacagaagctgtgataacgtctctgccaaatcatcagatagtgatgtcagtgatgtttccgccatttcccgaaccagcagtgcctcacgcctcagcagcacaagctttatgtcagagcaatctgagcgccccaggggtagaatcaggtgagttggcaatactgtttatataaactggatctttatctgtgatataaaaatacaactagcttcctgaatattttttctataatacagtttaggtcacagtgggttaagtatttatcgactactatgtagtattgccaacagaatgtttagtattgactactatcagatacagcttataaccctagtcacaattttagagatcactctgagtcacatttgtagtagtttcctctaatatgattaaattcccttcctttagtccaacatcagaaagtgtattctttaaagggacagacagtaaatatttcaggctttgcagaacagtctttgtggcaactactcaacaatgtcattatagtgtgacagctacataaataaatcaacatgggtgtgtgtgtgtatgtgggtgtagtggatgtgttaacaaaatagacatccctagttacgttatgagttgaaaggcatttgcgtcaattttgtttaagtcaccagtagtgcttttgtattcttaaaagacaaataccctgctgaaagggaaaagaccccagacatccaagtgctatctaaactaaagcagattgattatggacaaaacatattttgtattagttctttactagttttcagaagtcaaagtttcatatagttatagtcgtgtaacctaaaaatttattacaatttaaggaattttggtgttgatgagaggtccaataaatataagtgttaaaaatatgaacaaacacttttccaatactctgaaaggctgatgttagtgcacattttgatgatgtacaatgaattgaattttgaaaattctctcttgtttgttgaagcaaattaaaagtaatcatcctgctgttatttaacaatttcatactctgataatctaacatgagcaatttcaactgataaagatattagtagaaaatcttttatctttacttttggtgttctcagcatctgactctaaaagaatataaagttctttaaaatttaaggaagaattataagagctcaagaatgtagccatattaagctaagatcaaggggtaagaagtattcttatagattcctttttattgaattcttaataagatagaatgttttttaaactgttgaattaccaaagaatgtaataaataggatgtaaccaaggactttttttttaccttattcactgaaaacaatttgaagtaatttttgtttgtattcactgtagagccaagtaccttgagccctatgctttaaagtagtactagtgaatagaatttgtattactaaccaattgcatagaataacttgtgagttcattttcattctcctaaaatttcagaagtaggattcttcaaaaatttatcttcctataaaatttggctatgtgatttcttttagaaagaataggaaaacaatgacaagagactatgattttatacaaggagaatggggaaaactacatgttagtagtgtattggaaccagtgttactttgtggagaacatggcaactcaacaaatcagcatggactataaccatatcatgacaagaagcaaaagatagaggatttttttgcttcattgcttcgtatgaattttcatatttagtgaagatggtgagaagaggggtggacctaaaaagagtataaataaacttcttagtgataaatctattttctctaagcacttttttgttttcagcttcctttcccttctttgtagtttaaaacccatataaactgagagtttattttatgtaagtggattatgtaaatttaagcactacagctaatagttaaacaagtttccccttaagctaacataaagagctacttttcttgtaatctcatactgtatgtcagtgatttgtcatatgcggtacatatttgctcttagaataattaggaagaatagagagaaaaaataagatgtgacacgtcttctcttctgacattcgtagactagttatcccttcatatgcattcttctgtctacatattctcatagacacacatgcagcagtacacacacacacacacacagagacacacaaacacatggagttattttgcttccctcgtcaatcctgtggtaaaaacctgagaggtgatagtttggaatgataaagaataaaatgacatcagcataaaagcatcaaagtcctgtgaacaagcattgcaggctcttcagatgtaaatattccctgcccttataggtaacactatgaggaataatttttcttaatatattactgtttcttctttattttttagcaactaacatctgcataatttctatagttgtttactcagctaattaattataatgatagaatatatttacatataagttgtaataataagcagcaaagttttttgttcctatcatgtgtaaggactttattatcttctttttaaaacaaacaaaacaaaaaaaaacattgtaaattcctgttatcttccccaccaccatgaccatgtagggtccagtctactccctaacctttttcccaaaaaaggtgctacctccttcccagacagatgagagagggcaggacttcaggctggatctaccattaggctctccctcccccagcttggagcacaggaggggaggtgatacctggtgacagatggatgggtggtggacagagaagaggagacaaggaagggctattccaggctcagccctgctcctccagccttgcctctgggtataggggaaacagaggcatgaccaggatcagggtcatgcccagctggccacaaccacgcgtggggtagtccaataaataccgtggatgctcagcaaggctgctacctggtgttttgaggctgctgtggttgcagacaccctcctggccttggctccctatcaagaagctggggatgggaggtggagggaggaggagcccctgccttaggagcctcacaggctgcaccaagagagcaaccagcctggagcaggagccaccaggtcccaagcatggctgacccaaatgtcatagatgcttttattgggtggcacctcctggaagagggtgtctagatcccagagcagcctgggggccctctggtttcagaggccactccctagtaggcagggccagttgacggtagacactggggacagtaggtgggtggtggtgccaagggcattaccacattgggagtgtagataggcaagtaggaggtgggcagctgcccccagggggaggccctgtgtcccccactggacagccacccaagaactgaggtgtcctgcagtagagtggagagaccaggccctaggctctgtggagagggtcgagggcccagtggctccctgctgggaagcctccccctccattcttatggggctgggaagagggcagagaggccacagaggcctctcagaggagggcaggggtggggtgggcaccacctcctccccactgctccccatgcctgaaggagctgggctgctctgtggcaccagtcccgaccagggtgccccctccccagagtcccctagcagggacttgatgctgaagccctcacggggtggcagcaggggactgggagcatctcgcagcaagtagggccgcaggtccttggtgaaggctccacatgcaccccagttctgccagcacctgcacagggctgtgttctgccaccatagcgactctgctgggatcaggcttatgtcgaccgcccagaagttgcccttggcctggagctttgcagggtccacaactatacatttagtaaaatttggcatttgatgtcagtaggcataataatcagtaagcatatactgaaaggaatgttcttctatttatttgaggattttaaaacaatatagattaaattattttatattttaagttgtgataacaaatatagaagttaatatattctggaatgtcaatcttgatattacagttatgtttgaaaagtgttatagaaaataatttcaaatgccccttatttcacaatagttcttcaattcagtaaggcaatacaggataaaattcaaaagtaatccttggatttttgtgatgcatatgaaaatcttgagttagagttatctatatatccaatacatgaagcttattatctacactgttccgaacttcaattgctttactactcttttgcctattcgatttggtatttactgaaaatgctcagttaagatctatgaagaggatttgtcaacttctttattattctgtccattttttcttatatgagattacttaattaggttcaagttcagaattattttgtctttctggcgatttaaccttttatcattatgtaataaatctctttattccttataatattattttgttttaaagtcagtttttcttacatgataacacaagctattttcagttagtgttcaatctaactattcactgttcacatctttttgtgtcaacttttctatgaccaatgtgttatactcacataaacagcaaatagctaggtttaatttttttctgaccacacaatctctatcatttaattggctagcttatcaatttgcatttattttgattcttatagacttggaattacttctatattggtgtatgcttttaatttttcttattctattttttctctttcctgatcggtttttaattgaattatttttctttcatttcccccctccattacactggaaattatgcagtttctgtgatttttactgactagtttctcaagtatataaattttgttaagtagtcaatttaaaattaataattacctctactttctcctaggaaaaaaaatgactgtcatatgcttcgctgtgctactatccctcccccatttgcatattcttgtacaatgttttaattatagattggttcattttccccttattgcatgttatttttttaaatgccttatattaaaccatatgtattctagtttctttgctaaccatttttcgtgcatcttagaccttcattctggatcattctcctctctgagaaaagtgcattagaaagccaccagtgagggtctgtgagagcttagactgagacacacgtttttccttgttgttctttaagggtcttgactcatgaggatttcagttctaactcctcactagacctgaaaggtttccaaagattcatcattcacttaccgacctgttttagttctcgtttggtttttggctaaggacatatgcctttctttcttgtgacctcaagttggtattttaacaggcatttgttgtaattttcccatcataattactaggcatttggaagtgaaaggattttttagaatcagaatatatcatctaccatactgccagaaatagttcatatttgatgtgttaccattttttaaaatttttttttaaatttgcttacttgaaaaggataatatttaaaaataattaataaataagaaaaaacatgtaggtgtgaaaagtaagaaggatcatggccctagagactttatcccaagttagagggcaaatgccaaggcagagcaagcagagttggatgttaaactggaagtaatatctaaggggcttaagaaaaataacaatcaggaacatagaaggagatggtgaagggagccaagaactggaaaactttcaggaaagaagagagtgccagcagagacaggaccatttcagtcatgaggtgtaatggaaggaggagaatgaagaactaatgtgggaggtaaaggttgatacagctcaaactgagaaagagattctgaagtctcagaggatattgaatataagggagaagaatgaagtgagcctgaagttaagggaatggttagtgattgctgaataaacagcatcttgtgatcagagttcctatgccaggacaatgtgaagactaccagcctgcccttaaagactgcttttgactcagatgtgaatctttggttctgtcagctatggctcagtacttctactaaccaatattgagagcttcattcaacaagtgtacaacttctttagaccttgattttttttcacttagtcatagatttattcatttacttattcaccagtcatttattgggtacatcttatacgcaggtgccgtacactatctagtataaaacaaaacacatgattcctagatctatgtttttagtggattttcatacaagtgtaataataatattaaatgtatattcatctgaaaaatgtgaatcatacctgccactcctaccttaccagactgtttgagaataaaatgaaatagtgtatatcagaatactttgaaaatatagcattttgctttataactcagttactgcatacatggtatgaagtattagataagttactttatacttttaagtcatccttgaatgtcttctgagagacggctaacacataatatagtgcaacggcatttaaaattcgaattttgattactaatatttaacttatccacttcacagtgcttcatggtgagttggatgaatttaacagttggatttgacacttgaagagttcagttttattcgagtgtttttcaaagttatgcccatggactgttggtgttctaatgaaccttattgtctccaagaattgcctgatagacaggagaaagttgtccaaggagcaggagaaaaactaaacggggaggagaattcctagactgcaggacttcagcaacttcaactaaagcagttctactagtatttgtttagtacaacagaagtctgtgaagtagtttatttttaaaaaggaagccaggcactgctgctttaaaaacatattgtaaaccaaaatatatggcacagtaaattctagtgctattacttccaaggagaaaattaaaatatgagatgtggttctacttctctagttattacctgtttttaaaattcagatagtaccataatttggctgaaggattatgcaatgtatagtgaaacttcagtataatacactaagaaaaaacaaattccaaagaaaaagaaaactactagaatgttctatattggtcttagttggtctgtttttctactatatattatgtttattatacacttggtatatgagataaatacttattattgttttttagcattttagctttaaatagcattatatagattgtccagggaaatatatattatttccaagctcattacttcagcttgtacagttaatagactttatactatgcttttttatactactcttgatatatgttcaatttaaagcaatatagtaaaatttttaaagtatatttttactttatcttttttattcatttagaaagtcatcatttaaagctttgtttctttactcattttaacatatgattaccttgatttcagctagactctcttaaagcatagacatgataaccaagtgcggattgattgatatttgctaactgtatacgtactacttatgcagcataatgaataaagaaagcatagaccttgatgtatcctcaagatggcatatatgctatttccttataattagtggaaatattttcaaagctttctgaatcactaatacaacaaattagttgtattatttgttactttgtaaactacaacagatatatcaaggcagcatttgtgtgtattcatctttaattttatgactttattatttgtgactcatttatatagttttatggtccatacatgatgtaagtaattgttttctcatgttttggtattcactgagtatgtatatcagcttttgtttaagtatgcatttgtttttgtatgtgttgcatttacaatagattagaaatacatgagcagatgtattcttaactggttacttgtaaaacaacatttattagaacaagtatgaaaacattatcggcttgtttagtattttaacagaataattatatgctttttacaccattatccacccagttcccaaatcaaagaactggaagccacccagatttttacctctccccagtcctcttcctaattcaatatttctcaatcctttttattatcactcccctaagggatcttttaggtgttcctttcctaattgccctccttacatgaaattttaatactagagacatactatttatatactgcaggcctttggaggaccactaaccattgtattatctaagatttttttgttccctctaccttcaccaagaatcagttatccccttctggggacagtatcactcccaatgggaatgcatgttcaaatgagtcatcaaggcctactcattttacttctcaaagagaactcatgatcacagatttaaagttacagagaacagatgtgtttactcacctcaattttataagaagactaaaaagactaaaaactccatctaacatgaaactaggatttaaccacatctgtaaataataagctatagaaagcaattttcaaattcagtgaaatctgaaccaaaatgagaggaaatgccaaaaatagttgcttacttgttcagctattgaacagaatgtgaagctctctaaaataaatgtcacagccttaaaaagtccaatgaaaaattcccttctagaatatgtaagagctaggggaagttttagccctggagcaccttgaaacagtattttatacctcatagtagcagactacatggactcagaagaggaccatctcaggtctgccattctgtggcagaagcagggtattgggggactgtatataggaatcaatgtggcaaaagctattcagtataatttacaaataaactggtatagcatgattttaacgtatgtcttcattatgaaatcctatgaacattttgataacaacataactggtctaattctacccttattcaaaaataagcaataatattacatggtcacagttccccaggcatgacagtatagtttatatcagactaacttctccacatataaaactataaaagctgaacaagaacaaataatgaacaagaacaaataatgaacaacaacagcaaaaactattggaaggcctttgagagcaacaaagcaggcagaaatttgagtagtttcaatttttgaaaggaggggaaaacacaaggtaagtggtaagttcatcctagtttcctctgaagttactttccaatttggtgacataggataatagagccgtaagcagagagcagtgttcttacttactaggctgagaaaataaatttcacaattcaggaactgacagagaaactggaaattgtgagggtggaaggcttcaaattttgctatagaattccttcatacgttgaccagtgacctgtctatgcacagggaagtttccaggaaagcaaacaaaaagcagcagctggaaggccaaagagccaagcacaaattccagcagctgccagtgctggggagatggattggacttcaagttcccatagttagaggggtatgacaaacacttttgatttcttttaaatatctcagaagggccaaactctagaaataagcattacactctgtgaataatagcaaatctttaaacccaaactctgtacaagaacaagacgaaatctttctgtcaatcaaatgagaattttacctattttggaggaaaataatatcatacagagcctccacagggtttcatccacacagttttacatctgattaaaatttatgagtcatgtttaacaacgagaaaaaggactacctggctaaacactaacaagagttatcaaatagagagagactttaaaatatctgtgattaatatgttaaagaaatcaaaggaggatggattatttaacagagacctggaatccattttaaaaaattaaattataatttaaaaattaaaaaaaagtaatagtgggtttaatgacatatgagaaacagtaaaaccaaggattaatgaactagtcagtagaaagtataggagttgatgtacagagagaagagacagaaattggaggagaatataaacaagttgaacatgatgaaaaattctaatgtatatagagtcccagaaggagaggaaatgacagaagcaacacttgaatactgaattacagaccgacaattttccaggactgataaaagacatcaaattacaaatctgaaatctttacatacccaataatatatgtaagagagaaaaaaatcagcattattgtaatcaaagtacagaaaactaaaggaaaacatttcttaaaagaatctcaggggaaaaaagagataatatctttggagaagcaaagatatgactagctgaaatttcagcacatattatgagaccccaaatttgatggaatggccaaaagaaagaactctgaaaggaaaaaacaaaaatgtccaacttacaattttatgcttagtaaatattacccagaaatatctttcaggaaataaataaatgagtgcatgcatgcatagatagatagatagatagatagatagatagatagatagatagatagatagagaacaaagagaattcatcatgaggtgaccagcactacaaaaaatactaatgggagttcatgttgaagaaaagtatctccagttggaagcactagccttgaggaagaatgaagaacattggaaagagttcataatgataaaaacaacatcttgtggtagttaaaacatatgtagacgtgaaaaatatataaaatacctgagtgaaaggtgggaggggagtaaatggaagtaagttattgtacagatcttgcattattttgaaattggttaaaatgtctaacttgaggatttaagtaagtcaaagtgcatattttaatctttagggtagtcactaatagcataatagaagaatgcacaactcagatgctaatagttgaaaaaatgtggaataataaaaatacctaattaggcaaaaggagaagtaaaacaacaaacagatgggatgactacaaataaacagaaagtggtggatggaactacatctgtatcaataattgcatcaaaagtaaatgtactcagtaaaaattaccaatatcatagaatgaaaggggacaataatacatattatagatatataaatgatattgtaaacaacttacgatagtaagtttttcaattcagatcacagtgagcaaactatggccagcaggctaaatctggcccactgcctattattgtgaataaaggtttactggaacacatctatgcccatttcctaatatatcgtctatggctgttttcccgccacaacaattgagtggttgcaacagagtcgagtagttgcaacagagtcagtatgaaatatttactatctggccctttacaaaataaattttcctaaccctgacttacatgaaatatacaaattttctgaaaagtacaacttactaaaaatgacataagaataaactaaaaagctgaagagttatatatttagtttcttaaatgattctgtaattgttttcaaccttttcaccaagaaatatcctgacccaggtagatcctgataattacaaatatttaaagaataaatactcttatcttccacaattttttcctaaggaacattttgaaactcggtgatggcagcctttccttgatgcatttggtaaggacattacaagatagaaaaaataggacaaaatctctcattaaaatagagagaccccaaacaaaattttagcaaattgaatccagatagagagagggatgataaatgatggatgaattcatagatcattatttacagtttatgtgattatgcatataggaaatatataaaatatttctcttcatgacaaacttagcttaaaaacaattacagtccatttacatatattcaatccactaaaagaacctagaagtctatataaatatatatatataataactattagaattaatgaattttgcagagtcactgggtataaggttaacgtatgaaaaggaattttatttttatgtactagcaacaaacaaaccttaggaaatgaaatttacaaaatgccatcaatgtaatatagtcagaaatataaaatacctagaaataaatctaagacctaggaataaactaacaaaatgtgcataagccctcaacactgaagactacttatagcttcacataaaactcaacacatgtatgtgtgtgggaatgagatttaataaaaattacagagatcattacttcttaaggtccagcttacttgaagagattgaatataaatagtgatctaacttgagttcattttttagttctgattcttattatcaaaataggtccaccagacacctttaggaggtatttaatgccaccttgattattaatcaccagtccctgtgttatgaccactgaaaattataggatggatgcctggagatggcttcttaatattgatcaacaatattgatctactgtttgtggttagtaacttgtgtattgatccagatgtaagtgtagggctcatataatttttgttatttaacttttaaaatttttgtaaacatcattgtgaacttatatgcattattattctttatactacttgttccttcttaaggcttacaatagaattatggtagacttctaggttcttttagtggattgaatgtatgtaaattgattgtaattgtttttaagctaagtttgtcatgaagagtgggaactatcctgacatagcccctcgtgtcttctgaaaacattcttgctttctgaaagaaggtgttttaggacttctgttttttatcctcttccaaaacgttgtgtcagcctccttacattgtaataatgggccaaagtctggcaaatgaaggtacagatttgattgtcttacattacccatcacttctgtatctataagtaacagtctatgtttgggaaagtaagcttctgatgctttaatgttattttattatttttaaaaattcttgtttaaattggtttcttgtttgtctgttaccataatttaattgattttatccacattacttgtttgtattttaccatctatacaatcagtacatattctacaattgatggcatgtcatcgtttaattagcatttttctttcttaggagagagactccatacccccattccagaattacttggtctgataggcagaacaatgtgcccccgacaaagggttcctatatcataatcctcagaaaaatggggaattggggtgtcagatggaattaaggttgctattgtctgaatttaaagtagggagcttgtacaaggttatccagtgggcccagtgtagtaacaggagtgcttataagtgaaaaaaggagggagcagagtcagtcaaagacagagatatgacaatagaagcagaggtcacagtgattccacatgtatgcaaccagccattgttccctttgatgacagaggaaggggccatcagttaaggaatttgggcagcctacataaactagaaaaggcaaagaaacatattctcccctaaagcctccagatgaaacatagcccagctgacaccttgattttagggcttctgacctccagaactgaaagataataaatttgtgttgttttaagccaccaaaaaaaaatacataaaataatgatgtgtcttaatactgatggcatctttgatttggctgaatgcgtatagacactttatcaccttttccatttaatgcttaattatttcataccaaatcatatgtgtaatttataatgtggaccaaagtgttattaccaccagatctcattttccatacctatcagtatgaggtccccaaaattcatttctttttatggttgataatatttcattgtatggatttaacacattttgtttctctattcatcagttgatgggcatttgttttgtttccatccactttttgacttttgcgaataattttgatatgaatagttcatatatgtttgtgtggatatatattttcgattctcttgagtatatacttaggaatggaattgctggatcatatggtagctctagtttacctgtatttaaagtgccatcatattttctaaagcagctgcatcactttacatccccatcagcaatgttgacggctccagtttctcctaattctagtcaacctttgttattgtctattttttattatagccatcctagtacatttaaagtagaatatcattgtggttttcataaacctgctgttaagccaaaattatcaaactactttgctatcttcaagaattcactttgattctactgagttagcaattttttgaaaagggaattttcttaaaatggtagcatttttaaagtattagaagttcagtttctttcttctctgggattctttaattctctatgctagaattaggtaagtactcacctgtacagatcaatcagaacagaagttctattaaatgtaaaataccattctactataaagacacatgcacaagtatgtttattacagcaatattcacaatagcaaagacttggaaccaacccaaatgccaatcagtgatagactggataaagaacatgtggcacatatacaccatggaatactatgcagccataaaagggtgaattcatgtcctttgcagggacatggatgaagctggaaatcatcattctcagcaaactaacacaggaacagaaaatcaaacaccacatgttctcactcataagtgggagttgaacaatgacaacacagggaggggaatatcacacaccaaggcctgtcagggggtagggggctatgggagggatagcattaggagaaatacctaatgtagatgatgggtttgatgggtgcagcaaaccaccatggcacgtatatacctatgtaacaaaccttcatgttctgcacatgtatctcagaacctaaagtgtaataaaaaaagaactccccccaaaaaatcttatgtaccccataaatatatatagctactatgtacccatgaaatcaaaaattaaaacttatttttaaaacaaaagtataaaaacaaaataccttgggatctaatatttgctacttggacaactatccctatggtatacacaaagtaagaatgtttttgtcaccaattaaaaatatttttttttagcaaacagaactagcaggttcagtgttaccacacagctatagggttaaaattaacgtagtaatctaagcctatattttaaagggtttttcttctttcagtatgcacaatatatttcttgagtgatgtgagtttttagtagcattcaaaaaaaaatacttgcaaaaattctaccaaactagattttctgtcatctgccacccagctttcaatgtattcctgacactgaaatctgctggccagccgtctgacagatttcacccataggtagattccctattgttactgccactagttgggaaagtattattagtcataagcaatgcagaatcagagtcagtcttgccaagaactggaaccagaaagaaacaaaacaaaacaaaacaaaacaaaaacatgcatagaaaaccagagtcagaaaaaaagaaaacagaaagaagactgtgctgttgcctcttgaggttaaatctagaagccaggaaaaggcatccttgggcttatagagcccatgaaatgccctgcttggacaacacagctaattggcttaagtagggagttcatttaagtgtctttggtgggacttccagtactatcagaacataattctccaaattaaaacactaatcaccagaaaaatagcaaatgttggagctttaattaattagtgagaaaaccgacagtataacaagctgtttccaaagatgatccaagaaacccttgtaattttgtacatgtacatatagttattggggaaaatggaatactaaaattagattactaagttagattcaaaactggataatgtattctaagtcaatgaaactatgacttaccagttatccactctagagccagatagtaatcatatgccctttattagtttttttttttcaaattaacatctaactttacaaagaatataaaatgtttggactacaattataagagtaaatactaagtcaaaattttacacttctgtagagagtcaaatgacccttaggtgctcttgttagccaatgcacaagcatgttagggaatgctcaagaaaagtggccagaaaaccaatttggttggttggttgggtttgtcttacttccaagattggatattttgttcttactctgagcagttgggtagatgggtgcctataatgtgatatggaagattggagagggagcaggttttttgagggttgaacactttatgtttgagagccttattagatatatccaagcagatacgtcagttgacagctggatatataaatctggagtccagggctgagtacaaggtgcaggaaaacaattgggatctgcagcatatagatactacataatgcttggaaccaggtgagacatctgtggagttcagttcatgtagaagaatataggccaaagggctgggcattgaggagctcctacatttagtgataaaagaggatcaaggtcctgccagtgaggcacaagtttggaaaatccattagaataaagtatttcaagacaagggaatcaaattctttgacaaatgcatgacatattgagaggtcaaaaggataaagactggtaagtgacaggatttgctgtgtggagttattagcgactgataaaagacagttttagtgaaatgttagggacaaagcctgattcaaattacttcagaaaaaaataggagaggatatataaataactacttgagatttttcagcaaaaagtctacaagaagggggggatcaaaaggaaagggattttgtttgacttttaaagatgggttatagcacagtatatttctatactgatcactttttttcacttcctactcataaatctattcattcagcaatgggaagggggctgtagcagttttagtggtgcataaagtgcatgctgttatgaaatatcagaatcccaatataaccagtacaaaatgtaaaacaaaggaccaggagacaacagtcatgaagctagagagactgagtagctttataaagcagaaaaccttaagatgtgtcttaaaagattcagatatgtataagcgataggaataatttttcaagaaacagaagcagaacaaatgaaaggtaagaaatggggcagtagaaagcatatttgtgctgtaatcttcagattgattagattaatctgactgattagattctatgaactgcctcctcagttagaagaaatgaaaataccttaaatgtttttcattgaatattataatattatagactgtttaggaagctacacaggtcctcataaaagaatgcttttaagcatctggacatatattttttgagaaaaaaaaactcatattttattcagccaatcatttttcatataacttaaccccctcccaatgataacacttgttatacatatttttctattttttccagaacttttatttgtcaaaattgtagaatatttcactgctaaaattggatacccgtgaaataaacttttgaatcttcccagttcatcttaaattttaataataaaatatgatagtagacatttccctatactcttaaacttctttataaactaaagaacattgcccagaatttcacaatggtgtttttttgtgactgatattagagatggaaatttcaagctgtaatagaattccatctttatggaaataatgggaagaaaaaagggtacatgttaattaattcatactttcctttaaaggttagaaaatcatcagaagagaagttttcaataaccattgtggagagtgggctaaaataattgatgagagatgagaaaccactgctttctctgttgtaggcattcgattgagcatggacattgtaactatgaaattgaccaaatcctgacatttctgtagattctccagcagaattctgcaagtaaaatagtaaagaaaagcagatagagtagccttaaggatgggtggcgtattagataatgcattcaaatatgttggtgaagacacagaagaaattgaccataatacttatcaggaaagaaagtctcctggagttgggaatataaatcccacaggaaacagtttgggattgatcatacataataatactctcatttgtgtctcaaaaaatgtacataaaatgcatagcaaaattatcagatttgcaaatgacttaaaattttgagttaatgaaaaactgactggaataagttgaaagaataagaatcatttattattatcagaattttgatgtggacaagttcaagtaatgcagctaagtattaaaaattacaaattgtcctcatcaagtagaggtctcaattttcaattcacaatccatgaaggatcctaaggaccagtcttacctcttttccgtagcttataaactctccttgctgatcttgctctcccacctttatgaactcacctcataccaatttctctctcattatatatatgacaacaaacttgttacataatcccaacactttctgttttataatttataatcatattaggattttttctgactcacatattaaatgtcctcactgttaaagatgctatatcagctagtgtgtattttgtagttcaaaacaagaagtagaaaatgaagaagatcaaaatggtaataagggtcatataattagtttttgcaaatattttgaggaaacataaaattaagagggtcattttaggtgtatcaaaccaggtttttattagacagaaatgtactggtctagatggataataaagctgcatatgcattgtaatttaaaaggttgtaagaatcctaacatcattctcagtaaactatcgcaaggacaaaaaaccaaacaccacatgttctcactcatagatgggaattgaacaatgagaacacatggacacaggaaggggaacatcacactctggggactgttgtggggtggggggaggggggagggatagcattaggagatatacctaatgctaaatgatgagttaatgggtgcagcacaccagcatggcacatgtatacatatgtaactaacctgcacattgtgcacatgtaccctaaaacttaaagtataaaaaaaaaaaaaaagaatcctaacatccatgctccctgcttgcttgccctacctctcctcaactctcagacgtagtttactttggctagtagaaaggagtttttcccagctaactttctatgctgcataaaataattaacaataatatattctttggggagagaaggaatctattcaggtaaactggtacaagctggtaacatagacaagttttgataggaaagaaaaaaataaaaagaaatcagcctacatcatgcgagtgtgaggcactgaaagaaggaaatgagatgaagaagtttgtgtggaggaagtggagcatgaggggacaaggaaggaggagggaaaacttaatccaaaagcattttgttgttgttgttttagttttagtttttgctttctttgcagtcttagactcattaagcaagatgtgttagttagaatcccaaagggaaattagaacaaatactgttttcatttcttaagccttgttatgtggcacatttaaagagtgtacgtttttaaaaatatttttctctctggaatatatatgaacttttcttaataattgaaatattttagtttttctctggtaacatagtaactatactgtttacaaaattggtcagtaacattcatctccccatgcatggcatttgttgcacttatttttacaatctttaaaaagattctaaattattccatgttgaaatggcattgttttaagccatgtctagtaataaatactttgcaggtggtggtgtgatactaaagtatttgtaggtatagatccactactcaactgcattttctccctaaaaatgtgtctggattatttcaaaataaattagatttagaatttcagtgatgctgacctgtaatttatggatgcatatatgtttttactttgtaaatatagttcatttacccccaaaatgcaaggcagacggatggggacttcaggaagatccatcatgaagagcaccagtgtcagtggagagatgtacacactggagcataatgacggcagccagtcagacacagctgtgggtacagttggagcaggtggaaagaaacggagatccagccttagtgccaaagtggttgccatagtgtctcgaaggagtagaagcacatcccagcttagtcaaacaggtgagtgatgtgaattcaacctaaacaactcaattcttttatggagagaaaaacttgatcttcatgctatggcttgtgatggaattgtggcatatttggttcttctttgaaaagaaaatttatttttctgtctctgaaaatctgctaaatttatgggtttattttttctgtacagctctcttcacaaggtatcacttttaaatctgtaaagtggacagattttttaattaaaaaaattaaggtcatatttgcaaatatgcaaggaaatgcaaagaagtattaaacatccaaatttatttacatgcaacgaaagcaacagggttctctttttcaaaatgttccataattcaattacttatttttggctatatctatactttttatagaaaagaaggtcagttgtgcaacgtgacatatactcttcaaggtactgtataaatataataattgaactgtacttgctatagtttcaatgtaagtaaaaacccagcagtgatttttactttagaaaaatgggtcagtggttttatgcaaggagtaatgttttaatacaaatatgtgtttcagatattttctgctgcttataaatttaaaagcttaatgtcctaaaggtatatatttaaaaagcaaatacaaaagggagagtggctatttttgtattgtaaaatataacaaaacactgcttaaaattatataaaattggccagacagattagattattcattactatgctcaatactatgtaaaatcaaaggtaagtgaaatattgaagcaatttaaatagccagcaactgttttttctcttaaaaccaacattggttccattttctgttccttaatagcaagagccttatcacaaaatttacttataccaaaaagctttcacaaaatcctttttatatctcactcagcattctggaaagtacctattttaaattattcattctactggatatattggcaaataaattagaagtaggaaatttgagtcatgtcttaaaattacaggattagaatgaacttagaatagctagcatccctgtgatagatctgcatctttgcccttccaatcagatgagctgttctatttgttatgaaggagaattatttgtcttctttagagtcaagttcctttacagtaagtataagaggcatttttcatttgtgttgtttcttttgtttaaattttttatggtggtgcttcctggtttttggtgttttgtttgtttgttttttaaattacactttaagctctgggatacatgcgcagaaagtgcaggtttgttacataggtatacacgtgccgtgatggtttgctgcacccatcaacccacacctacattagatatttctcctaggcctcctaggagatatttctgctatccctcccctaggcccccacctgctgacaggccccggtgtgtgatgttcccttccctgtgtccatgtgttctcattgtttaactcccacctataagtgagaacatttagtgtttggttttctgttcttgtgttagtttgctgagaatggtggtttccagcttcatccatgtccctgcaaagggcttcatccttttttatggctgcatagtattccattgtgtatgtgtgccacattttctttacctagtctcattgatgggcatttgggttggttccaagtctttgctattgtgaacggtgttggaataaacatacatgtgcatgtgtctttatagtagaatgatttataatcctttggatatatacccagtaatgggattgctgggtcaaatggtatttctggttctagatgcttgaggaatcgccacactgtcttccacaatggttgaactaatttacattcccaccaacagtgtaaaagtgttcccatttctccacatcctctcaagcatctgttgtttcctgactttataatgattgccattctaaatggtgtgagatggtatctcattgtggttttgatttgcatttctctaatgaccagtgatgatgagcttttttttcatacgtttgttggccacattaaatgtcttctcttgagaagtgtttgttcatattctttgcccattttatgatggggttgttcttctcttgtaaatttgtttaagttctttctagattctggttattagccctttgtcagatggatagattttattggtattgaagtaattctttacagcatgaggtggtggagaaggttttgaccaccagacttcaaaatacttaaatgaaatggaaacgttatttgatgtccttgaaggaaaccagtgtttcctatgtgagagattgtaagtttacaagttggttttacttcttccctcaactttccagtctgtctttttctctctcttctccctctttaccctcttttcccctctagctagttagtaccctatcattcattacttgagcatagttttcttataaaacacagcagtaattttgcataaaaactatacttgtggctcatctttgtattaataagtaatgggttcaaattatggtcatcaaaacacttagcctctttgcttttttcatttatgttttatctcagttatggtcagatgttgacttcaaataacatcttccttcccagaagatgtattgttaataacttcatggaatatcctcttttcagagactggattccagtgtacaggtggaaaaaggaaatgggattatgaagccaagataccaaaatatgtagttctgttccaaagtgactcaacgaatgaactttgacttctctctacaactcagttttcttatataatgatgggttgaatgggatgtcctcctgtgaactttctatgtgtaaaattttatgcttctctttctacataataattttacctttcatttgatagcctatccttagatttcaatcttcttgatctttctaaagcaagtgacaaatgttgataaccctcaattatcactcctctttgttttagtgcatagcctgatatttctctttcttaggacttcccctagtgatttttcccattcatttaattatctttcatctctcctacagagatttaacaaaattcagaattattctaagaaatgttagcttttattgcttcagattctgcattgaccatgagatctgtatttctggattcctcttcccctatgaaatattacttaattttaatctcccataagaaagcccctcttagatttctctcttaaaataacttcggattctcttaattttcagcccttactttcaatatagatagaaagggtatgacgtagtaaagaatggtaaattttaagaaaatgtccccaagccagaaatattttggaattgaatgaacctccaggtaaactgcaggttgggttttaaaatgtaaagtttttaatctctgttgattttagtggcccagcctgtgtaatgtaaggaattgtctcccctcactcaatactaactgtataatattccatataatatcctatatcttctcctcacttgaaaatgaaggcattattgggaaggttctacaaatctgtgcaaagtcatttctaaatacacttttgaaattatactaatcagtatcataagaatgataagtattcatgtttctaagtggataaaagtaatatgtctacatttctagagctttttccatgctctcttaagttatgtttgtgtgagtgtatacaatttcactccttcattggtcacaagaaacttatgaaatgttattattcccatttttttcttttttatttcattttatttattttttaaattatactttaagttttagggtacatgtgcacaatgtgcaggtttgttacatatgtatacatgtgccatgttggtgtgctgcacccattaactcgtcatttagcattaggtatatctcctaatgctatccctcccccctccccccaccccacaacaggccctggtgtgtgatgttccccttcctttgtccacgtgttctcattgttcaattcccacctatgagtgagaacatgcagtgtttggttttttgtccttgtgatagtttgctgagaatgatggtttccagcttcatccatgtccatacaaaggataagaactcatcgttttttatggctgcatagtattccatggtgtatatgtgccacatttccttaatccaatctatcattgttggacatttaggttggttccaagtctttgctattgtgaatagtgccgcaataaacatacgtgtgtatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcaccattttaactggtgtaagatggtatctgactgtggttttgatttgcatttctctgatggccagtgatggtgagcattttttcatgtgtcttaagaaaacctaggcaatgccattcaggacataggcatgggcaaggacttcatgtctaaaacaccaaaagcaatggcaacaaaagccaaaattgacaaatgggatctaattaaactgaagagcttctgcacagcaaaagaaaccaccatcagagtgaacaggcaacctacagaatgggagaaaatttttgccacctactcatctgacaaagggctaatatccagcatctacaatgaacttaaacaaatttacaagaaaaaaacaaccccatcaaaaagtgggcgaaggatatgaacagacacttctcaaaataagacatttatgcagccaaaacacacaagacatactattcccattttaaagttgaagacactgagacttagagggattgggtaatttgcccaaggtctcataactgattgggcctgaatttaaacccaggctacctggtgccaaacccatgcttttaaccaacttgtgaagagagagagagagagagagagagagagagagagagagaaagtgagtgcaagcacatttgagattttgaaataagttcaagcatttattgaacatctatgtggttagtacatgctaggcatcatgccaaggcactgggataagagctagggatgaagggatgaatggcatactgttcctgctctcaaggatatcacagtatcatagagcaaatcacatataaatatttcagctcagaaaagacaattatattaaatacaagtgtcagagtggtagaacggaagcacaggaaaggacgagaatcattccaagaggctttcttgaagaggtaaagcctgagcataaaaacacaaataaatcaggataagtacacaaggaaggactttgcacaactgagggaagagtacttttttttcattttctgaattatttatatctttttttaaaattatactttaagttttagggcacatgtgcacaacgtgcaggtttgttacatatgtatacatgtgccatgttggtgtgctgcacccattaactcgtcatttagcattaggtatatctcctaatgctatccctcccctatccccccaccccacaacagtccccagtgtgtgatgttccccttcctttgtccatgtgttctcattgttcaattcccagctgtgagtgagaacatgcagtgtttggtttttttgtccttgcaatagtttgctgagaatgatgctttccagcttcatccatgtccctacaaaggacatgaactcatcattttttatggctgcatagtattccatggtgtatatgtgccacattttcttcatccagtctatcattgttggacatttgggttggttccaagtctttgctattgtgaatagtgccgcaataaacgtacgtgtgcatgtgtctttatagcagcatgatttatagtcctttgggtatatacccagtaatgggatggctgggtcaaatggtatttctagttctagatccctgaggaattgccacactgacttccacaatggttgaactagtttacagtcccaccaacagtgtaaaagtgttcctatttctccacatcctctccagcacctgttgtttcctgactttttaatgatcaccattctaactggtttgagatggtatctgattgtggttttgatttgcatttctctgatggccagtgatgatgagcattttttcatgtggtttttggctgcataaatgtcttcttttgagaagtgtctgttcatatccttcgcccacttgttgatggggttgtttgtttttttcttgtaaatttgtttgagttcattgtagattctggatattagccctttgtcagatgagtaggttgcaaaattttctcccattctgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttatataaggtataaggaagggatccagtttcagctttctacatatggctagccagttttcccagcaccatttattaaatagggaatcctttccccatttcttgtttttgtcaggtttgtcaaagatcagatagttgtagatatgcggcattatgcgagggctctgttctgttccattggtctatatctctgttttggtaccagtaccatgctattttcgtttttgtagccttgtagtatagtttgaagtcaggtagcatgatgcctccagctttgttcttttggcttagggttgacttggcaatgcgggctcttttttggttccatatgaactttaaagtagttttttccaattctgtgaagaaagtcgttggtagcttgatggggatggcattgaatgtataaattaccttgggcagtatggccattttcacgatattgattcttcctatccatgagcatggaatgttcttccatttgtttgtatcctcttttatttcgttgagcagtggtttgtagttctccttgaagaggtccttcacatcccttgtaagttggattcctaggtattttattctctttgaagcaattgtgaatgggagttcactcatgatttggctctctgtttgtctgttattggtgtataagaattcttgtggtttttgcacattgattttgtatcctgagactttgctgaagttgtttacagcttaaggagattttgggctgagacgacggggttttctaggtatacaatcatgtcatctgcaaacagggacaatttgacttcctcttttcctaactgaatgccctttattcccttctcctgcctgattgccctggccattgattaaatgttgaaaatggtgcttagtttcctgggatatgagaaagaaatctgtgtggaatctaaaactatatgaaatacttctctaattccagtggttacctcatctcaggacagatctcaaatcaaataagctccgtacaactgagactatgatttctaatagaacttttaaattttatgaagaagacatctataaatgtaaaatatcagctttataaactagaaattactcaatttactttaacttgtactattgggtaactgtatctgcagtactatcccaggcacagtgggtgtttcaaaaatagaagtatcatttacactggaaggaaatcattcacacctgaaatacacatgaaccaagcaacaaagtgaaaaaacataaagtaaaatgcccgaaataataaaatctagttctatttatgtatgttatcaaaggtagtggggagacaaattggtcaaggatctaagtccctaggatgagggcacatacagaattggtagatgatttgttctaaccatttagtaaaattatttattatatcattaacagctgagaatactttgttagcataatatcttttctccaaatactgacaagatgttgatgtttatattctaattatggaaaatattgcaggactctttcacaattttcaaacagttgtcaattatgatgtgctatgaatgtgttaaaaatcacttgtatgcttctttagtaataggtattctgtacctttccaatatttttccactatcaaagtttatttctcccctgtgcagatcctttccttcaagaccctgtttaagaccctctaactctatatgttgtccccaattatttgaacagtttgtttttctgaattcctaaatagagctctctgacttcactgtcaacttgctgcccactccactctccattttgtcattcatttcagctccttctctctgaccatctcattcatctctatcttaattcccctccacaattagatttagcacgcagttcttgtcatgggtgggaaaggctagaacaggatgtactctgggtgggagcccaaggggatagggctaaaaggtctacaatgggttagagtgaggctgccttcaccatccctaaaatctgttcacatgcatggtgctggggctggcaagatggataaatggaggtaactcttatgaacttttcttcagggagcttagcattaggaaggaaagagatcaaatgtagcagtccttttttctttgattctaccaacatttattagcacttttcttgtaccagactctgtaattgagggagtagtaagagtaagatgggtgtgtgtgtgtgtgtgtgtgtgtgtgtgtgggcatgcatgtttcagaacaaaggaatctgatcatttttccaggtgaagagtggatataacacctctagatggagagactgaaagatgatacgaataattttaattgtgcagagttccagagaacagaggcgataattcaagaacacaagtttattcttggagacagagaaggttgatttttttccttgagtatgacagaaaagaggaaatggctgaaatacaaaggaatattgcaatggggatattgaaagctgaaggagcttgagtcagaggctgcttgatcttctcagtgcaaatgaggtattaacaaatggagagagtgaggatatagggtgagcaatgttgtaagaaattaattggtatgaataaaatcctgctgagcagcacttatccagctaagtttggataatgcaagtcatgtggaaagtaactttaaaaaaacatttatcagggatcaaggcctcccttgcaggtatctggttcacattagctattcttttgtctttcaagattgtcatcccctgcctttgtgcatctccagtgtccttgccaaggtgtctgaaatgaccataagattctttgagaatatattgccacattctttaagacttagagaaaatatctggttaagtctagattcttaagcccatttaatgattcacctgtcttgggctgctatttactgtttagtttgactctttttagcatgcatattattattattattattggagaaaattgaagctctgctctttcattcttatctattaatattgtgtcttctcaaggaaataagaaaatcttactcctttcttttctttcttcttcttcttcttttttttttttttttttttttttgtgtgtgtggtcttgaactcctggcctcaaatgatcttcctgcctcagcctcccaaagtcctgggattactggcatgagtcaccacacctggctcattctttttcttaatatggctctaaatggctttttattttttttgctttggcaatttatttctaggaaattaaataattctttcattataatcaagggaatgaaagacttcaggaggtccatagtggagttcaaaaccatatggagttcactattctacaagattatacaggcaataatataagtattctaaggtgttttaggtagatttatagatgttagatttcaaaatgggttaataagtgtttatgaatttccaaggtgtatcactaacttctcaagatgaaatcatatatagaaactatcaaaattttccttgttctactgtcaagaaatgaataatatacactgatataactgtaactcacatctaaagggatagtgcttgaataagctaatttacaatgagttcaaggtattattttaaaattcttatggtccttagacaataattatgccaacaaatgtgaaaaatattaaatctccttctgttaattttttccagttttattacccaaaagtcacacaggtaatgcaagtcatgaaataaatcaaatgagcaccttcctggagagcctactttatttaccttgggaaaatggatgacatttgccctaggacttatttttctccttctaaccaatacagtttaccaaaatgttctctggtaattttaagtctggtatggctttgtgaagactctctgccttttctcttagaaaaataatgttatagctgcagggaaggaaggctaaggtggtgtctttgaacattctaagaaatgttttcttggctctgttgattattaacaatataagccaaaaattcttacaaagtatgtaggcccttccaagtttcagaaactgaaagctacagtggatcaaaatattgctgaaatctaaattccttatttgtgccttattgcctcatttacttgattcatttaatggcacaagaaaaacattctgaagaatgtaatatttcatgttctttgtttcctgaacacaaaatcatggtaccagaaatgattctcaagttggcgaaaccatcaaatgaatgtaagcatgggttcttttatttactgttgctgtctgccttaggaattcactactgttaatagagattcaattcagctaaagtaactcatcttctaaagagatgccctaataaggattagtattttcaaacatactccagctggtctatgtttgttcttttccttgctctgaaatataaattttacgtttggctaagatatagatatacttttaggttggcttggcagaaaaaattattgatttcagtggaattaatttttataattaatttgtatttcagggtttggaggagggaaggaaactaaatttattaagtgccttcaaagcacaacacttagcactaaaataattacacatgttgatatttttaactatactaagatgattgttaagcatgagatcagtttcaaaataggtgtcacaaaacatttcaggcagctaaagatgtaacaagaaatgtgtctgattatttttaagatgaccaattttaatacatccttatttaattcagagtgttttttcatagagatttttgttgattgattttcacattttaaatacagaaaggcaaaaagaagatatataaaactcctgtggtatcaccactaattgcaaagtcagtgtgaaaatgatagtttattattggataatttttctatgcatttgtattattaatattgataaaaccattagcaataatagttgtgatttagtgagcaattattacatgccaaccagtgttttaattttttacatgtgttaattccttcaattcacaaaaaacagccatgaaatactcttattatttgcattttacaggttccatgacttgtctgaggtatcacaactcttaaaacttgaagtagagcttatgttctcaaccactttactataattccgttccaactgtatgttcacacagagagatacctttttgatagagattttttaaacaagcatagatttataatatttaattttgttttataatcttgccttttttcactttaaaaaatgtgtatttaagaccacttagtacaccatcacgggatgcttgtactagggtggaactggaaggagcttagaattatgtcttagaataaacagtcttttgtatctgagcatttgggcaatagggagaagaggaatattagagataaggttacgtgatgttaccatttactaagagggtggttgttgggaaaggaccacatttgccaattctggcagtgttgagcttgggaccatcataggaaatgtgttttaggcaatttgaggatcaacaacatagaactggcaattgaaatcaatgaagttacttaggaaagaagtataaaatacaagtaaagaggatctagaagaggctcctgcagaaaacaaaaagttaaaggtcctttttgaccctccattttcgcaactataatatggaaccataaatggtacctacctcagaagactgttgtggagattaaataaatgttttaaacaatttagcaaagtacctgacaagggatcagtaataataattagcagttttaataattctggggaaccaaatacaagggtaagtagataaagaaaaggtatcagtgacatcgttcatgaatagcagtcagagttagattaatccagctaatatttttatctgttcattacatgtagttaatagaatacaagaatagaatcttaagatctaacgcttgagttcttctaagtcagtatttctcaaagttcctcaagtcaagtccacctttgaggatctggtgaaatctgttagtcctagcctcagtaaattgcacttgttcacatacgccactgtgtaaacaaacatgaaagatgtttatgaactcccagaagtatgttcatcccaaattaggcataatctgccagacagaaatccaagttttctttttgccagttccctcccttctgctctgttactcagccttcactctattaggttagaggtcaccaaagtctggcttagagtctggtttttagggcccatgagagaataaatatttttatgttttttaaatggtttaaaaaaataaaaatgagaataatattttgtgatatgtgaaaattctgagaaatcaaatttttatgtcaataaacatagttttattgaaatacagccatcttcattcatttacatgttgtctatggctacttgtgtgctacaaagtcagagaccgcttaatccacaaagttataaatatttactgtctagtcctttaaggagaacattccttaaggtctgctgtaggccaacaacttagtgcctgcaatgcagaagaaggtattagtgaacaataatcatttctatcattgttctctgcttctcagagtcaggagttaatttaccctacttccatgactttatttttttccatatacctgtcatgtttacatttataccatacgtctattgatatctcttgttagacacagtgattctcagaacgaagacttatgcccccatagataagactctttatatcttcaactttgccctaaaattgatacctggcttagctgtttacataaagtagtaaaagcacgtcactcaaccctaattttcccagttgggggctcaaggaccaagtctgtgatttcagtgattgtatcccagtatgtagcacaaagcctgtaccacatacagaaaagttttctggaatgaaagaaacttttggaagagttttctgtattccctttctttctgaggccactcagtccccctcactgcagtctgaattctgtctattcgatttccccaaactgttcttagtagatcacagaaagtttatagatatgaacttattttaataatttaacttatggtgtaggccacagatattgtgcacatgtgaaaccaatgtgatgtatgtaacagaaaaatagtaaaaaatgtccacttttatttgacatgagcaaatgattcttatttatgttccatctcttaaatgtgtaacttcatttctttctatgcatcagacctatcttcctggggttcacagaacacaacttaaagcttctttctttgtacctctctacaggtgctctacccagaaaattcttaatctgtcagtttgtctgtcaaaatctttctcttcattcaagccctacccaaatatcaacttcctaccaggaccgaaagtaatttttttaagtcctataagacttttagggagttctcatgtggtgctgtttacatctgtagaattcatgtcacaaaatgaactccgaagtaaatcaagggtaatgaccacgcaacaggttttttctggtctttcacaacagtgcatttaatgcagaagaatcttgataaacgtctgttagataggtgaatgtgatgtttgcttagtcaaaacataatgctcaaatggtaattaattgatcaaatcatggtataatatttcatttaacattgtgacaagcaagctcttcttagtgggtaaatttttcttctatgtttggtttgttattcttaggaaataaaaacatgttttttaagttgtaacaagtacagttgactcttaaacaatgcagtttgagcttcgcaggcccgcttatacacaaatttttttgtcaaacaaatgcaaatccaaaataaagtattcatgggaaatattatagaaacctgcatatgcggagggatagctttgattttggtatacatggtggtcatcctggagtcaatccccaacgtttactgtcggacgactgtagaagtgatttgtctattactttgcaacctcccttttcctttctttctcttctttgcttatatatcacttcaaaagcacctgaacattgctctcgatagatttaaccagttaattctaccttattgcttttaaatattaactcttttataagcaagaataaataattatcattttaagattttgattttttaatagattcagagggtacatttgcaggtttgttacatggataaattgcctaatggtgaggtttgggcttctagtgtacccatcacccaaatagtaaacactgtacccgataggtactttttttcagcactcactccctttactgccctctcccctttgtggaacctccagaattggtgctgatttaactactttaccattacagtaaatgtcaaataaagtaatattttattagaaaattattgaaagataaaaatgtacatttatgagaaataataatgattgataaagatattaatttacaacatccttttatatcatttataaaaggtttattaaccttatgaaaatacttaagtatttaagcaaaaatgcccagattttttgggaatctttcttttgttgggcatagggccagaggaggcttgtgaacaaaggatctactgtaactgcttttcaagtaagctagtgaattcttacttgggaaacaaacctctgatattgaagcagtacattgtgatactcattacaaaatcatttatactgtaaagattattttcttacaaccgaaaaatgtggtacacccaatgattagtcatagttttagtgaagcttaacagactttatgttctaggtctacaaggaggtaaaaaacattctgtgttccagattcaaagtcagtgccataggatgtttttgtaaatggaaataccatacttatttttctcttaatttgaaactatgaagattctgacaagtaatcaaatagtaaataattatactacatttaggaaagtttcaactgaaagagattaaaacttatttgtaataactaaagttacatttataaataggcatatagttgcattgaaacactgctatatctagtgatgtaatgatgtaaaagtatattagttgggaaatataaaaattaacatatatattaatatttttatcactctgaatttgaaattgtaagaatgaatatttgacctgtctacctgcattatggaaactgaaaatggatgtaaatactctaatgaggaaggattctttaaaggaaaggatattgattagaaacttaccggaaagggttgattagaaacccacaggaaaaataaagccaaaacaaagttaatcatctttaggtaacttaacctgctgctgaaaatactagttcctgtttatagtttctaccttgggaagtacactcaacctattattcaattgtttttaaaaaggaaaaataaaacagaagaatcattttaagaaaatattacataaaatttatagagatttataactagtgtaggattctgtgatcttcggctaatcaaagaagaaaacatactaattgtcataggttttggagacttattgagaagattgttgtgaatagcaaggaaaatagtaggaaaaatttacctttgaagtaaaaatttactctcacttcagttctttggctttctataatgcttaataattctgtcttctcatggatcattctttattctctttcaaatcacagtttgaaaagtatatttttgtgggaaaaatatttaataaatcacagaattttaaaaatctaatttttgtacacagaaaaaaggaaggaaaaaagactaaattcagatattttgatgttgcagtaaatgtgttgaccatgataataaagcatattttttccagagctgcttgaatttgctctcagtgcaattgcaagtattgactttaatttctgagaggtttgtagcttcaatgatgagtcccttggtgcctaaatcaaagtggctctgtaataagtgagttctgttgtctcctttctgctgatggcactggaggcaacagcatgtcttctagaggcctctgtctgtgcttttcttttcatattcagcatgtcctagattcactggcccagatagcacaatacagcaggcagctttttactctgtaaatggcttagtgacattatttaaagtaatgccagttgtctattcttttgttctgcttttatattttcatagttgttacccattgcataccctttggctgaagcgtttgaaaatatcctatgccctttagaatttggcactgagcactctttatggtacataagaagtaaaagcatttatcttgccctggagttatttacaagctcatttactaagtagtatatcaacaggcaaagagagattctttctttatagaactttagcttttacaaagccctttcatgctcaccagctcagagtgcaaaattattgaaagcttttaaaataaaaggctgatcagattgggaaagattaggaatgcattaactaaggaaagcgtctggaagaaagtgacttttaaagtagaatataaatatctgctttttattcctcaaagtttccataaattttaatatattcttaataattcactttcttctcatctaaaaaataattgtgagaattaaatacaattttaaaggagcataaacatttcatatttatatacatggtatatgaaatgtaattttttagagaatttgtttttagtaacatatcatattgcatttatcttatttattcttagttgtatcctactcacctccccaagatgtaaaaaaaaaaaatgccattagctctgttttaagctttacctttgttcccaccattaaatttttaggtcagcactgcctgaaaccagcaatcatttccactgaacttaaatggctactgtttttattttcactcatcactgacagtcatgtttaggtgatgtcaaacatttatttcattcattccacagatattgatcaagtgcctaataattactaataagaatggctaagagttgttcagcccatattatgtaaactggtcctttgtaaggcttataatgtgtattgtcacatttaaccctgtcagcaaccctatgacattgatacaagagactgtgacacaggaccctgacaattggctggattcttcaaggaaaacacagaagctgagagaagttaagtcacttaaccattgtcacacagctagtaagtggcaaagaaataattagaattttagtctgtgcctatagcctcagtccttaaccactacaccacatgccttcagtatgtttaaaatgctattatatactagttaaatgtataattgcctgtaaatatccagaatcttcagtgtcgatggtgagcattttgtcatttataaccagaaaaatatttaatttggacttcatttttttacaaggagaaaattataacatgtatatctatataattttataccctaagactaagctgaagcacaccactatttttcatcttcagtgatatgcctcactttattagtcccatttacttatgaggaaattgaaacacagagaggtatgtaacatgcctgagttcacatagtaagggcagagctggaattggaatccagcagttgggctacagagtctgtgctctaaatggggcatgtcattgaagttggccgaggaggtggcactgtcagtgaaccttctgactctgcaaacgttttactgtacaaccatgccagcttcttggtagactatcttaaactgttcagaatgtttctgtatacttacaagaaaactggattcatttgttctgcttatttagctaattcactcatccacagggataagcctaattgtagatattaatgaagactgggtttatcaggtacatacaatgagtcatactggcacaattctagcactctaaaacaggtaccattattatcatcattttatttagataaggaaactaaaactcagaaagattaatttgcccaggatcacatagctaataactgataggcacagtatttgtgtggtagaatttattcttagccatcatactattatatcatcctcaagtaatttgatatattagctaacgtaattctagtttttataaaaatttaccctaaaagtataaaggctcacatttagtaaaattctatttattgttaatttaataatttgaggcagatgctcatggcaggcagtcaactctcctctgtgcagtggttcaggtgcccaggttctttacatgttatgcatttttgtcatttgaatccatatcgcaaaagtataaaagggaaatggagaacatatatctgactactaaaagccttgttctagaagcatcacacatcattcctattaatgctctattaatgacagttaatcacatggccaagcctagatgctggggatgggacccgagaaataaaatccctgacttagcaaccacttactatgaattctgtaactggaaaggggagaaaccactaactgactgtcacacacacaacttgaaaaggctttcattataaataattaagtcatttgagagtttacattcttttttcttttttttttttttttttttttttgagatggagtgtcaatcttgttgcccaggctggagtgcaatggcgagatctcggctcactgcaacttccgtctcccgggttcaagtgattctcctgcctcctgagtagctgggattacaggcacccactaccacgctcagctagtttttttatttttagtagagacggggtttcaccatgttggtcaggctggtctcgaactcctgacctcgggtgatccaccagcctcagcctcccaaagtgctgggattacaggcatgagccaccacgtccggctgagtttaaattctgttctaaagtaaagtctgaaaatactggtgctttcttatgttactgtaaaatttgtgcactgacaatgtaatttgagagcccctttatccgagtttcaaagcctgtcagaatccaaaactgaccccacaatttctattcattcgtcagttttaaaatttcctggcctcttttgactcttagagtccaggttcccctgttcaatacaacatagactgcataaagcttagccatttccttgctttataaaacaaaacagaacaaaaaacgtttgttcatgtccaggctttatgagtttaatagactttgatgaagaaactgttagtcatggggggattggagggaaggtgattgggaagtggtcacgtcacaaagcacacattattttgctctttttctctctcttctctctcacctctgatactcagttactacttctggcttgtttatgtctacaaataacaggcatgtacatttatatatcatttactcttccaggttgttttatcaacactatttaatctttaaaacaagccaatggaataggttctgctaacatttttcctgtatacagtaaggaaattaaggtatagagattaagtaactgggggttggcagagctagtattaaaacccaggctttggccgggcacggtggctcacacctgtaatcccagcaatttgggaggccgaggaaggtgaatcacctgaggtcaggagttagagaccatcctggccaacatggtaaaaccccgtctctactgcaaatacaaaaattagccgggcgtggtggcacgtgcctgcaatcccagctactagggagactgaggcaggaggatcacttgaacctgggaggcagaggttgcagtgtgctgacatcatgccactccactccagcctgggcaacagagtgagactccgtctcaataaataaataaacaaacaaacaaataaataaaacccaggctttgcgcctacatattctgtcttcttagctactccatggggacagttttctcactatggaaaattctagctcttaagctagaactctattttattaaatttacttctaacactaagcccaattttttttaatttttgtatgtacataaaaggtatatatatttatgggatatatgagataccaatttttaacctactcatgtatttgctgtagttaaaataattgtaatgattacagagcacatctttaacaaaaagaagtaaaatgtgtaatatctaaaatttggaattgcatacattttgtttcttagatgctctgtatgctatgcccagtgttactttttaagtgagagagttgctgttgattaactataggagacttgatttatttctaatttttcctagtactgttttgctatgtagaatataaagattctgatgggtatattcagttttattcaccttgtatttgtaaacccatagaacatctacccacatctaagtgtagttggcaaacctctttagtgctttagaccttttggggttctgttaacataagtctaggccaagaagtaagtctaaacatcacctgaggtctgccctgttgctactttatacataaaacccaactgccaatgttagattttacttttttaattcttttttttgtgctcagtggcatgtttaaatattaaacgcgaggaatgttcatagacctatatagccaaattggtgtggggagaactgttatgtgttgtaatagtgcaccgaaaatgctatcaaccaataaggtagacaatatcttagaaaggagagtgaatacatgcattttgtatacttaactaaagttttattttctgtttttaaacaacagttgtgtcacttaataatttttgacaaaatgaaaatacgggttaaagggacatacaactatcttctagtcaatccatagttgattttatattgtctctaaacttttatattgtctctaaacttcatctttcactacttacataaaaatccctgtaagtattacaatttatcatacccttaaaaaatagtttatttagaggatttacttgtattacaactaaatcttaacttctcaaaacaagaaaatatatgtatttacatactgttgttagagcaaaaataacctggaaaataatagcattacaatatatttggggttgtaaagatttttaaattattaaaattattgttccttgattgttccttttttccttatatccaaaaggcgaattgtgttattattcctcttttgtatgcataaagatgggtgaaaacacctttagaacaagcagctgattttttacactgaaaaattgtgcagcagttatgttatcaggttagagactgccagttcgagatgttggatatttccacctcctattctgcatgatattttaataaacatacatgtctcccatctagtttcccagtggtttattgcttggttaaatgaatcgttgagctccctatgaagtcttctgacatgtctaattcgatacctgtcatttataaccatctttccttcctcccccaacaataacaaaaatatcataatgagcataataatcagatttgctgataaaatacacttttgacgtttctgtgattacacataacgactcccactgttctcagaagattctgttgttgcgttctagatacttatttggcttagacatctcaaaaagtacaaagaatattgtatatcatcattgacgtaattcttccacataatctggaaggtgattccagtctactatattaagctttcctgtgataccccaaacacaggttaacattatatatccagtcagttgacacaacaatctctaaattatgtccactttatgctgacaactgaccttaacggtatctttagaacataattatttcctatctttggaacgtatgaactaaaaactactttaactccaaatcactaagcttcaagaagacttgaaattctatggcttgctttttggaatttggaaatgtactgccaaggtaagtttaaaaaaaaaaaaaatgatgttctgtgtttcttaaactcttccactgaaaggcctctaatggcaaagggaagtagtgcatatctccagaaagacagggcatagcctcaaacagcagctaaaagaggaatattcttttaagtcttcaattttatctaaaaaataatgagatgtgtccaggcacggtggcttacacctgtaatacctgcactttgggagtccgaggcaggtggatcacctgaggtcaggagttcaagaccagtctggctaacatgatgaaaccccatctctactaaaaatacaaaaaattagctgggtgtggtggcaggtacctgtaatcccagctactcaggaggctgaggcaggagaatcgcttgaaccccagaggcagaggttgcagtgagccaagattacgccactatactccagcctgggtgacaagagcaaaactccgtctcaaaaaataataataataaaaaataaaataaaataaaatgagactttagccttctgcttatcatatactaatgtttactataaaaaattttccaaaatattttagtataaaagagcattcttctctaaattctacctttatctttgagcttcaaatatcctctgaaacactgcttaattcctcctatgaatataattcaaaattttaaagccagacatacatatctgtgggtgaacagcaaagattttttattgcagctataggatctgtgactacaggataaagcacagctaaataccacagatatcaaacttctttttacctggcaccaaaatttgtctaagctattcagtaatttgtattgagttcagtttagcctgtgggccagagaataaagattattttccatggagcctctagagaaaatatttcccattaaccttgcaggtttggggtggctttgatgtttaatcctcaactaggttcagttggagggtgagtgggaccagcactttgggctgaaatgttctcatagcagcccaagggcatcctgcaatccaccatctctttactcagatgaaggatcagttctgctgctgagtggtgcacatacatgaactgcaccagcctctcatcctgggataggaatattttatgggtagaatattctaaggtgtaacaaatagacttaggggattgttctgtatttatgtttacttgtattagaatatgtaccgtactgagagtcaacagacctggatttcaggtgcctctctgccagaggctagctatatgactttggcaattttcttttcaccttttcagccagttttctttgcagcaggttcatggcattggattctacagggtctctaatacttccaagctcttcagtctatggttctgtaacttgtttttcacaacagtgactttaatcaaatccttctttacttgatttttacatacatatgatattcaacatttagcacttctgtaagcttggaaccaaacttgctcataaccgtatctcagtcataattccactctgaaattttctgaaatttgcattattggtaattgacaatgctaaaagtatcacctaactttttaattttctctaaagataaacatatattaggtctggttcttcatagagattgagacatcaaaaaatagcagtttctgagtgatgctcaacgtctttacatttcacttttatgcaactataactttcacacattatacattgatttcaaacacagctggtgcccgttaggaaacaattcattttaaacagtatcaccaccttgtctgtacagcacagtagagtcccaaaacaattactggatttatatatgaaattattttttcccttttgctgctcatagaagtaagtaaagaacagaaagaaaaaaaaaaggtgctgatagattagaagcataggtactgtaaaatataatccaacaaaatataattaaagactatggccaggagtcaaggtagataatgaaagtgatagagaaatctttacaattctgtttttaagatcattatttctgaaacatttcaatgagtatttttctctttttttaagtgagtacttttctcttttttttagtgagtatttttctaatacaaagtaaagttctcatttgtatgagaactggaacaaatattttgaagtggctgctgagattccagaattactggttagcaaagactgctttgataaattcaacagaatttgtgtttgcaaaatattacactttccagagattacgtggggacagagaaagaagacatttgtttaaaaattgttctctgagatatgaacaaagaaggggaggcagttaagtttgtcaaggaaaagcatgggttttgaaatacttatattctattgaaaggaagattttaagataaaaagatgagagaattaatcaatagagccttgtctattgattgaaggcaggagggatcacatccagcaagaggaaagacaccttttgcattgttacaggagagaaagagggaaagaatagatgtgggaagtttagtggtacagtgatctgacacatcaggctccagctaactacctaggtgctacctaagtccataggtaggtcttcagataatacactgactgccctcagagggcataacagagccttagccataaatatcagatcagatgagacatcttaaacctcaaagaggccacctaagggtcattctttaatctcctatttattgtgttctctaggcttcatctttacttttaacttacatcattagaaagcaatgttctgtgttgagcaagtaaatgcaaacctaccaccaaaggccaacagagctgagaggccaaagaaagaggctaacaaatacagtttatcagaaagaattattaactagggacttacaaacagaagtgatgtctcaggtggctgcaagatggtggatccttgcaccaatctccagaaagaattctttatatagcaagcttttaatgtgctggtcacatcttcagactttcttaccaaatgaccactggggagattagataaacatcttcatgattatctatgctgcaggcattgtttaaagatgttactgagaacacctttacatgtgggagtcaaacattggttattagggtggcttcacttcaagatagaatcgctcttgccatgcaacaggctgtttccctaaaagcaatttgctttttttttttctttaatccagagactgacctttccaaatatcacaaagccagttaggcacgtcttcaatgacctgccttaatattgaccatttcacactataatataaatagcaaagctcattaaattaacatatagcacccatagagtcatcaaaacgtccctagtacaagaaaattaattgactactatattttgatgtgcatttcttttaactaaatgtgtaaaatagcaagggttcctttccagttgaaaatctcccttcaagggtcatgtgagagaaataacacaacacataaatcacaaagtgcatcccaagtttgagtttcaaaatacgttattatgttttaaagtgatttcttcccatgagcagatatctaaagaattattgtccaaaatcatgacaacaacccaccatataaaatacttgttttacccaactctctgacagcatcgtgtactcttttaactacagagaccttaacatggagacttaaaatgcaatagttttcatagatttctaacacaagttgtataaaatttatcagataagtttatttgccttaattggagtgattgggctaaaacagaaaaatttacaagtcagagttttgttcaccctccaaattcaaattgtatagccatctcaaactgccaagcagagactagtttctgcttactcactgagtgactcctgcatttcatcccttcctcaccataccttgaaaagcaagaagtagcatctagcttttgtagtattttgatttgtatcaaataatagactataaacaccctctgaataatcatagttaatgctaattacaagtttctattttcataaaattaatctatttatcacataccttctgaccagagcactgtgtctttctgtacaatagtctttctgttagcatctgctttcaaacatatatggaaatgttattacttggaatctgtatttgtgagaaaatgccaaagggtctacagtacactgttattcaatggataaatctatcatttccattcctcccaggaaactgagcaatttccactttacttaaaaagaaacttaaataacttaccaaaagtcgtatcagtgctagcatttggatttaaatctagatttgcaaagagtcttaataaaagggaaatacatatctacatgtatatgtgtgtatatgcatactatatttatatatttaatatattctatactatatatgtatactatattttttttactatatatataaaactgtggctacagtccagctatctaaaaaagataggaaaaaagacggcgttttattttttgtgcgtagttctttaatacttaataaatatttgactaaatgcattctaattacaaacaactctattttccataggtgagaacataataatgggtatagtggatatgtttcctagccttagaaatcctctgtttaagtggtaggtttttttttttttaaaagttatttggaaaccttcatattattctcaggatttggatcatgagatcatgagatcttcttataaataaaagagaaatttagggaggttccttttgtaaagtgataactttttgagtaatcttctgtaggaacgggtctttctttcttttttttttttttttttttttttttttttgagacagattctcactctgttgcccaggctggagtacagtggcacgactcagctcactgcaaccaccgtctccggttcaagcaatactcctgcctcagcctcccaagtagctgggattacaggcacatgccgccacgccctgcttttttttgtatttttagtagagacggggtttcaccatgttggccaggctggtctcgaactcctgacttcaagtgatccacccgcctcggcctcccaaagtgctgggattacaggtgtgagccactgcaccggctgctattactttcttattgctgcttaataaattaacaaaaatcacaaattttatatcttattccaggggtcagaagtctaaaatgggtcaaagtattttcaagtatttcaagtattttcaaagtatttcaacaacacagtcaaggctgtgttatgagcttggcacaaaagtaagtgtgttttttgcaattatcacccttaattaattaagagtaattataaataccgcgattgcttttgcaccaaattattacttctggaggctctaagagagaacttattttcttgccttcctagcctctagtggctgcccacattccttggcttcttttatcatcaaagccagcaatgctaatgaagtctttctcacatcacttctgcctccctcttcctcttataaagactcttgtgattatactgccttcactcagataatccaggataactttaactgtttggcaagcttaattccatctgccagcacaattccccattgccatgtaacatagcataacatgttcataggttgtaaacattaggacatgaacatctttggaggaccattactgtattgtattgtattgtattgtattgtattgtattgtattgtattgtattgtaattttttcgcccaaattaatggttttatttccatctttaatgctagcagaggattccaaagcacactgatatccatggatatagtttaaatgtaacaaagagttgtactatatacactgagaaagggaaagggatttttttttcataccaatctttccctaggtcacagtttctgaatagtagaaactaaacatattgttttcttaccaatttaatttaggatgaagtagtacaagtctgctaatcaaccacttaagttttctttaaggataaagcataaagaaattttaaaatgagtattaccatatttattactggactggctccatggttcccttgctccaagtcgggacatcatggtatggaggagattattttacttaccagagacagatttaggttttacagggtcggaattttgtggaaagccctcttgaagaaaatgaagaaataaaattatgaatacaaaattagacactaaaatgtatacttatgtgtaatgaggggggaagacaacaaaatacaaatttaaaaaaaagcaaactgcatctcacttaatcccaactaattttatccccagttgtttaatatacccatatagtagataaaacaactgcatgataaaatgcttcattcagcacttctatatcttttgactaaattaaaaataaataggtagaactcttgtcaaaattttgtcttcaaagtttgatttctaaccatctcttcatctttattcatttatttatgtcattttccctatagttcagttgttcaattccatgtgttctgggagttgtagcacagagaatatagaatttgggaccagaagaccttggatcaagtccctcctcatttgttcattcaaaatatatttattaaaaatctggtacatgccaggcactatgctgggcttagagaatacagtaataagcaggacagacatggtccttaccctcatggatcttataatgtaacaagaaaacagaaacaggatggtcatctcaaatgcattaaatgttatgaagaggtatagggccctgtgagtgtcctacacggggacttaacctagactggtggcaatgaagtctgctacttcaggacctgagggattagaaagggtgtgcaaggcagaagggagtagtgcaagggaaagaagaggacctcatacaaaaggaatattatagataatgacctatgatggaaaaggtgaaagtaattttaaggaagtaaaaaaaggtcaaaaaagtagagtatagggagaaagggaaaaagtggcgcaaaaacattcttaagagcaagttagggccagctccagtaaggctttgtgaccatgtttgcaattttggtttcatctaaagtgcagtagaatgccattgaagggttttgagcaaagatagtgcataatttgattcgcagatttaaagattttcctgtttggagaatggggctggggcaagaggaaatggcaagagtggatttaagaaaatgagttaggatgaagagaaatatttggagttgaaatatataaagacaagttaattagcttctaaaaagaattctgatatgcatgccttttcattgacaatgactcttttttaaaaaatattatttattaagcactactggaaacatacaaaaaagattgaaagcatacctcattgactgcttttgtgctgagattcatttggcttgtttctttaaccaggggtttgcattttatttcaaattgtataatgaaaacagtttccctaaatacaggcatttcaggcatcaaccaactggttaaagggataattcgggtattaaaaagctccttctcaaatcacaccaagatttctttaactgattttaaagattatttgatttagtacttggtggtagtgtgggggaggaaaggcaacctcatcccacacagcttcccgttcctgtgggcttaaacactccaagactgctgatcccagaggcaccatgccttcctcaccagattccatggaacatgaggtgtcttgagatgagtcacctggcaccaactcctccactctgggcctttccttttgccttttcaagcctggcaataggccaagccctctcttttacttctattaaaataactctattctggctttcctgtttttctgccctaatattgccagtgacatcacttgttttctctgtggtttttgcatatctttatccagctttttacactgttttgtaaaagcttactgccccttctgacacattataacgaggaaatgtatcactgggatacatttctctgttgatcaagatctaattacacctttaaaaatagtcaagatggatagccatataaaaattattccatagagcatgagtatctgaaggaggctgtactctatgtgcagtccccgcatgctacctgtgaaatgtgaatcgtttatagtctgtggcaaataaaagttatgtcattctaatctttataaaatactaatcaattgactaattcatgaaaaattctcttatctttctcaaatattggctaaaccacatagtcctccagccttacaaagtagagtaagcttctctttggcaactgtgttggtcaggctcccctaaaaacagaccctgaaacaaagatttgagtgcaagtagtttatttgagagttgatccccgggaagcacgagtattgattgtggggaaatgagacagggaaaggaagtcaaaatacggtgtttaattatcagatttctgctgtaggcaattggggttctatgggagactatgagaagtgtttcctctgagcgtgaggaaattgtaggatttatccaacatctctcatttgtccttggctatgggactgcttgcagagtcactgacttcttcaggcctgctttccttatgctcacagctgactacacaattggaaggaaccctcagcagagggttggaggtgcttccagtaagacagcatccttgcatacaggaacagtgaatgtctacggggcatagccaggataccaatagcatctgctcccgtagttttctacccagagtctccacctaattgtgtggtttggtctttgcacagaggtgcccagccagtgaggggctctaaggcacaaaagtgctctttgcccaaccacaagttctatgaggttatttcatttctgatttgttcaaatttgcagtatgtgcttgaggaagccattcttttacgttctttctctgtgccttctcttccctgctggggtcctctggcaggattttaacactgtttatattccacctttattcagggcacccaaccatggcattccacatggatatggcagccttctataaacccagataaatactccaagttctgagaggcagatacattgtttaccaaggtaccagtaggctaaacttttgaattacatagacttcatcccttgccatttcaattttaataccagtcctgtcaaaattccaaaatatcacttgcagttttgaggcaggtttagtttaacttgtattgctctaccacttatatgtctattgactatataatttagcatccaaactggaatatctttgtaagtaaaagagggccaccattagtaatatgctagaacaggcataaaccaggattatcctggttaaccatgaaaaatgatcactcttgctgacttttactccttcatgctgttgacacagccctggagggaaaaagaggaaaaacagaacactctagactctaatgtttttaattccttagtgccattatggaggtgaggaggagccacacagaaatatgctcttacggtaaaatcctgttgtttccatattccttccatgaacatgatgttataaaaagagcttaaagagcttacacacgtttgaagaagacgggccttagaatttggttgtgttttggagggttttgttttcacttgtggtggtagctgtgacacttactacttcttaactctctgaacctctcatgcatgtaaaacatagcaataccaataccagagaattatgataagggttaatggaaatgtgtgtaaagctctaagcataaggcatggtatgtaaaaagtgctcaacagaagttagaaccttttttttctaagtttttctatttccagtgttctagtgtttttctcgtggcagtagggtgggacgtgaaacgacacagggaaagcagctgaaacctatcagtgtttaataagtatatattgaaagtgataattttgacagcttaagtgtattaaatgtgtattacaagtgccaagtgagtacaacacaagagatcgatatagaaccttccccttaattgtgtaaaaaccttttaaacaaacttatcctggaaatcacgtattagccctgagctttacttctctgagatttcttacctaattggagaagctatattatattcaataaagtaggcaacatattttcatttcatttgatttaaatgtctttgttacatagtttgtttaaaatgttgtgactgtggcagttttcaaattgtggccctttagcagttttcaaatttatgacacatggcaaatttgcttagtgatgttacacttcatggtcttacaataagctataggaaagaagcactcttgacagaagcaatttaattatattctgtatatgcatgagaaggagagagtgtcggagggtgagggaggaggagagagaatgggagagagacagagaagacagttcacaggcagctcagacagatattccagccagccaccgcacaagttatttaaaccaggtcaaagcttctttggcattcagttttccccagagaacaatttaatgctgatacttaattttttcaagatagacaaggtaagtctatgttccttatatgtatttactaagttataaggggagtttgtttatttataacttttcataaaacctagccaaaagccaaatttctatatttgtctgaagctttcagtgttgtttaacagttttcaaaggtagtgttatacttcagattgcaaataattaaatgaaaatgaaaaaacataaaaattatgcagtggacgaaataattaaaaaatgatgttgcaacagtagatttatttatagcattgtaatatccaaatatgattaactttaaagctagacttacaggattttaaagctggatttgaagttgagcagtccttaaactcattactaccaaaacataaatcttaacggtatcataaagttatatttttctttaaaacaactttattcttatttaaaatttgtcagctatactgtatacaatatagcccttctaggtacaattcagtgcaaatatatgagcatttcttttggaaattcagaagtatatttactttgcattttgaaattatcagtcacattttctatttaggcttcctaaattttgccttttattttgttattttcaggcaaggaccagggaaatgtcagcttttagatccaaaggaaacatatgtgttaataatttgatgaaatttcaaaaatagatttattttgtgctttcagaaaaagtgtgggtagaagtataacctcataatttatttctagaatcattttcttattcactgatactctgatgtcacaaacagcctggctgaaattgaaagtgtacagttgtcaccactagagtttgaaaaggacagtcttacatacatatatatattcaaaaacagtgctgttctccaaagactaaacatataatctgtgcagtactatccatatttatcagtaacttcctttcttacttctttctaaaagaactgtcaatcaaaatatgatggagaatacttttgcaaatgaagggtttcatagattatccaagaagagtcatctacatgttgcttgtgttttatttatatatttttttatattctgagtaatacttgtattaaattaattcctaatttcaattttatttaataattaccttcagaagcagggcttatccgtggaataaaggtataaatgtacttaggatggctttaatacatttgtaatttatatttttgcctcccataattccaatttagtttcattcatttgtcttaaaaggaatcttaacatctatttggttttatgccatcattatgcttaaccaactgcataaaatgtcctcttatttcttatctgtgcttgttataatatttataggcagcaagaaattatttttctacctaagtaaaaaagtttcttttttcccccttatgttataaacttggtgtaagaccaacagtacagaatcagtgttgtctgatttttttttttttttttttttttttttgagacagagtctcgctctgtcacccaggctggagtgcagtggcgcaatctcggctcactgtaagctccgcctcacaggttcacgccattctcctgcctcagcctcccgagtagctgggactaccacgcccagataattttttttttttctatttttagtagagaagggatttcaccgtgttagccaggatggtctcgatctcctgaccttgtgatccacccgcctcggcctccactttgggcttctttgaagatacatacacagttaatgttataagttttagttactaaaattcagtcaccagctcactcaatgaagatgcggtaagcacgagtcttcacaaagcactctggcaggagtgtgttgaggggagagatttagaagcatataaattcagatgacaagttagataaaagggaaagattttatttaaagtttattgcattaatctgttttcatagagtagttcatggtcaattatttatttacagggaaaataatataggagttcagagagcagtatcactacagcttagggtggtcacacttggttgttgggaagatgttttgaggcaatcttaaaggattggtaggggaaacacaggaagggacatcccaagtaaatgggataaggaaaagcttggaggcagaacatgtcagctcatacagaggaaacaggatgtaaccagcttggttggagcagagggttgctgtcagggagtaggaagaggtaaatatggcaaaggtggtgtgaatctagtatgggagcacagtaaatgttatggtagactaggagagaaccagtaaaatttgaacaagagatcaatatgccatctctatgaaaattaagctgttatggttgtaccaagccaattgaaatgataagaatctcaatatgggaagaccaattgaaataagaagggaggaacaggtagaggagataaggcagttaagattaacagtcatgttttgatagtgagaggatagtgagtgatagagagcagtgcctttaccagaaatgggaagttcataggaggccggttgggtctgtatatctcagtcagattctacccagtgaagcagaatctgtaggacatgtatattaaaagatgtgttacaagaaactgccttatatgactgtgagaagtggctaggcaagtctctagggcaggtcatgagagaagggtacactagagctctcaggcaccggctaaagctgcagtctgcaggtagattttcttctgtcagggaagcctggactctgctcttaagggctttccactgattgaattaggcacactcaaattatctgaaataatctcccttacttaaagtcaagtgattgtagactgtattcacagctacaaaataccttcacagcaacacccaaatttgcatttgattgaaacccccaattaactggcaacagtagcctggccaagttgacacatcagaaaaccccaaagtattgtaaacactaagatgctggtaggattgctaggcgaaagcagccagaagtctattggaaattatgatttgcaactcatgaaagctatggagattagagataccaccctgggagttatccacctgaagagttaagaagatcttcagagagttaaggagatcctcagagaaggctgtagaacttctgcatcaaagattaattcttggaagaaaccatttttaaggggcagaagaaagaagagttaaagggaaaaagattaaagagctaagaaaagaactaaaatagcacatagtcatagttgttcctctgtttgctacactttctccctggttttccaagatttccagtggggcagggaacacagcattggttcccctgttttccacctgtatttggggtccttgctaccaaagtttcagagaaaatttgacctgagaagaggctagtggttttattgtgaactttgaaagtacaatttaagtaagattgttaaaagggtttccaaatctcaggtatttcaagacacagtagataataatgaattagaggtacaactgttatgattacttagtgaaaagaccattcgggacctttgcccccacagtcatgaatgccctttgcctttctcatctgtctagcaagttatatttaactttcaaattatagttcaagtatctcctcctcagcaggaagttctttaacttaccccaggagagatgctaacttgatcccctgtctcatctctcacttaggaatattttttacttctgattctactgaaatagaattgcttatgtggtttccttcctcccccaccaggttgtaagtgtcttttaatttttaatctacagtgcttataacaataccatttaagtgctgcatatatatttggggagtgaaggtatgaatatttgtacatgtatggatagcatttagaaagcagacataaatatttataagcagcttgtgaaaaaagaaatttggggagtactggggcttaaagagtacaaataaagagaataaagtagagaagaaaagggaggaaaggaactatatgataggaatgctgcagaggaagaggagggataccttctcccagtacagaaaaggaggagaggtttgatgtagagaagaatgtagttgggaggaagtatgggagaaatttgtcttcccatgaaagttaaagacaaacggatatgagaaaatctgccttctcctaaaaatatgagattttttatatgaaaaacttgaaattttaaaattatatttgtcaactctgatcaaaagcatttaaagcatttataacaatgaaagctattccttttctctcatatctctgtgtgtctgtgtctgtatgtgtatgtatgtgtgtatgtgtgctgtgtgtgcacatgtgtggtctggagggtctattatgggtggttcttatgcaaatttatttaattgatatttcacctatgtgtgacatccccccagccatatgctatcataggattaattacaagcgctagtaagtcaaaatatgtctttgaaaaaaattcgtggattattactctggtaaaataacagtactctcctggagaaacatgatttctgcagatgctaagatgtgtaagcaaactgtcatcctgtttttctttctagtagagcactactttaaagtgctctacttaaaagagacaactttaattaagacttgaaactttgtccatatttgaattttacagttttatgtttatttgcatatgtagttgaagtgtgaagtataccctgaaaagttgactaacttctctcccaaggacaccagaaaggtagaaggaatcaggaatcagttgaaggccagagttaggaagacagaaatgtagtttgttaggtcacgtcctgaagtgctggccagcattcaagaggaagttaagaggcaatgggcaggacccaaccagtccctgtgtagatagacgagccccttagccatagttcacctggtgccttttaaggggcaaagcttttggtaacttggagctagaagccctgaatgtgagttctaattctgccatttactggcgatgatctcagcaaaataatttaacctctctcatccttggtttcctcatccaaaaaactgaaaatatttatcaaatagtggaattctttatgaatataattattctactctgggttgcagtctaaccaggaaacagtctagatcatcttgggctcacagcaagtcagaatgtggagtattagaataaaggcagcaatcttaaaggctgtttcaaaacaagaatctaaaatacctgggccaaggattctaggcctgtggttctagaagcctgtttgaaatttctggatcagaatcagacctcataatctgtgttggacaggccataaacatgtgttggtgagaatcatgaattttcatgtcaatattatattgtgtgtggtttcttgaaaggaaaataaaaggtaaaagtatctcattcaacaattgagattgaagatatatatttccatggcatttaacctttacaaaattacccatcatttctcatcaaaattgttaatgtactcctgagataattatttttgccatgctttctagggttccatctttttaatgttttaaagatttttttatgtgtttaacttagcaaatggtaggtgaaacattaaaatctacaaaaatgctcttttttcctgagattgatttagaacttgactgcttattttctttccaaaaaatgtgaacttattgtacagagaaatacagccaaaatcaatttaccaagaatttagagtaaacagggacatacagtacttttctcccttttgtacctttgtaggggcaatttgaaggagcatacttaagaattaggtttgcaaacaaaatctccctgtttctaagaacatcggaaagaactaaaagtggtttctctggactgtgtctaatcttcagcgattggtttgctattcattgttgggaaactatatatggctgccgccaggttgcatgacctgttacataacaatttattgaagcagggagatgctaaagtcactggaggttggacttggcctgttaagagtgtgaacaaatggagtgtaacaatgtgtgtgatttctgaaacaaacaatcctgggaataaaggacacagtccactgctttcataataagacaattcttttttaaacaaaattaaaattaaagttttatctacagtaaaggtcaaagacttagaagtggaaaaattaaggctctaattttcattgtgttggtaaggagctaagtaaccacaggctaagggtttaaccttactgcaccttggattctttgatcagactttggattccgtcatttatttttaaggtttcaatgctaagtttctgatctgttctattctaaaatggatcaatttaacccaccgataatttgaatttcagggttttcagctcagtgcttatttttagtactgctttagtattgcataagccagtatttaatattcttataaatatactcctgctctaatgaaaaagtatcaggtttgtttttaccttgtgaattacagtgttttccttctcaggaagagttatcaattccacattcatggccatgttcattcattcccacttattgaagtgtggctgaaccagaatcaaacatttttgtgtgtgattaacactgaacacacctcctactcctcaaattatcaggattgtcattgtttatagtcaatttaggacaatgccttgagagtaataagcaaactggaaagaagagaggcagaaagtaattgattctgctaaggatgtcaaattaaattagagtcagtaatacgttatcattcttatctcacattttgttaacattttcattcattaaagcttagacatctgcttaggcacatttttttttctcccacagaatcattaaatactgtacttgaagtaatttagtcaattccttaagatacagtaatgcagttctgaagattggtaaaccttaatccaccagattttttcttcaccagtatactttttattgtattgcatatttcaagttcatgttcatctaatttttaaaagatgagtagtgagatgaaaactaaagacctaattttattatttattttttatttttatttttttgagttgaagtctcactctgtcaccaggctggagtgcagtggcgggatcttggctcactgcaacctctgcctcccaggttcaagtgattcttctgcctcagcctcccaagtagctgtgactacaagtacgcaccaccacacccagctaatttttgtatttttagtagacatggggtttcagcgtgttggccaggatggtctcgatctcttgacctcgtgatccgcccgcctcggcctcccatagtgctgggattacaggcgtgagccactgcgcctggccctaaagacctaatgtttttaatacttcattgtaccaattctcaccaccaaaccatttctttttatgtcctaagagttttcttttggtcttcagatacgcaactatgttttgttatttagtacctattctaaccacagtcagtggaaaagcaaccagtcagcagtttcccaaaacccttagggcacacaggctctaattaagtttttatgcataagttatattcttcccagtcatggaatgattcttcattggtgtcacacaacctgccctcaaattactaccaaggcctgtgtggccaggcctcaaattagcacaatttacattatttgcctattttctctcttgtcatatccatactttgagctagagtagatctcagtgccagtctgaaatgaagtggtcagagtattttgcgttaaaacagcagtcagcaacctttttggcacaaaaccagggaccagttttgtggaagacaatttttccatggaccagggggtaaagggggaggatgatttcaggatgattaaagtgcattacttttattatgccctttatttctattattattacattgcaatatataatgaaataattatacaactcaccataatgtagaatcagtgggagccctgagcttgttttcctacaactaaacagtcccatctgggggtgatgggagagagtgacagatcaggtattagattctcaaaaagaatgcacaacctagatgcctcagatgcacagttcacaatagggttcattctcttatgagaatctaacgctgcctctgagctgtcaggaggcggagctcaggcagtaatgcaaacaatggggagcagctgtaaatacagatgaagcttcgcccactactcacctcctgctgtgcagcctgcttcccaacaggccacagactggtaccagtccatgaccctgaggttggggacccctgctttaaaaggactagccagtcagaatcacattgtgctgatggccaccctcactctcatgagctctttgcctcatcaagtttagcgtttctgattttctcttggcctctctaattaattgatttttatctctcttcttacattttacagaatttctcctgtatttactaataactcgttctatacctactaaataatcttgatactttttttctcctctaaaagcataaattacctttctgatcactcagtaaatatataactttttttttaagttttcattacatttcctctagaataggtatgtcagctggatgttagaaattacactgatgaactaacttgtaccagccacatgtagttagttatcataaatccaaataagcctccaattatgatataactaaacagagtgaaacatttctagatgataatattttgggagagtgcagctaccttgagtagttattgcttttcacagttgaatttgctttttctatgatgacagaatctcctagagttgtatgcaggtacttctggagggagtggggcaaggtttgggtacacaagggacccaaacctggattggatttggattgctttgtaactaagatatggcctgtaggggatctctgcagtttttgctggcttgctccttgggagcttactggtgaaaatgtttgtaatctttgcctactgaattatctgccaataaaattccaaatttcccttttaataaaatggaaatggaatatttttaagttagcagtggtaaatatctctgaccacattcttgcctcttggttttataaatgcaagagaaaagagatggtttctggtacatctgaatttactttttcatgaaaattctgaagttagaaaaaagactatatgatttccaataagttttggagggactgaccctagcaccccaattttcttttaatctcttcttaaatcaaatctttgtaaataatgctttcacattctattaaaaatgtatagagaaatattcacccaattatgtgaggatcgtaaaccagtcattacaatatgtgctagcatacccttgttttagtctgtgaagtgtaagttttgctaccctaaacctctgactaccctgctgtcatcctgcctcacttccatgaggaatattttgtctgggtctatagattttcccagtccccggtgtgttaatgtgagaattgagtctccagtaagagctgttactcttccacatctgctcctttccttgtaggcccccaagtcttctgaactaaggagagaaaaaaactctataaaaaagaagaagggctgggctccgtggctcattcctgtaatcccagcactgggggaggccgaggcaggcagatatcgggagctcaagaccagcctgggcaacatgatgaaaccctgtctctacaaaatcatacaaaaattagctgggcgtagtgttgcatgcctgtagtcccagctccttgggagactaaggtggaaggatgactagagcccaggaggcagaggttgcagtgagccaaaatcacatcattgcactccagcctgggtgacagagagagactctgtctcaaaaaaaaaaaaaaagagaatcagattttgctactcatataagatttccctgggtttttaatcacagaaatttatcacaggtttttcagagtctgaccaaaactccaaacaaaattatgcaacagacttgttctaatgatagttccttcaaatggatcaaaataaaggattcattgtttacgaagcatgggacagttttacgcttgagagattctaggcttactggaggccctgagcaataaatggaagtacacattcatatatgccatttaaaagttataaaccaaactaacaaaatgccaaataaaaggtcttttagtctccttccttgacaaaaatatctttttaatgaccaaggaggtcacatttcaatttagaattctcaggctctccagagttctgtgcttgggcttggcttaccccacctcctgctgaaacctgtcacccaccttcttctgttcccaaaccttggctccgtcctgtaccttgagtgtccttgcgcacgtgttcaagctgtgtccactgccacttggaatttagggtgtgcacactgctgatactatccatcctcaggagagtaaaccctagaaagacatctgggctagctctgggattggatgcagggccattgaggcaggaaattctaggattccatggatctgaaggttagttcagaagggaacatgggctctgagtgggcatggactctgggtgggcacatcctcttggccccctcttggtctatgggacagggaaggctatatgctatgtgaagaggtaagataagaagagggcagagcaagacccttgaaagcaagaacagagtagggccccaagcagaggtttgaaggccaaactgatactatcttttcatagtgtcttgaacataatatattcttataaactgcctgtattgattaactaactcactgattccatctttgtgaatttttattttatatatacagacatatattcatcttgttcttaggaaatcatggccaatcctgatatgatcaatgtatacaactaaaagatgtaaaggaatcaaaattcctctttacacaaactttgcctttaggagatcatcaaacttattttattctttccttgtaacatttaactacttcatatgaacgatattaatgttgacttctcagtaatggtcgtgtaagttgttctaagtgtttacctcacccatccttacaaaagtatacttacacatgctgtctgcctctccattgtgaattgggaaaatcataagcactcaagaataaataaatacctgctctgctgttgtttcaaggtacattgagtcccccaacaggaaactgcccaattatcccttatcaccctaccatttagagtacctgatgctgtgattttgattttcagtgtgggggcttctttagtgataactaattacatatgccacatctctcctagatcaattgtacttctgtttcaggttttctcaagaattgctgcctatctctttaagttgccctgctgggtctcccaacaggaatttcacaatactgcatagcttctattctaaatcaaaccaccccaattttgatgaaaatccatctaatttattttgtggaatgtggtaagaagtacagagaatctattccattttacagaatatagaaaacactttttcttaattttctttgtgacctaaaaccctctcttctatctataacttgtgcagtacagtcatttccacacaataattaagaacttcatacatgtgtgtttgtttcagaatattaaactattagaaaaggacacctcagggcaggtgtagtggcttatgcctgtaatcccagcactttgggaggccaaggcgggtggatcacctgaggtcaggagttcacgaccagcctggccaacatggcaaaattctgtctctactaaaataataataataatagtaattagccaggcgtggtggcaggtgcctataatcccagctattcaggaggctgaggcagaagaatcgcttaaacctgggggatggaggttgcagtgagccgagatcatgccacttcactccagcctgggcgacagagtgagacgccgtctcaaaagacaagaaaagaaaaagaaaaggacacctctgtttattgtaccctgtggggtgccatgagggtatttaataaacggtgtttattgctagaatcttcccctctaacccaatattctctgagactttgtggggaagaaaaatttccattaactctcttattagaagaggagccttattcttccagacatgaaactgtagaggactaaaatgttctatctgaagctacagaactgagagtattctttattattcctaaaactaattttattatttcaaaaatccacactgggtttgatttagaatattatcttctgtggtacacgatagggtgctgtaacaaggcacacacagatagtgtttaatcaagactcttacataatagtcccagtggtcatcccagtctgggctgttatggcgactcctttatgtcagaggactaggcttcgccagcttcatcaaattctcctatcctagacccaaagtagctgctctagctcccaccatcatgtccccatgccttcaagagcagaggagggaagggaaatgtggtcagtccttaacttagaagataggaagtttaccagtaaaacaaatggtgagaatgaatagatattgggggcacatgtaattatctgtgacatgttgcagcttaattttacggcattctaaatagcatttggaattaaatgtgaggcccggaaagaacatgtgctttgaatggagcaaggagaattggcattattctacttgaagatgtaatctgtgcagaatactttgagatcttattctgtaacaatagataactttaaataggttccaggcactttcctgagtgctttacatgaattatctcgtttaatactcaaccctatgagctaggtattttgattcccccatttcatagatgaggaaactaaggtgtaaaaggctcagtaggctgcctgcaggcacagaactagtaagtggtagagctggtacttgaatccaggcattctgagtccagagttgcccctcaaaccacttctggtccaggctccacttggaatattagtctgcctgttgagattggataggaggaaagattccccaaaaccttgagtttaaataaaagtttttaaaaatatatattcacaatagcaaagacttggaaccaacccaaatgcccatcaatgatagactggattaagaaaatatggcacatatacaccatggaatacttgcagccatataaaaggatgagttcatgtcctttgtagggacatggatgaagctggaaaccatcattctaagcaaactatcgcaaggatagaaaaccaaacaccgcatgttctcactcataggtgggaattgaacaatgggaacacttggacacagggtggggaacgtcacacaccggggtttgtcgtggggtggaaggatgggggagggatagcattaggaggaatacctaatgtaaatgatgagttaatgggtgcagcacaccaacatggcacatgtatacatatgtaacaaacctgcatgttgtgtacatgtaccctagaacttaaagtataatatatatgtatatgaaacaatgcaataaagcatttgcttctttctaggcttcaacctgaagtattactttattattatagtcagggtggtagacagtaaggagatattctaggtttatgcttagtaaatgaaatccagcttcatctgaggtattaacttagaccaaagaagagtaaagaaaacgaatgtgaagtaaatgtgctatttttactactactgagcaaataaaatctgagcctttatcttcctgttgtcaagagttgttaataaatgatttcagtatactcgtgtaatacttcagattacttttttttaaaattgagatagggtctctctgtgttgcccagactggtcttgaactcccagactcaagcaatcctcccacgtcggccttccaaagtgctgggattacaggcataagccaccatgcctggccttcggaccacttcttatttaaggcaacctgaaaaacaagtccattccagtatttggggcttaatctcatcctcagacaatttaggtgattatttatccccacatgcttaaagtatctcaatcatcacaattattaaataacatgataaaataataaaatccactccctaaatgtgtttatttactagggctgctgtaacaaaatgccatagactggatggcttaaagagcagatatttattttcttaacattcgagaggtcaaaagctcatgatcgatgtgtcagcaggtttggtttcttctgaggctctctccttggcttgctgttggccaccattttgttgcgtcttcctagggtggtccctcttgtgccggtggcccctggtgtctctgtgaggcctgatctccagctcttataagaacaccagtcaaattggattagggtcaactttaatgatctcgttctaacttaatcactgctttaaaaggccttttctacaactacagtcacattctgaggtacagtggttagggcttcaacatgtgttttagagggacataatttagctcctaacactagaaatactttggaaacattgaagctgtgaaatcaaacaatttacacgagtgagaagttcagcatttggatgtttcccgctctcttatctggctttagccaaaataagaggtagtacagatggtatgtttcagtgtatacaaatctctttacttaaatatttttgggcagccttattaagtttaatatgaagattatttaaaacatacgaaaagccatgttgaacttgctattgtttatactttcaatagctcagcgaatggaaaaaacaaagttatgttagctaacattttgctgaaaatgtaagtgtaactgagtgatttaagtagatctgacaggcaaggctttatagtcaatcatagcaataccaggtttttaatgaaagaatagctattagccatggaagagctgaaaataaaaataaaggtcaatgttcgaacagatgaatccttttctgaagtagtatctgtaaataacttaaagtacattgtaacaaaataaaacattttatatcttttgggttagggaaatgcaataaaagtggataagtacatcactaggaaagatttgaaatattctcttgaaggaaaatatcatcaaaagaatgattccatctatctcacaaaaatactcagaatgatactgtttttagtttcttgaccactgtattctttcattagaaatatctttggaaaatgggaaaatggaaggaaaatagtggagtttatgactgataggattaacctggagaataagtgagagaaaatgaggaaaacaatgaaagccaaagaaccttgtgccattttctaaaaataatcctccaacctatgaaatttttacaagttgtacttatctggcttaggataaaatatattcaaaaaccttggcacaacacaaaaggaacatttgtgtttatttgcttaaatactaaagaaaatgatggcactattagggaagactaataaaaaattccaactatatggttaccacacattggaagcatctgacatcaacaaaggagagctgctgcatattttcttttaaataataattgttggagatagatgacaatattactatattatattgcatgtaatacaaactacacacaattgtatatgggtaaaattgtataaggaagaccaggaccttgagattattaaggatagcattaataacactacaacatcagttcaaatgatatgtcactgtgcaccctgagggccttagataaaagaccctccagtgtttacttctctggcttcacacctcactatcttcaatcaccattaaattaactctggtgattcaggaaatgtagttaactcgagggaccatactctttctcttcaggacctttacctatgctgctctcctggcttgaaatacaactatacaattcccttccaccctgcctccatccgtcctctacctctacacagagttaaaatttcctgtgaaaatctcttaaatagcaatctacagtctctcaataagtccaatactgtctgcttttacacagtttgactacattggtgctgttttgtttaaatccagataaagccattggcttgcttttaggcagcctttttttagaaatcttcataaacacaagaattatcttgaggaactgaaacaaagaagaagatttgcatttctcagctcatgatctctccagtttacatgctcattaagtggcattgcaagctgcgactcacactcactgcttgaattattctctccccttctcttcttctcttcatatcattgaatttacataacataaatacataaagttaaatacatataaaataaacccactgcacagcacttataccacatcacaatgagacttttacttgtctatgtctccttctagactatgaaatggttgatgggtttctttccttttcacacttacatatacagtattggggcacaaagcactaaggaaatagtttgttgaatgactaaaggacaaaatgaacaagtataatatactaaccacaacaattttttttaaactgaattttcaagttctcactgcggttccacaaaaagaaagaaaaaaacaactgaattttggccaggcacagtggctcatgcctgtaatcccagcactttgggaagctgagatgggaggatcacttgaggccaggggttgaagaccagcctgggcaacatagcaagaccccatctctaaaaaaaaaaaaaaaaaaaaaaactaaaacaattagtcaggtgtggtggcatgtgcctgtagtcctggctgttcagaaggctgagaggagaggatcgcttgagcccaggagtttaaggtaacagtaagctgtgatcacaccactgcactccagcctagtgatggcataatcatagcttactgtgatcttgttactgagacctagcaagaccctgtctcttaaaaaaaaaattaatttttacaaaataactgaatttgtcacctcaaaaataaaaaaaatatattatttcagaataaccaaaaaggttatacttacttgatactttgtttttgtgagttaacaaaccattattgcatttattttggacctaaattgcttaatcaggtgatactcttttattgatttttccaattaattgatggagttggatagtgtatccagttccatcagagactgctttggcctcagagactgctttgattggaagatgatttatctgatgttatctatctttatacatctctccagccgataatgttaagtctaacaatgtgtttttccctgttcatctaattattccaatctacatagaaacaagctctactaccacacatcttaaagaaaaggacaacctcccctaatactgtgtgactttccaaatactacctctcaatcacaacaaacctttacaaaatagtcataggagctgtctctatttactcacctctcattccctcttctgactggccactcctttcaggcacctaatcttactgcttcactgaatctactcctctcagtcagttatctccatgaagccaagcactgtggtcacgtctatatttttttcttactaaacctcttaagtagtaatcaacattatttttttagttcttgacacacttacttcttctgatttctgtaccattgcacttactgcttttcccccaccttaaaaggtcctcctattcagcctccttgacagtcctgattttcttctgtacctctaactgtgggaatattccaagctccattctctttactctttatgtgtatttcctccccaagttcttatatttaccagcatagattttaattgtatctgcatgtcaatatattctatctctctatctttctagccttgacctgtttctcatggtcctaacttaaaaatacatgtttactgtattccctattctatcttattactgttgtatctgaaacacctagaacaatgcctgtatcataggttcttggtgattaatgagtatttatagaatgaattaataagtcagtggatgtttctaaatataacacatatctctaaataagcaaagagagaaagagttcacctgtaaatatgacatcttttggaatactctttgagagaaagtttgcccttccggaacacgggtgaaatattgcccccagacattttggattttagtaatttttcatgtgactagagaatattaaaatgcactacttttctaatcttttttattcttaatagaatacttcagatggtgttcacaaatcaaaggtttcatgtcataatttgtagtagactttatgtctttataaggttaatgattcttcaatggatacaaataattaataacgatggcattcctaaaagcataaaagcattttctaatattgtatatattttaatggactatattgacattaaacatattacatagatgtaacacatatttgttataattacagtatatgtacatagatgcagataattatacatttgtgcttgtatagaatatatgtgctttttaacaaacttttacaaactaacttgtaaagccatatgtgaatgtatacataaaaatacctgtgtagataaccattgttctatttgcaaaataaataagaccagactttacattttcctaaaatgttgtataatggaatgattgcaagactaagatttagaaagacaggtttctaattcagcttttgctgctaactaatgtgatgttaagcaagtcattatatccactagaatgtaacctccattggggcagggattttgtctgttgtgctcattgctgtattaccagcatctggaaaagactggacccagagtaagggccgaacgaatttgttgcatgaattctgtttctccagatttacagtttccacatctataaaacaatgtttcttctaatcctcacattccaaattaatattgggacccttatgaatttaaacaaggcaaatttaaaactagaactgtttattgagcttctgcctggacctttatattgcttaatcaattgaagctcttttcatgaatatttatttatatgaataagacaacagttagatgtcagttcatctgccatcttcattcagcaggactaaaacaaaaactttaatattaaaaatattcaaattcacaaaatcaagtaaatataaaagaaaattcaataactagcccctcaaatgatatttttcaagcatttgtgtcctttacaccgtggaagctattaaagtttaaaactgctgtaagaattttgagacaccctgtagatatacctttctttaagaaaacttgatatcccaactaaaatatacaaatgaataaagattattcacttttaaagtttttcttttcagttttcattttcatttgtcaccaaatatgtaatgaacaacaatcatgtgaaacctgtgttagataatgcaagataagtcagttattgacagtctgcacttcaccgtcatctggactgccagcaacacacagagcctgagatcactggtgacagagcctctgggttggagtcaacatcgacattacaaagactggagaggaagcctggggacctgtgcactacttgcaagactgcagccctccccttcccctctgccacagccaccattactcacagccttccgtcagcaggactgatccccgcagtgtactgcttccctctttcctcatagcttgtgtcgtcacttccccctgccctgcttaatcagaccctggctccttttcaaacaaaataattcccgctctacctcatcactctctacccctctcatcctgcctaattttttccctatcagcgatattgtatcttcgtttcactgtctttcttttttttttttttttttttgagatggagtcttgatcagttgcccaggctggagtgcaatggcccaatctctgctcactgcaagctccgccttccagcttcacgccattctcctgcctgagcctcccgagtagctgggactacaggcgcccgccaccacacctggctaatttttttgtatttttagtagagacagggtttcaccatgttagccaggatggtctcgatctcctgacctcgtgatccacccgcctcggcctcccaaggtgctgggattacaggtgtgagccactgcgctcggcctattcactgtctttcttgtatacacacgcaaactagaatctacgctcctttaaagcaggaaatttctcatccatccatatatctccagcacctcgagcagtgtatgacacataatagatgctccataaatatttgtaggatagatgaatgaacaaaaaacagaatgaactaacactctaacctgaacccgccatattgttgatcctcttaactgtttctcctccagttttcagcagcacctcaccgtttagatttaatgttcctgcaatttctctagccatgatcctcgtgattttcaataactggtgttctatgcagattttattatctcatgctgtcttggataaacacttgtaattcatcttggctcaatactttggtaatatacccctggggcttacccctgtcctttaagtgagatctggccagtatgtggccatgagtggccactgctctaccatagtgacttcacaaatgaattacctctagaaaggaatcaacatataaatgaataaataccaaaactaaactaaacagcatttacaatggccatagatgaagtccctgccttcggtaagtgtgcacgttccacaatgacaagtcaagtggacaagacagagtccaaaaaggggataggaagagaattcttgagccataggtaggtaagtgggaacatccatgtgactcttggtaggagtataaatcactacaatgtttctaaaggggaatttagaaatagctatttaaattaaacagattcctaccctttcagtagcatttcaacttctagtaattcattctgtagaagctctcctataacaactggaaatatccaatagcccatcaataaagagatggtttaatgatgaaccacatagtcataaagtggaatagtgcaatctttaaaaagaataaatatatacctgtttgtgttacattatattaaatggaatgtgaaaattgcacattagtatatgtggtgtgatttcactatcaacagtttatacccctgttctagatacgaggaataacagtgaacaatactcacaatgaccctgctcacatagaaattaaattctaattggaaaacagaccacaaacagataaaggtttaatggcagatgaagcagtgctgtgaagaaaaataaagcacagcaaagggatactatacaaagcctccctgaggagacagcctgtcttgaagcagaaatctgaataaggagcaaggcaagaaagtcagaagagacaaacagaagtaaaaaaggcccagaagcagcatgcttgcaggcttgaggaaatgcagggaagacagtgtgactggagagcattgatcatatggaatgaggggcagaagatgagatgtgaggtgtccaaggaccagatgatatggcatttcctgggccacgataacaattttggattttcattttactttggtgattaatcattataagatcttgagcaggggaatgatatattcagatttacatttttaaagactcaccatggctgttatgtcaagaatattctgaggaggaaaggaatagaagcagtgacactagctgtacgggtatggcactgctcttttgagtgatgatagtgtctggacatagggttggagctgtggagaggaagaagaatgaccagacttgtgatgcattttgaaggcaaagccaagaggattcgctgatggattgggtgtggggtgtgttagaggaatcaaagatgattacaaggatttaggccttatcacccaagtgaattgtagtaccatttactgtgggaggaggatttagtagtgggaggtggtagtgtggtggaggtggggaagagttctgtcttggatatgttaatgttgaagtgcctatcagatctgtaaatggagctactaggcaattggattaatgacttcagcatttatgggaaaggttaagaccttgatgtatatttgggaggcacaagggcataggtggctttgttagctatgttaaagctatgttagagatcacctaggaagtaagtgtagaagaaagcaaaaggtctgaggcctgaggtctagggattgtctatttctaaaaatctcaaagaggaaaaatccagcagaagagactgggaagtaacaaccaatgtcaaagaaggaaaaacggagaatgtggatcacagtagccaagtgaagaagcttgtataggtataaagaaaaaatagttcccaaattactaaccattgtcttccttgagtggtgaaattatagggggcattcaatgttggcaatttctgtaacatttaaatattttgtaatatacatatattgtctttgtaagcaaaaatagcaataaaaaggttaagaacaataaaaaataaaaatgttaatgaacatactaaatgtgtaggaaggatcagcattaagttcatatagcataacctattatatctttgattagacaatttacaaaaggaatccagtgaccaaaaatgagagggaaaaaatgcagtgtttcaaatggcttatctaagagtgtatttaggtacctgctttgtaaaggttttatgtggattgaaaagttaatgtgtttatatagtagttatgtatgtaattatgtatatagagcatttttcatatattattaatgggtattatatgatactatacagaaactaaagcgaaaaccagaaatttatataggacgtatagatggaataaagtctaacagttttcctaacctattgatactgcttatacatgtaagcaagtaaatattttagaatttatttccatgctatgaatagaatgctggttagtgcatttcaaagtggctcaagaaaattcctctgagcttatcaagaactgaaatgcaaatgtatgtaattcccagtacaaatggaggtgtacaccccaaactgccagtcagaactcatgcagctgagtcaaaaggccatgaggtagctgtgtagtctttgaattaagataaaacctgttacacctaactccataatctatatggagtagaaataagtataaatattatatagtgtatgttaaagtgctgcaaaaatcatcaattaaaatactagtttctcttcatgaggattgctgatacgtgacagtaaaactgtggtatttttcaaactgggttccaaatgcaccttctccttaaaagaacacgacctgtcctttgggactattcatacacatttagtgaattccgtattaggagaaacctattagattgttcaccattatctttccacagaacagttgggtgccaaattcagattttcattgaagttgtcaccatcaataatacaatgatttcattttggctgattgagatttaggcagtcactgaaactgtggccatggcatagcatccagtggtactccccttagccaagcatactttggcaaggagcctgaatcaagcaaagtactcccttaggttactatttttctgattaaatttgtaattatgtgtaaaattaactattgtatttgcaggatcaattgatattcaggagtaaactgtctaaataaaacttagagtttcttttactctctcctgtcagagtcgggccacaaaaagttaaaaagtaccatccagagaagcacagaaacaggcatggcagctgaaatgagaaagatggtaaggcagccgagccgagagtctactgatggcagcatcaacagttacagctctgagggcaagtaagtgctgtcagcacgtctgcatggctgtggaaccaggaattgtgtactaatcagtaagataacaaagccactgagtgttactgtgcagcttctctatttaatcagaagttcaaccatccattttaaaccaccctgatggcttataagtaagtacacatggacacacctctacacctggtcattcatacctttcaaagggtgaagaaattctgagtccacatgaacaaattgatttcttgcatctaggaaagcccagactagttccttactggatgtttagtgtacaaatgccacaggtaatggactctttcatatgggaaactcatagtctgtccctgtcaccaaagtccaagttaaaatttataagtaaggaactgatttcccattttcttaattttctccaagctattttggaccctaagcttttctaagtctaacactgtcatatatgtaagttacattttcttgtttttaaaacattgctgactcatttttaccttaggaaataatccagggtctatcagcttcattatttttctgactaaaatgttttagttaattctgaaaaaatagaatacgatttttaaaaatttactcttttcgattctttttcttttttttttttttttaccatttcatatggatcctgcacaaaacctgcttcttcctatgcttgagaatatttctggtaaaattgaatttttattgaggtagtggatcttacaaataagtaattaatgtgttgttttggattacatggagattcaccacatataaattttccataattatttgttcattaccattcacattactcatataccaatttgatatttctaatttcttgtctttactggaatttttctatattgtttagaaaatttaacagaattatgccaagttactgtttgtgatattccttcccattcctgaaactagttggtctctgtttagttggtcaaatgattggcttgttatgcatgtttccagtaaggaatataagaacaaaaatcagcaggtatgaaagttacagagataaacttactgacaaaatacccatatttgatgaagtagcataaagtaatatacaaatgagacttgaacacatcattttctgatataaaaaagtaacaaataaaatttgcctccatcataaaccatttaatctcttggatttattttcatggtctctggatgggattataatctgtgtcccatttaatttccttggttaaaagaaataatagatgtgaaagcacaatggaaagagtaagtctctatagaaatatgctcattcaaaaaatgcttattgaatgcctatcacataatgagcatagttgtcattacccagtgataactacatcagtcaacaagaagagaacaggcactgcccttgtgcagcttacatcctggggctatcaggaagttgtattataggaagaaatacagattttttaaccaattaatttccattggaaccaaataaaagtctcaaataattcatctttgaatcaattaaatgtttataaataagaacttgaactatgttataacatttattcaagaaattattggccactttaaaaatttagcatgaatgttacctaatgttcatgagcaagtatctgtgtgaagtttatgatataaaaattcgcatcttatgtttttttgtcagcaacacatttatataaggatttggaacttggtatattaaaaactataactgagccctcttgaatagagcattaggtgttaaattgagagtttacacctttcctcagtcaatgttaagcctcatatgcttggctcaaaggcaatgcaaagaatcaattaaaaaaacagattgtctaagtaatatttatgtttcatgatcataattagtcaagtggaaactagtgaaaagaattctagaagatttcatgggttttttcctttggtttttatccttttgctgatagtttaatatttcctggagtgcgactgggagctgacagtcaattcagtgattttcttgatggattgggaccagcccagcttgttggccgccaaacccttgccacccctgcaatgggtaagaatcattttttttttctacaagaaaattgatgttttgtgtttgacaaagtcatttaaaatatttaaaattgtgtaatagcaatacaagtgagaagcaacattttagctacagagttactgtttgcaaacaactattctaatttcaagtgcatttttctaatttgagatgttatgaaaaaagaagtaaaattagctataaatatttgaattaccagaaaccctgatataatagatgtaaatgtaggacatgggtggcatttcacagcatggaaaaaaaaaaaaaaagactgttcagtaaagtatagtaacataactatttacctgtgtgaaaaaattaatggaattccctcacgcctacacaacttaccaaaaaagttagtattttagactcaactataaaaaagaaaagggaaggtggagaaaaacactaaaaagtactggagaacacttaagttaatctgtctgtaatcttgcagtgggaaagaacttcagcaaaatgcatgaaaatagatcagcttgaagacacaacatagtggaatttcacaatactgaggcttgatagaaaatcatgcaagcttcctaagaggaaaaataattttacaaaaaaactatcaaaaatcagattcttgccgggcgctgtggctcacgcctgtaatcccagcactttgggaggccgagacaggcggatcacgaggtcaggagaccgagaccatcctggctaacacggtgaaacccccgtctctactaaaaatacaaaaaaaattagccgggcatagtggtgggcacctgtagtcccagctactcgggaggctgaggcaggagaatggcgtgaacccgggaagtggagcttgcagtgagcccagatcagggcactgcactccagcctgggcgacagagcgagactccgtctccaagaaaaaaaaaaaaatcagattctcattgagctcttcgtattttcattggattcttcaatatactggaagccagaagactgttagcattaccttcagaattcggaggaacaagagatttccaacctagaatacaaaagccagccaaactatcaagtaattttgaggctacagtaggtacatactcggccccaagcaaggcctcaaatcattttcctcatttctaacatttctcagaaagctacttgaagatttactttgaccaaacgaactaaacgacttttcaaaattatgaactaaaaaaaaaaaaaaaaaagatggaaccaaaaaacaaatgcttcctcacaaggtaaatatgattgggatacccaggatgatagcaaaggaagaactaaagatagctgcagctaggtttcaaagcagcgttcaaattgggtcatgtcagacttcatgagataaaatctatagaatacctaatgggtttgatttttatggaagagataaacaaccaggagaaactaagatttgaactagtgaggtcttcataaaaatgtaagcaaatgcttttttaaaagatactaattaagtgtagggaaaaagaaggtctgtctaagaaataagaagtagttataatattctagttcacaaagttatgcataaggttacatagtcaaaataatataaatattaatattgggagaatgggatgacagaaattgtcaagtatgtagtaggggtaggaaggcagtgaaagagatcaaaattgaagtcaataataatatctaaaactgcaaaaaggaaaatataagtatagtgcttagaaataaggaggcaaattccagaaagtaaatcagataaaaatattgaaaattttggaagcaataatttttggaagacaagaagttgagagacaggtagaagttagttatgcataaacataacaggttttatagaacaattggggatatgtgtgtgatttaaaaagaaatctttaagaaacattaaaaggacaaaaagagaacaaaagacttctaggaactgaggtctaaaacagaattataaaactaatgaatgtctagaacaacaaagttgatcaactgaccagacaaataaagagaatccatgcctgagaaaatggaaatgattcaactaagtaaaaataacttagaaattttcagagataaagtatcatataatccacagagaaaaacaccaagagattattaaacaaaaaggaagtatatatttttaagaaagaaagttagagaatgggaaatatagtgacttaaaatttaaaactctggatgagctaaatagtatactgaacaaagcttaagatataattagctacaagaactatagaataccaccaataacatggcttatataaatttaaaaaaatcttttgtaagagaggagaattcaggatgtaggaagaataaaccaaaaagctcaaacttactctaataggagcctaaaaagagaatagagagacagtttttggagaaaaataatgatgcctgaactgttttaagaaaaacataaaacctgagagattgaaagagcacactgagtggtgaactgaacaatctgtacaaaacaaacaaacaaggaaaagcttcttcatgcaatttcaggacatcatctcaagtcatgaagaagaaaaagaagattacctaaaataaaaaacatgatggagaatttcatcagaaaactcaaatctttaagagcccagtagaaattatagaattgaaaaataaactaaacttaagaattcaatggatgagttaccagcagtttagacagagttgaggagagaattggttaatggttaattggaggacagagccataagaaagtatccagaattaattggacacataaaataatggaaaatatgaataagaagttataagaccgagcagaaaagtgaggtctaatatatgtctaattagtcccagaatagggaaaggagtataggccagaagccattgaaaatataatggttgagtgagaattattcacatgtttctagcataaaagaaaaaacaaatatttaaggtaatgatatcccaattacactgatttgatcataacaaagtatatgaatgtattaaattatcacacatacctcaaaaatatgtacatatattatgtacatattatgtatcaataaataaaaagtaaaatggaaaatagacaataaaatgtaacaataaaaattatatatataattgaaaaattttcagaactgaaaataaatatagtcatactttccagagaccctcatgaaccccaagaaaagcaaattcagcaatgctaaaaataatattatcacaaccaaatgggatttttttttcatgaacacatggttggtttaatatttgaaaactaatataattgatcacattgctgtaataaaaaagaaaaaatgaccatcttaagtatccaaaaaaatgtttgataaaattcagttttaatttatgatagaaaattatcagactgaaaatagagtggagtttacttatctgttaacgtttctacaaaacacacgtgtgtatgtgtgtgtgtatttgtgtatttgcacatcagattgtccaaattgtttaaatcttttaatataagtagcaaagacattcagaaatatgcattctgatacactactattagaagcataatttggtgcagtcaccaattggaataatatggcagcatctagtaaaaataaaaatgtagatgtgctgtgacccagcaatacaacttctaatttacatatcctcaagaaactctttgcagcatttttttgtagcagcaccaaataggaaaaccaagacccctaattggagagtagataaataaatatgacattcatgtaatggaatattatagagaaattaaagggaatgtcctagatctcaacacatcaacttggatggatatctaagaaaatattactaagtgaagaaggaaaattgctgaatgataccacttatacaaatgcttaggctggacacggtggctcacacctgtaatcccagcactttgggaggccaaggcaggcagatcaccggaggtcaggagtttgagaccagcctgaccaacatggcaaaaccctgtctccactaaaaatacaaaatatagccaggcatggtggcacatgcctgtagtcccagctactcaggagactgaggcaggagaatcgcttcagcccaggagatggaggttacagtgagccaagatcacaccactgcactccaacctggacgacagagcaagcctctgtctcaaataaataaataaataaataaagcttaaaatttggaaatttatttaagatggacagttgttaaaaaatataacctaccacaaagaatttaagagtaaatagaaagctgaaaaaacctgagtagaactataactaccagtatttaacattctacttaccaaaaaatggggagaatacacccagatattttcacagatgagttctaataaatatgaactcaagagacatgaaaattatgaaacaaatattttcatgaaataaaaaggaagggactcattctagttgctaatctaattttgtatcaaactatacatgggctacatagtgctccttaataatcaaagaaatgcaaattaaaatatcgttttaaccagattggcaaaaattaagcatttttttgatactgatattagacatattgctaataccaatgttagagtgtgggaagcaggaagagctatatttctggtgatagtgcaaactggaacaacctttctggaggagttggcagtatgcatggaatttttggatgtccatactattagatatgaaaatttaaaatcttggaatttgatgttcaaaaaataactgatacaagaatgcgtacaagaattcttataaaactgttcattataaccctatttacatacactgcactataaaatagtttatgtaaataacctttatttccatcaataggagtctgatttaataggtaatgacatgtccatgcagtagtccatacagtcaataaaatgatggtgtatgatcatgattgctgatagatagataaatagatagatagacagacaggcagagagattgatagaagtataagaatgctaggatattcaccaaatattaatggtggctttctctggataatgaaaatacatatggttacaattttttattatatactggatgaaataagagtaagaaatcttattaagtacaagaattatagaaatactttagtgttgttatagtcatttattaactaatttgcaaatctcataagaggtattaataccagaaaaaataagagaatggtttccaaatttgatttggaaactgagaaagaaaagtggattgtggagtgaggggtctaaatattagtttcttatcaaaatcatgaagataaaaatctgtagtctgttacgggctctcctttttgttttaactgcacataactgcaaagaagctgaaacacatcttgctcctttccatttgcaggtgatatacaaataggaatggaggacaaaaagggccaattagaagtggaagtcattagagcacgaagcctcacacaaaagcctggttccaaatctacacctggtaaggagaagtattcctgaatttggtgaagggactatttaataggcaaacaaataaaaacatttgctgcatttgaatttcatatgctctgttttgcatcatctgattgattaaaaaagcagtgtttctgtgttctttgatgttattaaaacggatttgggttttccttgcacagttattctttcagaaggtgttaggaagtatgttataatattttttttaaagtttagttatggtcgtttcttagcttgtgtcaattattttctttttgcacacttagaaaggcaaaagaaaaaaagaatatagttctaatcataaaaaggtaacaatgagctttaagatataaacctgcattgtaacccaagtaagtcaaagtcttcaaataactttgtatacattgagtcaaaatgaggaaaatggcagtaatggtaacatatagatttaaggaacagaatttatggagcaatggaaattttaagtaatttaaacagtcaatgggaaactttcagtaagcatctctaattctctaatagggaattctctaattaaaaaaatagttgaatttaaggaataatttcttatatgttaatatacctttgtttagctccatatgtcaaagtatatcttttggaaaatggggcctgtatagccaagaagaagacaagaattgcacgaaaaacccttgatcctttgtatcagcagtctctggtttttgatgaaagtccacagggtaaagttcttcaggtcagtaatagtttgtttggctttttacattgaaatgtctgttttacccatacatcgaagagatggtcaaacacaaagagaataaaatttggtaaagataaatgtaggataatattcttgagtagacaaaattcaaatggttagtttataatataaataatatataatatcaaaaatatttggtgggtctaatagagaacaattttattttatctctctctcttcttgtcttttctctctctatcctctccttctagctttgccctgttcccagccctcctcactcctcactagatagatagatgataaatagatagatagagatatgtcctcactagatagatagatgatagatagatacagatatagcaaacaaaacaatgttaataatagttggttgagcattgctatataccaaacatggggtacaaagaggaagagggagaggaaaagagaagtgtgcagacaccagcaaatattgagccctggtggagtaccagatgcatttctaggtgcttatatacattatttaaattttgtaactaacatgtgcaataagtatcattatccccattttaaagattatgtctgagattcaagaggtaaagtaatttcacaaaattactcagtaaattttaaagacatgattcaccaccaactctgcttgtgtaaaacaggtgaatgagttcagttgagaacctttacagacgactgaagtattagaaaatagaacctgggagtatgtgaaatggaaggcttgtctgacactagtagccaatagaagttgacctagattgtggtaatttttaatgatctaattgaaatattaatcatctaaatcaaaattggcaggcaagtcctcaaaaggtaccagctcacaattattttttgacctaccccttcactaaaaagaccataatacgaaagaaatcaaatgaatactctcattctttgtacatactttctggtacatacattccatggtatactgagttggattgctcatcttgccctcctaaattgcacaaattttaatttttagatttttatggtcctgtacatcgctaattagatagtagttacacaagaaaggtgttgcattcatataaaaatactcttatgtatttatttctttaacatggcttatgtagctaatactcctcattgactaggaacacacaatccttcattccatcagactaaaattattgtgaagtgtctatgagcaccttaaggttagtgtatcttcttatctgtgccttctccttggtgatagttgtattcattattcttttcctctgcttcactgactggcccacttttacagcatagttgctttgagcccttcgaatgtgaagcagagagaagtccaggtaatgttgcatttctctatctctgcaggtgattgtctggggagactatggcagaatggaccacaaatgctttatgggtgtggctcagatcttgttggaagaactcgacctgtccagcatggtgatcggatggtacaaattgttcccaccgtcctcactggtggatcccacactcactcccctcacccggcgggcttcccagtcatctctggaaagttcaactgggcctccctgtattcgatcatagtgaactcataccagagtcattccaataaaactctacttttcaggataataatctgaaccagatatttcatgatcgaaagcattgttggagacagacaatcaacttgtgttttgcctgtagtagtttttcaataatatgtcccaattgttatttaaaacatggcttcatatgacagaacaaggcaatctatcaaatttacaggaagaatcaacatgctggtgagagtcactgatgcttctaacaaatagaaaaagaggaaactttaaatccacgcatacacgtacacacacacatgcacacacacacacaccaaattgaacaaactggaaactctcactctgtgaaaagttgtattctacacatttctgcacagaccacaagcagtgttatttccctgatgtttgagttgttttgttcttttgtgtgttttgtttatttgtgtgttgtttgttggttttcgtttcttgagtttttgttttgttttcaccacatctgttatttccactagtttttttttggctgtgtcatgacaggcctcatgatgctaacagagattcttcccttcttttttccaaaagcaccaaaaaaaagggctgaagtagtctctgtagcatctccccaaagtgttaaacagctacataaggtgaagccaaggaagggtttcactagctttcattttataattatttaaagtcttatgtgtggatacccaagagacaaaaagttatcttccaaaataaataatcacagaagtacttttttaatgaagagcctatctgtttgcattctagaaaattaatttatggtttccattgttttgcatggaagacttttaaagaagtcaatctgcaactaatgctggggactaaaactaactgcataattgtactttgaaaacactccttgtaatgcctttttcttcctgatattaaaaaaatgctcatgtgtataaaccatactttgacttcccaaaaatggtgactaggaatggatttgagcctaagacactttgagctatgcccaggcttctcagccatacctcagtgtagacacatccatctgccctggaaagagcatggtatgagctgttcaatattccactggaaattccagttgaaatattctgcactaaactattgtttttattgaattttagtttacatttctttgagattgatgcaagcacaaagcttgattttttaatgcaaagtatcttactttttggggggaaaataaacaaaatgaactttcaatttgcattttcatttagtttctcttggccttgaatttcccttgtgacattctgtacatgtgctacaaactgcagtctctgcaggtgcattgatatgttctccctccttttatgagtcactccacttttgtgattacacaaatagagcagcatgacttggaactgttcagagctgcatgcacattttgtaaaaaaaaaaaattttaaaaagaaaagaaacaaaaggttatttaataatgtatgttagttccacataggccagcttgtatgttgcatgtacttgtacagtttgcttgttaattactataccgaaataaccaagaaatctaagccatccacttttgttatagacattttgcaggttttagccagactcagtctctgggtctgtggtgaaatgtctatagatggactttattttttaccctccggaaaacgtgatgtagtacggaccaaattccttctaataaatattttggtgtagattcctactgtggggctgtaacacatgtagacactgtgtacacactaggttttaattcatagacatactgcctgcaccaagtgaattatttattattatttacacatgccagaattatctgcccatcattccacagggcacagattgaccactgctcaccatgctgagtaggaggaactgaagcattggtgcacttctactagattccgttctgtcttagtggccaacaatcaactgattataattgggtagtatctttctattttgaccacttgtcttaacactcccctgtgcttttaaatgaaattccaattcatgtatgtaaacatgtttaataaaatttacttttcatgtcagtcagtagccatatgtgttctatgtcttgccagatttccattgtgggttctatggtgcaaaatgggagccaggccatgggaaggggaggctggggtttgttgtctgctgcgggcatttgacttgacttgtcactgcactatattatgtcttaatcgatggcccaaagggtactttgcatcacatacaagttttcacttcgtcagcctgtctaagtgagcacatgactatacttctgaaaagtggcattattaaaaataataaatctcagtaagaatcaaatggaaggttgttttctgctgctgtttgaatgtgctaataaaagagacaactctattg

SEQ ID NO: 759 - DNA, 33121 bp, Homo sapiens
cgaaaatatttttccttttaatgtaaatattacaggttcattgcaaggaaaaaattaacttaaaaacacagaaaagaaagtaaaaaacaaaaaattgatgaaccactaaaacagaaataaccatcattaattttttggagaccatcctttcatctctctcaaaagttcacataattacataatattacatttacagttttataccataaaggcagcatttacatttttctgtttttacagtctccccttcccttatctctacttctccttttctcactcccctcaaggtaatcaatattaacagcctggtgtatattcttccatacctgtctccatgtgcatctaaccacacacacacacataaacacaaaataaatgggtgtgattattttaacaaaaatgatatattgtatatatacatttgttataaagcaattatttatcaatacattgtggaaatacattgaaatcagctagcatagatataagtcgtttttaaaattactctcacactgttccataatatgggtatgtcacaatttatctaaccagttccctattaatgggcattcactttgtttgcagttggggctttgcccccctctacaaacagtacttcaacaaacatgtttatttacattcttatgcattgatgctgcttttatttctaacggacagattccaaaagtgagactgctgggtctaagagtatatatgttttaaatttttaaacatatattgttggactgctggtggaagtatgttacacaacctttaagtaatagtacatggtttcccaaaccccaatagctagcaaaagatctcttaatttttgccagatccatgaaggggaagtttcatctcactgagcatttcaatttgcatttccctgagtgctttttaggttcaaaatattttcacaggataatgatcacctacagttgctctcctatgaagaaccatccagtccagagggattaaagacttaagtgtaaaaaataaaatcataaaaatcttaaaaacacatttaggatactacgtataacctagggattaaggagatctcttttaagtaaaatgagtaaaataaaaaatctaaaaaggaaatgatacaaatattttcctataaaaatgttgtgcattactataaagtataaagacaaatgctagattaagaaaaacatctgctacataatgacaaaggattaatatcaaaaatatataaaaagcacctccaggtttataagaaaagacagataaatgaatagaaaaataggcaaatacatatataggcaattaactaaagataatttgttaaatgagtaaagtatgaaatctggatgaacactttcatttgttcattattttcctctagtgagagtttccttataacttctaagatttaatattattaaatgatttcccacataattgcttatagtttctctgtatactttctgataaattcctaatgaagattttcctatattcataaaatatagtttataagattcatcttgtggagttgacatctaggtgaatgacttattgttctttatattaactgagtttctctttgatgtattctttgatgtacagtaaggctcgaactactcctgaaggcttttccacattcattacatttatagggtttttctccagtatgcatcctcaagtgtacagtaaagtctgagttagttctgaaggcttttccacattcttcacatttatagggcctctccccagtatgaattctctgatgtagggttagctgtgatagagtaatacaaccctttccacattccttacaggtgtagggtttttctccagtgtgtgttctccaatgcactgtaaggtaagaacccctcctgaaggcttttccacagacatcacacttatagggcttctctccactatggattttctgatgttctgtgacatgtaccatctggctaaatgctttcccacagtcattacatttaaatggtttctctccagtatgtgttctttgatgtgtattaaagcctgagttacttgtgaaaacctttccacattcattgcatttatagggcttctctccagtatgccttcgttggtgcacggtaagctgtgatgtattagtgaaggctttctcacattcattacatttatatggtttttctccagtatgggtcctctgatgtacaataaggtatgatttagtcctaaaggactttccacagtcataacatttatagggtttcactccagtatgaattttctgatgctccttgagatttaccattttggtgaatgccctctcgcagtcagtacatttatatggtttctctccagtgtgaattctctgatgtacagttaagtgtgattttattctgaaagactccccacattcattgcacagataaggtttctcttcagtatgaatacgctgatgtataattagagaagaagaacgcatgaaggcctttccacattcagtacatttataaggtttctctcctgtatgcattctgtggtgtacagtaaggcatgaataattaatgaatgctttcccacattcattacatttatagggtttttctcctgtgtgaattcgctgatgttctgtgaaatttgcgatgcggttgaatgctttcccacattcattacattcatagggtttttccccagtgtgagttcttatatgtacgataaggcttgaattacttctataggcttttccacattcgttacatctaaaaggtttctctccagtatgaatcctctgatgcacattaaaaattgtggtattcttaaaagacttcccacactcgttgcactgatatggtttctcttcagtgtgggtcttctgatgtacactaagatatgacttgttcctaaaggctttcccacaatcatcacatttgtagggtttctcaccattgtgagtttcctgatgtcttgcaagttttgatttatcactaaaagctttcccgcattcactacatttatagggtttctctccagtttgaattctctggtgctgattaagacgggcacactggctaaaagatttcccacacacattacactgataaggtttctctttagtgtgaattctctgatgtaccataagtgatgaagaagcaatgaaggcctttccacattcattacatttatagggtttttctccagtgtggatttttttgtgctgactgagatatgaaggctggctgaatgttttcccacattcattacattcataaggtttttctttagtatgagttctttgatgttgaatgagcaatgatctataatgaaaggccttttcgcatgtactacatttgtagggtttttccttattattggattttttccccaaagttagttctgaagtctgccttatggctttgctgcctttcatctccttgcaaattatcttccccaaatgggtatctgtaatcaaatttaaattctctgtgaaattttcctcttgtgtttggcatctgctgtgaagctcttctgtggcaatgcctggttctggaataagaatagattcaaatctaaagcctctttgactagtgggagtcttcttgagtggaattattctttgactcaaatgattctcctgattattttgtaatctcaatatcctatcattccatttccataacccttccattctggaatcccacagaccattctctgtaagtttctctagtatggcctcctgtgataaatcttcagaaatagcctttgttcgtgtagccttcttggttgcaggtttgggctccatgtctggggcaaaaaagagaaaaatcaagtaattcctttcctaagctggggcaatctcactaaacagaataataaaagcaataaatacatggataatgaatatatggttttaattgctttcacactgacttgttttttagtgagaagaaggtagggttaagggaggctggtttagcaaaaactaaagtagcaaattcaatgaaactttcccgttaaaaaagtccattcagctgggcacagtggctcatgcctataatctcagcactttgggaggccaaggtgagagaattgcttgagcttaggagttcgagaccagtctgggcaatatagcaaaaccctgtctctacaaaaaaaaaaaaaaaaaaaaaaaaaaaaaaaaaattagccaggcatggtggtgtgcacctgtagtcccagttatttgtgaggctgaggtgggaggactgcttgattctaggaggtggaggttgcagtgagccaagattgtgccactgcattctaccctgggtgacagagcacgactgtctcaaaaaaaaaaaaaaagcccattcatagtttagagccaactattttagatggtattcttcaacttttgacaatctcaaaaactgtcatacttccttgctttctatttactccacaaaccagactttagtccccaatcacactttctatttgttttgttttgttttggagacagatacttgctgtgccacccaggctagagtgcagtggcatgatctcggctcactgcaacctccacctcctgggttcaagcaattctcttgtctcagccttccgagtagccgggactacagtcatgtgccaccacgcccggctcatttttgtatttttagtagagacggggtttcgccatgttggccaggctggtcttgaacttctgacctcaggtgatccacccacctcagcctcccaaagtgctgggattacaggcctgagccaccatgccatgcctggcctctatttgttctcatttttgattgactagctttgttgtgagggctttctcaaattcactggcagagtagtttattcaagtctttgtacataccttttaataaaacttttatggaaaaaaaactttgattttcaaaaagaactgaacaacaaactagtcaaaagttaatatttatacttactgatatttcaaatagtggtaattattgtttaattaagggtagattttgcaacttttttatggccctaagaacatttctgacagtttgtcaaaaattcattaaaaaaattacactgtgggatactggtcttacaatgtgtttgtgtatgcaatttaatattttatttttaagacactttaatgccttttaaaacttgtaattcattttcaggtaattatgcctcaatatttaaatataagttcaataaaaactcttgtccatgatagaatggttttatgatttttttttttttttaatttttgaggcagtgtctcgctctgttgctcaggctggagtacagtggcacaatctcagctcactgcaacctccacctcctgggttcaagtgattcttgtgcttcagcttccgaagtagttgggattacaggcatgcgccaccacatccagctaatttttcttatttttagtagagaaagcattttgctatgttggccaggctggtctccatctcctggcctcaagtgatccaccctcctcggccttccaaagtgctggggtttcaggcgtgagccactgtgcccagccaattttatgattttaaaacccacttttaagcagtatgatttgtctatgttattttacttttataaaatttaaattaatattttgtcatgctgttgctatttatcattcttttacttttaaatagttttaattagtttgagcatattttttgctgtcataggatattatattgccagtatctgataaaaaaaaaagtttgctctcagaaaaaaagctataaggctgggtgtggtggctcatgcctataatcccagcactttgggaggatgagacaggaagactgcttgagcccaggagtttaagaccagcttgggcaacacagtgagaccccatctctataaaaaattaaaaatgagctgggcatagtggcacacacttgtagtactaaatacttggaaggctgaagctggaggatcccctgagcccaggaagttgaggctgcagtgagctatgattgcatcactgcactacagcctgggtgacaaagtgaaaccctgtctcaaataaataaataaataaatgaaggccgggcacagtggctcacgcctgtaatcctagcagtctgggaggccaaggtgggcggattacctgacatcagcagttctagaccagcctggccaacatggtgaaaccccgtctcaactaaacacaaaaattagctgggtgtggtggcacacgcttataatcccagctactcgggaggctgaggcagaagaattgcttgaacccaggaggcggaggttgcagtgagccgagatcacgccactgcactcagcctgggagacaagagagactccatctcaaataaataaataaataaaaaagaagaagaaaagctatataaaacatatctatagcaccaatttggaattcagaaactaatattaaatttaaaaggtcaaaagaatatgaagttggaaagcagaaaaatttgctgcaaaatgcactaaaattataaaagcttagagtacataaaggttgttgttatattagtaattagaaattttcttcaataaatttatttgtagaaacttaatttatatgcactaaattctcatctttcttgagtgaaagtaaaatgttactcccagacaacaagcataaaaaacagaataaaaacttttatatttgagaggtctgcactttggggatgtcagaggaagtcatttggaccaactttattgctgagaacaatttgaaatgttggacaaaagaacagtctgtttgaaagcatctgaaagctagaaagacttaacaaattacaaggagaagaatgaaacccagaaaaacaatcctggtatttggtgccattttccccttcaaatgcctgttaattctctaagaaatgactgagaggctgaataagtaagcagaactcttaataaagtcatagggcaagaaagacagagacggatttaggtccattaaggaggacaattctggaacaactagggtttggctggaaccttaaggtgataagccctacaaatagaacgactaagaaatagatcggctggctgaaggactaaaacccacctcatttaaatttctcattgaattaaagtgaatgaagattgttatagtccctagcctagcagtctggcaaaagcaaacattaatcctctgtgggaaagattacataatctagaacctcctaatattactatagattttcatagtcaatgcctgatacccagtaaaaaataacaggcataaaaggagaccacgctgggcatagtggctcacatcttgtaatcccagcactttgaaaggccaacaagggcagatcacctgaggccaggagttcgagaccagactgggcaacatggcaaaaccccatctctactaaaaaatacaaaaaaattggccaggcatggtggtgcatgcctgtagtcccagctactcaggaggctgaagcaggagaatcacttgaacttgggaggtggaggttgcagtgaactgagattgcgccactgcactccagcctgggtaaaagagcgagactctgtctgcctcccccgaccccaaaaaaaagggagacaaaaatcaaaagtcacatgggaaaaaaatcaagagagaaaacaaatatacagaaacagatctaaaatgaatccaaataattgaggcctcagacataaactttaaaataactaggataactatattcaagaacataagattaacaatctcacaaagatttgtaaagtataaaataaccaaatgaaaattctagaactgaaaaataaatatagtaacttaactcaaactatgggctaagagcacaatagagacagcacatgagagagttagggaaatggaagataggtcagtacaaagtatccatactgaaacacaaaatgatgaaaaacttgcaaacgttagaaaagcagaagagacatccaggatagggtgaaaaggtctatcacagatgtaaccagagtcctagaaggttacaaagagaagtgagagagaatggacagaagctaagtcaaagaaataatgtcttagaattttccacaagagataaaaaaaaaaaatcaagtcacaagtcttagaagccaaatgaatcttcagcatgagaaatatgaagaaaactatattaaagtacacagtagtaaaaccgttgaaaactaaactcttaaaagcagccaaaaaaagagagacagggaagggcacagtggctcacacctgtaatcccagcactttgggaagccaagatgggcagatcccctgaggtcagagttcgagaccagcctggccaatgtggcgagaccccatctctactaaaaatacaaaaattagctgagcgtggtggcaggtgcctgtagtcgcagctactcaggaggctgaggcaggagaattacctgaaaccaggaggcagaggttgcagtgagccgagatcacgtcactgcactccagcctgggcgacagagcgagactccatctcaaaaaaaaaaaaaaaaaaaaaaaaatctgtctctctctctttttttttttaaacagtgtcttgctctgtcacccaggctggagtgcagtggattggattacaagtctgtgccacaacgcccggctaatttttgtatttttagtagagatggggttttgccatgtttcccatgctggtcttgaacgcctgaccccaaatgatccacccacctcagcctcccaacacctggccaaagacagatagatgtcctttaatgagcaacaattagatcagaggttacaaattataaccaatttggcccatcatctgtttctgtatagccagcaagataagaatgatttttatatttatttttatttatttatttacttacttacttacttattttgagaccgagtctcactctgttacccaggctggagtgcagtgggcaatctcagctcattgcaacctccgcctcctgggttcaagtgattcttgtgcctctgccttccgagtagctgggattacaggccagtgccaccatgcctagctaaaatttgtatttttagtagagacggggtttcaccatgttgcccaggctggtctcaaactcctggcctccagtgcctgccttggcctaccaaagtgctgggattacaagcatgagtcaccacgcctggccaatttttacatttaaaatggttgaaaaatatattaaaagaatgtgagacattaaaaatgtatgaaattcaaatttcagagtccataagtgaagttttagtggagcacaaccacattacttggttaatatgttgcctatggattccttggtgctacaatggcagagtggagtagtcacagcagagagtccttatgatccaacaaagccaaaaatattgctgccctgccttttatagaaaagtttagacagatggttcacttctccacagattgtacataagacagaaaacaataaatgatacctttgaaatgttgaaagaatataactgccaatctaaaatttcaaacttaccaaaaatatcctcccaaaatgaaggccaaatgaagatatttttagaaaaaaaaaagagaagaggctgtgcgtggtggctattgcttgtaatcccagcgctttgggaggccgaggtgggtggatcacctgagatcaagagatccagaccaacctagccaacatggtgaaaccccatctctactgaaaatacaaaaattagctgggcatggtggtgcatgcctgtaatcccagctactgaagaggctgagcgagtagaatcgcttgaacctgggaggcagagtttgcagtgagccgagatcacgccattgcactccagcctgggcgacgagagtgaaactcagtctcaaaaaaataaaaaattaacaatatactaccttaaaaataaagacaaaaagtacaagaatacacagaaagtgaaagttagcagatgaaaaaagatatactatacaaataacaaccaaaagaaagatgctgtagtaatattagtatcagacaaaacagattttaaggcaaaaacttttaagaaatgagatacttcataacgacaaaagccaatttaccatacagataacaattataactttgtatttacataataacacagcttcaaatacagaaagaaaaaaattaaatgaactaaataggaagcaaatgtatagtctcactagcagactttaaaaaatctttctcaattgatagaataagctgtaagtatacagattttaacataattaacaaacttaatctcctgacacatctagaaattgtactcaatactcaatacctacctataggctgtacattttttcaagagcacaaaatgtttacaaaattctgcaaagactgacataattcagagcatcctgtctgaccatagtagaattaaagtcaacaagattgctagaaaattcccaaatggcacaaaattaagaaaaacatttaaaaataacccaaggataaaagatatcacaatagaaattataaaatattttccactcaaaaattatgaagatgctacataaaaaagtgtgatatagttctgatagccctaaacaattagaaaagaagaacagctgaaaatcaacgatctaagtacctaattcaagaggttagaaaagatccacaaattaagctctaagaatggaataaaataataaagaacagaaagtaataaaactcaaacatacaagaaaaaggactaaaaacagtaatgtttttaaaagccaagtaatgtcaggcatggtgactcacacctgaaatcccagcaatttgggaggacgaggtgggaggatagcttgagcccaggagttcgagaacagcttggtcaacatagtgagaccccttcctctacaaaaaataaaaatcttaggtgtggtggtgtgtgcctctactcccagctatgtaggaggatgaggcaggaggatcacttgagcccaggagtttgagactgcagtgagctatgatcacaccactgcattccagcctgggtgatagaatgagaccctgtctcaaagaaaaaaaagagtcaagtaagattgataaactctagcaagactgagtaagacaaaataaagaaaacacaaaaaaccagtatcaggaataagaagtggcacatcacttcagatccatacaaacatttaaatgataaaccgatagtatgccaataaattttaaaattagattaaacggaacaatccctaaacataatttgctaaactgaaacaaaaagaaaaaggaaatatgaacagtcctaagtactaaaggcatagaggctataattaaacacttttcccaataaaagcttcaggccaagatggcttccctggtgaattccactaccataaaaaataactttccctctctcacaattttttcttccctcaccataagctaatgatcttgcctcacattttagaaactatggcagctatcataatagtggcctcaatcttcctgccctcaactgacatgcaggtgcacccatcttctccacctttctcagtattacaacacaggaggtgacctctgtacctattcaaggtaaatccccctttcctttctagattttatctcctttaaccctgtcaaacactttagtccttcgtctttgtcttgcaacatcaatgtctctctctccattaaggcaatcctatcagcactcaaacatgtcatagcagctcccatttcaaaaataaaacaagtattttttcttgactccattctttcctttagccactgctccatttctctttccctcttcgtaggggaaaaaaaatccctctctaaaaagttatctaaaactatctctaatgtctacttttcactcactcttttaagtataaataatatctgatatataaaaatacgtaattcatgtgtggattgttcatggcatcataataaaatgaatgcttaaatgaaccagaatctatttctttccatctccactaccatcaccctaatcaaagttactatcatctcctggatagactattgtaacaaccttttaacttactgcctgctttatgcctcaagttcaatctctataaacagggttattttctaaaaaccctgcagtagaatctctccatgctttggaactcacttagatcatctacaaagccctgcacaggcaggctgctacatctctaatcttattctgtaccagtttcccctcactttagtcacagcagcttccttttgatttccagaacacatggcattctctgctgtatcagatcctttgcattgttgttcccttagcctggaatacttctcttttcctcttccccttactgttttcttcttctgacccttcaggtctcggcttaaatgtcacctcttcagaagctcccctgaccaccctgtttgaagcaggtgtcctcatcccaccccagttactctttcttatcctccaatttatctcatagctgggaggtatggcaaccaccattttagtttgtttttatttgtttgccaaattatctatttctcaaaatttaatcttcatgaaggcagggacctggtccattttattagctgctatagcccttgtacctaagccagttcacagtatatagatgtataatattgattaaatacatcaatactatattttgattctcaactgcttccttgtttgtattagcaattagttaaaaacctggaggagaggtggtgggttcctccaaagtttctgtagccttgcaggtgaagaaaactaaataatgagtaaataagtttgccttaagagaaatcagtggggacccttatggaagcattttcaggtaaatgagggaagaaatgtcagataatgaaacaaatgagaaacatgaagttaactggagaagacagacctgaaagggatattttatgcaagtttgaatgaagaagaaataaaataataattacgaaaagcacgtccccaggaaagcagaataggatgagatgtttcccaaaagtggaggacagagagagagggagagagaagatgggggtgagagggacaggcagtgagatgggggatctcttcctctgagacagcgttgaacaaatatatcttcaaaattatttcagatgttctggtgaacatccccctatagtctgttacttcaaataaatcccatcttcttggttctgtttaactcaccaggatagggaattcttgaaatttctctcaccgtcacccatggtcctttcccattctccaaatgagatatcatgtctggtttggaaactgcaagccctgtccagagaaaaataaataggatttgattggagccatgagcaagaactcctgccaaattcagtctcagttcttaatcttctgggcagaatgaccattacaggaagttctagagctgcactgtctgatacagttgccaattgtcacatatggctatttaaatttgaatttaaataaaatcaagtaaaatctaaaattcagttcttcagatggactagccaaatttcaagtgctcaaaagccacaagtgactagtacctgccatattgtacagtgatgttttagacaattacaaagacatctcaaaggaactcaatgctatgattctggtttggtgggataatagattgtggaaataaactgagtttagaaagaaattgaatacatttgtttctttcttctagaggtactgataacttccatttaaggcagtgactagaaaaaactttggtccaaaatctgtggggttgtcaacaatctccaagattccagtgaaatgtgtgtttcttactctacaatgggcagatcatgtagttaagagtgaggaatagcataacccaacaatgtgcccctaaaatcaagtacttcagttaagtactttagaggccctttatctttggcaaacctggtcaaatgggcagatcaatcaacacagaagagaagttatccttacccagggagaccagattcctgtaattctctagcatcacatccttgtgcaggttcctctgtgtagggtccatcaacctccactcctccaatgtgaagtctatagccacatccttaaatgtcaccgattcctaaaacaattacattgtgatcacttagaaactatacaattagacttgttaggcagaattatacataaaaaactggggaagagccccagaaaccagaatcaccaaatgatcatgtaggtcaaccagttcatcctttataggatgtataaatctctccagtgacaagaacttgaaaccataatatgctgcctatatcatcttcagagtttcatctgatagcagaatttcttttcagaccaagtctggcttcctataaattataaatattggctccactatattatctggagtcaaacagcacggtttcctccttccctagaaagtatttaaaatacttgataacagccagcagtttccatccaaatcatctttcttccttaaaaccctggcttatctaaaatatcaattttctttcagttctaatctatagactatgacttactaaaagatacattttatcatttgtattgtggatatagaatattataagctttctctttgaaaaagaaaaataaaaaaaatcgaggaactttgggtaagttctttggtctggatatgtatatgtattaaaaaatggaagaacaggccataaacattttcaatgttacctatcggagaaaagagggagtagagcggactggaatgacagctagactcctttgaatatttgttttgtagacttgacttttgaaccatgtaaatatattataaatgaaataaaaaattaaaaaaaaaatccctgaaaattaagagtaacatgaaaccagctggtagcatactcactcattagagaggaactattttgagtgactttgaaacagtaatttttctgtatacattgcacaagatataccctgagaaaaataactgcaaaataaaaacaaaaccacaatgttttcagtaaataatcatattaattacagtgacagacatgttattgtttaactgctgtgcgtgtagtgcttgataaagcaaattagcatactgacatcattgataactaatatatttggcatgggagaaagaagatagaaatgtaatattgatgagatgaggttaaaaactccatagttctgagtttgaataggaagtatcactagagattcatgaagcattttaagagaaaaaaaaaaaaaaacacatttcctagcttcagccactgaaaaggcccagaaaccataaccaataaggtggcactatgcaagccagactgtgggctctaaatattacttccccctaaaaggaaccagggcctagaataccctgacatattaaaaagcaaggaagctatgaaagactactagggtcatatctaagacacaggagacaacttgaagaggcttccactggccaatgatatgacaatttgagcatcaataaggataataactgcaatggatttcaaaagcatctaatacagttacattcatgatacattattttaaaaatctcatctattatctttggagaatacctggaaactggtaagtaaagagaaagaatcaaacttttgtcctttcttacctatgcaaagtacatatagtttgtattgtaatcaaacataattaaatagttgctgagggaaggtttctctttatggaagtattttagctaatgaatgaagaaggaacaaaagaattagaacatcacaatttgcaactactaatgaattaaagaatcatcagcagctgctaacataaaagaaaggcctcagttagctagtatatgtcttctagtggtatataccagcaatatgcaatgacattgctgaaaatattttaaaaatcaaaaatctcagggccgggcgccgtggctcatgcctgtaatcccagcactttaggaggccaaggcgggcggatcacgaggtcaggagatcgagaccattctggctaacacggtgaaaccccatctcaactaaaaatacaaaaaattagccgggtgtggtggcgggtgcctgtagtcccagctactagggaggctgaggcaggagaatggcatgaacctgggaggcggagcttgcagtgagccgagattgcgccactgcactccagcctggtacacgaagagagactccgtctcaaaaaaaaaaaaaatcaaaatctcagccgggtgcagtgttgaataggagtggtgagagagggcatccctgtcttgtgccagttttcaaagggaatgtttccagtttttgctggttcaacatgtgcaaatcaataaatgtaatccagcatataaacagaaccaacatagtgttggaagttctggccagggcaattaggcaggagaaggaaataaaaatcactagcattcttatacaccaataacagacaaacagagaaccaaatcatgagtgaactcacattcacaattgtttcaaagagaataaaatacctaggaatccaacttacaagggatgtgaaggacctcttcaaggagaactacaaaccactgctcaatgaaataaaagagatacaaatggaagaacattccatgctcatgggtaggaagaaccaatatcgtgaaaatggccatactgcccaaggtaatttatagattcaacgccacccccatcaagctaccaatgactttcttcacagaattggaaaaaactactttaaagttcatatggagccaaaaaagagcccacatcgctaagtcaatcctaagccaaaagaacaaagctggaggcatcgcgctacctgacttcaaactatactacaaggctacagtaaccaaaacagcatggtactggtaccaaaacagagatatagatcaatggaacagaacagagccctcagaaataatgccacatatctacaaccatctgatctttgacaaacctgacaaaaacaagaaatggggaaaggattccatatttaaaaaatggtgctcggaaaactggctggccatatgtagaaagctgaaactggatcccttccttacaccttatacaaaaattaattcaagatggattaaagacttacatgttaggcttaaaaccatgaaaaccctagaagaaaacctaggcaataccattcaggacataggcatgggcaaggacttcatgtctaaaacaccaaaagcaatggcaacaaaagccaaaattgacaaatgggatctaattcaactaaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaccccatcaaaaggtgggcaaaggatatgaacagacacttctcaaaagaagacatttatgcagccaaaaaacacatgaaaaaatgctcatcatcactggccatcagagaaatgcaaatcaaaaccacaatgagataccatctcacaccagttaggatggcgatcattaaaaagtcaggaaacaacaggtgctggagaggatgtggagaaataggaacacttttacactgttggtgggaccggaaactagttcaaccattgtggaagtcagtgtggcgattcctcagggatctagaactagaaataccatttgacccagccatcccatgactgggtatatacccaaaggattataaatcatgctgctgtaaagacacatgcacacgtatgtttactgcggcactactcacaatagcagacttggaaccaacccaaatgtccaacaacgatagactggattaagaaaatgtggcacatatacaccatggaatactatgcagccataaaaaatgaagagttcatgtcctttgtagggacatggatgaaactggaaaccatcattctcagcaaactatcgcaaggacaaaaaaccaaacactgaatgttctcactcataggtgggaattgaacaatgagaacacatggacacaggaaggggaacatcacactccgggggactgttgtggggttgggggagggatagcattaggagatatgcctaatgctaaatgacgacttaatgggtgcagcacaccaacatggcacatgtatacatatgtaacaaacctgcacatcgtgcacatgtaccctaaaacttaaagtataacaataataaaataaaataaaaagagggggaacaggtttaagggatgtaaactactctccccacttctgtgagtataatgcttattatgtatcagagactgctctaagggcttataatgtactgaatgaatcatcacaataaggaaggtgctatttacaaataaggaaagtgaggcacagagatgttagatgtcttgcccaaagtcaaagaagcagaagaatctagattcaaatccaagcagtctatattgagaattccagcttgtaaccttgtaatcattctgatccatgatctagtaaactaagagccctgattagctgactactcaggcaaagaagtcaacttagatcatatttggctaaggtctgttctggatcagaagaaagatttcctctggggtgtttttctaccatttagatatgtatgcttgtcatacatgtcttatgtatatatatatccctttgtagttttgaacctttaggtttttgaagcttgttttagataattctgctaataataagacatggcgaatgtaggacatgttgagttcataaactttattgttaatcacttgacatgtgtctgtaaccaatgtactgggttttgttttctttcttcaccaagaactcagccccaggaaaaaatctgagaaggccctcatctctcatctatagcttaccttgaggctctgtacaagcaagaaatgactaaggcagagttgcaacctgcctgcctaagagggaaatgtatgcccaacacatacaaaggcccctttggcagtcgctgaagacttactggtttaaggcaaaaagaaatctgtctaatcattaactatcaccatgttaaccaagcagatattttagtggctatacatgataaagaatacagactttacagattggtccaggaaagtttctaaacaaagcaacagcaccagcaacaactgcaacaacaaaccccagagaggggagaatctgatttccagagttgccacattatattatttaaaataactagctggttttcaacaaaaaattataagacacacaaagaaacacgaaagcatggacccatacacagtaaaaaataaagcatcaatggaaattacctccgaggaagtcaagacattgtacttattaaacaaagacattaaggcagctattataaatatgttcaaagacctaaagaaaaccatgtataaagatttaaaagaaattgtgagaatgatatttcactaaatagaaattttagagttgaaaagtataataactgaaataaatgtaccagtgagacataacaaatttaaacatatactcacctaacaaaagagtcccataagacaagaagtaaaaatttataaaattgaaggggcaaagagataattcaacggtagtagctggacaaagtgaaaacagtgctcagagggaaatttatagctataaaatgcctacaatttaaaaagaagaaatcagtaacctaaatttataccttaaggaactagagaaggaagagtgaactaaattttttaggaagctgaaggaagaaaataataaatattagaatggaaataaaatagagaacagaaaaacagcagaggaaataaaaaagggcaaaaattggttatttggaaagataaaaaaatggcaaacccttagctagagtgactaagaaaaaaaagagagaagacacaaattactaaaatcagaatgaaaaagaagacattcctactgaccttaaagaaataagaggattataaaggaacactatgaaccatggtatgcgaacttagatgaaatggacaaattcgtagaaaggcattaactaccaaaactgactcagtgtacagaaaatctggatagatctataacaagtacacttcccacaaagaaaagcctaggttcaaatggtttcatgtgaattataccaaacatttcaagaagaattaataccaatccttcactaactcttccaaaaaatggaagggaaaaattccaaacccactttatgagaccaatattaccaaaactagacaaagacctcagaagaacaccacagaccagcatccttatgaatatggacacaaaattctcaacaaaatactaacaaagtggattcagcaacaactaaaatgccacatatactacagccaaatgggaattatcttaggaatacaaggtttatgtaatatcaaaaaaatcaatcaatagaacaaagaacaacaactgcacatcatcttaatagattcaaatatgtatttgacaaaattcaacaaactaaaaatagaagcaaacatcatcaacctgataaagactctctatgaaaacctacatctagcctcatacttaatggtaaacagctgaatgcattcttcctgagatcacaaagacaacaatgtcccttctcacttttctttttctttctttctctctctctctctttttttttggatacaggatcttgctcatcgcccaggctggagtacagtggtgcaattttggctcattgcaacctccacctccccagttcaagggatcctcccgtctcagcatcccaagtagccgggattacaggtgtgtgccaccatgcctggctaatttttgtattttttagtagagacagggtttcaccatgttggccaggctagtctcgaactcctggcctcaagtgatccacccacctcagcctcctaaagtgctgggattacaggcatgggccaccatgcccagacattccttctcacttctattcaacattatatcgtacattttgcaagggaaatttgaaaaggaaaagaaatacaaggtacccagacaggaaaggagaaagcaaattttgatttgcaaatgatataatctctctatacagttaatgttatcttgcatataaaaccctaataaatccacatatacacaaacaatttagttctattagaataacctagttcagcaaggttcaggatacaagatctatatgtgtgtgtttaagtcaattatctgtatacactatcaataactatttcaaaaggaaattaagaaaaaattcatttataatagcaaaaataagaaaacacaggaatgaagttttaacaaaagatgtgtaaaacatgcacactgaaaactataaaactacaaaactgaaagaaactaaagaatacataaataaatgggaggacaatcgatgttcaagtatggaagacttaatcttgcgaatatagcattactctccaaattgatcaacagattcaacataagacttataaaaattccatctggctttttttttcctgaaatggaaaagctgatcctaaaattcatttggaagtgaatttgtttttttaaaacaatactgaaaaagaagaaaggtgaggcactcatacctcctaatttcaaaacgtacttcaaaggtatttccaaaacttagttcaaagctacagtgctcaagacagtatggtactgacattaggatagacatttacatcaatggaatagaactgacagtctaggaataaatccctacattaatggtcagttgatttttaataagggtactaagacaatgagtagagaatagtcttttcaacaaacagtgctgagacaactgaatattcacatgccaaagaatgaagctgaatctctacctcagaccataaacaaaacttaactcaaaatggactatagacctaaatgtaagaactaaactataaaactgttagaaggaaagacagaggaacatcttcatgacctccgatttggtaatgaattattagatatgacaccaaaagcacactagacaaaagacaagaagagatcattaggacttcattaaaattaaaaacttctgtgcttcaaaggacatcatcaaaaactcaaaaagccaaccgaagaatgtaagaaaatatttacaaaccatttatctgaaaagggatttgtatttagaacatataaagaacccttacaagtcaaacataaaaggacaaataacccaataaaaaatgggcaaaggacttgaatagatatttctccaaaggagatatacaagtggccaataagtatgctcaagagaagatgctggaagttcttagtaattagggaaataaagtctctaagatacagtaagctaccacttcacacccaataagatgtgtataatcaaaaaagccagacaatatcaagcgttgttgaagaagtagagcaactgcaacactcatacgttgctggtgggaatgtaatatggggcagctgctttgtaaaacaatctgacagttctccaaatggtttaacatagaattatcatatgatccagcaaaattccaaccctaggtatataccaagagaaatgaaaacacatgctcacacaaaaacgtatacacaaatgtattagcatcattattaattgccccaaagtggaaacaactcaaatactcatcaactgacaaacggataagtgatatggataagctatatccatacaactggaatattatttggccataaaaaggaataaagtactgacacatgctacaacacacataaaccttgaaaatattatgctaaaatgaaagcagtcaccaaggacaacatattatatcatttcatttatatgaaatgtccagaataggcaaatctatacagatgaaaagattagtggttgtcagaggctgtaaggagggggaatggagagtactgctagtgggtatggggtttctttttcagggtgatggaatgttctgtaattccatacagtgatggttacaaactctgtgaatatatttaaaaaccactgaaatgtatactttatgaattttatgatatattaattacatcttagtaaagtgtcattaaaaatactgccagaaggacaatctttttcttccctcccaggggaaaatcaggtaaataaataatcataaaaaatcaaaggtttgtgttgtgtgaagaacgaatgaaaaattgattgtagaatgtagaagtgtgagttaactttgaaacataaaactgctgcgacagtttggatgccttcccccaaaacctcatgttcaaaactgatccccatgttggagatggggcctaatgggaggtgtttgtgtcatggggctggatccctcatgaatgccttggtgccatcctcatggtaatgagtgagttctccctctattattagtagttcccatgaaagctggctgttaaaaagagcatggcccctcccctctccctctcttgctatgtagtctctatacacactgtctctctttccttttcactgtgaatggaagcagcctgaggccctcacaagatgcagatactggcagtatgcttcttgtacaaactgcagaactgtgagccaaataaaccccttttctttataaattacccactcttgggtatgcctttatatggcaacaaacacactaaaacaacttctaagaatgttgagggcattttgatcttgtgaaagtaaattcacttaagtatcctttattcagaaactgaactttgtcaaactgaagaaactattactataactaaagttttatttttattgcaaaaagttcctagggagctaaaagagtacccatttatttcaaatttcaccatcccagaccaactctattcataatttagacaaataaaattggaaacctaatatataatacccaaaaattgttgattctaagataatacactgatgcatacaatggaaaccagaaatcataagcctcatattctctacctcaaagacactgggcaaataacattaagccagactgatgtaaaagtttctttttgatagagttcgagaaagtaaaaattagcttatactgagaaagtaaaattctgcccttccacacctcaagctagaatagagatacagataaaaccaactgacaagttaacggcaaacaatatttcttctaaagtcattctgcagctgtaaaatgtcataattacccgttttgagcaactactgctttcttactcattagacacctcatcttttaaagtcatagactgtcagaaattgtgtagtctgaaatcacatcagaaagaatgaaagtgactttgatgctgagaagcagttatttgcaacccagatgcagactttcacatgaggggtttctgaatatgtcattttacatttaactttgtattttccaaggaaataggactccagatccattatgcagtctggacatggtattgactcttttatacagagcctattttgctgtaagcctatcacatccctgatctcattaaaatttcatcagaattccctccttcgtcaagattatataataacccagctgggtgccatggctcatgcctgtaatcccagcactttgggaggctgaggtgggcagatcacttgagttcaggagttgaagaccagtctggccaacacggtgaaaccccgtacactaaaaatacaaaaattagccggacatggtggtgggtgcctagtcccggttactgggaggcttttaaaggcttattatctcctcttcatcttgaggctatgcttatctagttgtttgttgttggtaaattaagttgtttaccaaaagttacaacatatatactggcactatgatactcagaaaatatcaagactctttgtcttgatgtgttccttttggtctgattataataatcatgcaataagagttcttcatcaatcttctatagtttctttgttagacgtttgtactaaaaaacatgtacctgtaaaataaaagacatttagcactgaaatttcttcttttaaaggactacgctacaaaaaaaaaaaaaacaaaacactaattgaaaatgtcagccgggcgcagtggctcatgcctgtaatcccagcattttgggaggctgaggcaggcaggtcacctgaggtcaggagttcaagaccagtctgactgacatggtaaaaccccatctatactgaaaatacaaaaattagccgcccgtggtagtaggtccctgtaatcccggctactcgggaggctgaggcaggagaatcgcttgtacccgggaggcagaggttgcagtgagccaagattgtgccactgtgcctgggtgacagagcgagactccatctcaaaaaaaaaaaaaaaaaaaagaaaatgtcagcaatagttataagaaaatcaagcaaatacaaaaccaattaaattaaattaataacttattgatagttattatcaaatcactggttctattaaaagtaaaattaaactaagctatgtttagtatgtataataaaaaggatgcagaatttagggaagagccagacagaattaatcttctaccagggactccctttgtcagaacaaaaataaaccatatgaattgtacaccatgtcaaaaagtatggcattttctaaggtttatggttcaaagtctaaaactatgaatatttctactctaagtttttaagaatctaagctatcgtatgttaaaaagaatttaaaaaatcatttcaaaaatactatgtataaaactgaatctcagaatgtattttctcatagaagcaaaagtaaaaaccacattttacaaaaaacatctctggaataaaaccaactttcaaaggataattttaaaaaacttaaaaacataattcttctaaaagcatagtgaatacttgccaaagatttacataagtcattaatgagggatcagaagcttgacaagacaggtttaaaggagatgcaagaaaccgatgtacagatagtggaaaaaagaatgctggaataagactgcaaaattggatacaaacctggttaatgtcctacaggacagtaataccataactttggggattatcttttatcctagcaaaaataattgcaatgtttcaatcttctacaagttaatatctaacttttaggatctaaatattaattaatagtaaatggtaagtcaaacaacataaccctcccctgctatgtcagataacccttagacaggcttgttaagacaatggtctaatatgactctgaaatggcctacatttatcttttatttatttctaagttttggataatttttcttatcacaacaaatttctgatttttattttttctggaaaaatgaagtggattcactactcacatataagaaatcctgaagaaataaaatatctaaaccaatttaaactcatcttaacactatttccacaatgttgatgtactcttggtattttttaatggcacagtattgggtcttacaatgcagcacaagcttcagactacgtaatgataggatattttaccattagtaatcacgatgtgactatctggctagattacggctgccacctctgagagaaatgaaatctgttaaattgatgccaccagccctggggctaccacaccaatcaaataatcattgtgaacttgcaattaactgggaacattgagaatcagaggcagtaaaataggcattttctctgtattcattatatgtacaacagtaggtattacctttaccaattgtgtttcttctgcctgaaggtgaagatcttcatctggctgggtaacttcagggctctgatgggatacaggataagatcattcagtgataggctgcctatgacttacagcagagcctcaacaagcaccaccaatccactgtggatgcagtgtatacaggatgacctcacctactgttttacttagggctgaaatcaaagtcccattgtaacatgcaatcataatctttcactttgtttgggacaatgacaaacacacgtaagattgaaaaagatataactgcttttaaaaaagaacctatcaaaacaaaaataaacttataataaagtgccttcagacactacataattctactttttcatattgggatgaaatctatttctcagaaagtatctatcttgctcaagaataacactcaaaacctactaacactatctgttttctacaattgaaaaatcattacagtgtttggtggggggatgtggctcaacagtcactcaggaaatatttcagcaacctctcataacattgttttcttccaaaacttagaaactgtatctccatgagggccttatttatttatttatttttatttttattttttattttttttgagacagagtcttactctgtcgctgcccaggctggagtgcagtggggcgatcttggctcactgcaacctctgcctcccaggttcaagtgattctcctgtctcagcctcctgagtagctgggactataggcacacaccaccatgtccggctaattttttgtactcttttttttttgtggagacagagtttcaccatgttgcccaggctggtcttgaactcctgggctcagataatctgcccacctcagcctcccaaagtgctaggattgcaggcatgagccactgcgcccagcccatgagggcctgattttatgaatgcaatgaaattttactttaccttctagttgtagttatccatttcagatgctgtgccatttaaaaaaattatggataataaaactacataaagatcactatgaaaaaatgttatgctaactctccctcaacaacatcttgtctaaaaatgcacaaatattcagattccagaaaattaatgatgatgtgaatcttctatctctgatagagacgggttgatcccgtgatacacgattagacaaatatggttatacctggtgatcaagggcaacattttggttttatttatcttttcaagggtattttaaaggactatttacatgttacatattctggctacaaagaataaaagaccacaatcacgggttattacagatcattactataacaaattatatttgttggtattctctttcttctgaatctattttaaagtcactgctaaaacacagcttttatcacattaataataatcccaaggacactcaaacacacacacacacacatttaaatgtcttcagggaaacattaaaagattcatcttaaatatctaacttccagccctatctgtcacaactttccaacttgaatcacaagctcacccactgttctctgcctctgaagccttgcccttaaacccgtttctcacctgaactatcttcataaatactttatgacaattaaaatctcacttgtaattcagtaccagcttaaatctaactatccttatgaactttctatgaccagtttagcccacactatcatcccatttctttctttacatagcactcatctttatcataccgataagcaactactgttcacccaaataatgtaattattacttttgtacattttacctcaatgaaactgtaaattccctagagccaagcactgtcttaaacatattctctcaatgtaatctattaaatctaatcacttcttaatgagtagaaaagagatcactgagagtggcacaaggggaatggttcctgtgaatcagggctggggtatgtgtttgtgtacatatattttccccataatttcctatataaaattttccaattgaaaaatattccattttgctgtcccacaaataactaaaatttcctgggaacaatacaaatttaatatcaaaattaaagatgcctgtcataactaacgacagctcagatattttttgaaagatcatgtgtcctgatatttggttaagtaagtatagtgaatcgtcccatagtttactacccttactgtgaacccaattttcatgggtctatttagttgagttcccagaaggggtgtcgggggaagtagagaagtcgcaagccttcaggcaaagtaaacatgctctcaaaccaagatagtaggtcaaaaacagggaatcccaacttaccaggcgtccaactgagaaaaacacagcagccataatctctccctctggtttcccctctctggaaagagtggagtcttgcaaagacatacctaaggaagagaaataagccatggaaaccaatcctgcctggggaatttcagactcaccaagttggaatcctgacatacaagtgagcatgacctccctaaggaagcacaagagtaacccttaagatcagtgagggacaaagacccttgctccggcagagctcaagattttagcactgttaactatagtcacaactaacaggctagccattgtacaaggaggttttaaaatactttctcattttattttcacatcaacctagtaggaataatattcccattccatagatgaggaaactgaacctaaaaaaattaaagtacccaaggccatgcagatacatgaccccaaatcaatctaattccaaagcccataccttttccactgaatcaacatgctgtgtgaagtacgaaaaaaaatacttcagtctttctttgccacaatcacttactcatctaacaattaaatattctaagaatctccttttcttgcctttcccacgaagagtctatttcctaacattttcagagatctgtttcatgtaaagagaacactacgacttcaaaatttaaatgatattggaaatcttgatttacccctccgaatctgatattcaaatagatctttatcctttctatatcaggcaaacttaaacaaaaaggaagcaggtataataataataataataataataatagaagagacatgaaattcagtgcacaaagcattaagctatagtctttttatattgaaaaaaaagtatatacctaataaaagttttatcctatggagcaacagggtggcagagatcttttccagggatgcttgggccctgcttttctacctttggctaatgatatgtatggccttgctgaggctgagtttggttcaagaaccaggagtgcctgatgtaggatatcaaacagtacagattgtcaatataaattcttctaggatggtaatactagcctcatgaatctttattcatgagggcagtgacataataagtattaagtttttgtacaaaaagtgttataagcaattatatggtcctgcaagtagggcctttgttatgcttaaacatgtggaatctgctccttccctgaatgtgcaccttgcttctcataacgttcagtagctttgctcaataaacatagcagaacttaatctaaccttacagtgtctaacaatcagaagctcatctgaaaagatacttgaagtacttaaccattattctctgaaaaacaagaatatataaagcaaggttatcaagaatgcaaagaatattagagatataaaaattaactagatatgggtatactgaaacatatactgtcagattaatgtattaactcaaggaggagaccagggttagttaaatcaagaaaatatgtaaatatcttggctgggcatggtggctcatacctgtaatcccagcactttgggaggccgaggcgggcagagcacctgaggtcaggagtttgagaccagcctggctgacacggtgaaaccctgactctactaaaaaatacaaaatgatcagccaggtgtggtggtgcacgcctgtagtcccagctactcgggaggctgaggcactagaattgcttgaacttgggaggtggaggttgcagtgagcagagattgtgtcactgcactcctgcctgggcgacacagcgagactccatctcaaaaaaaaaaaaaaaaagtgagtatcttaaaaatgtagagtgacctgtttcatgacactggggctttcctaggcacaatgaaaaggttttggtggaagagaaacaatgagaagttgagggaggaaagcggtacagtgtggagataaaagaggtaaagaaagaatagtctgaggggattcctgtattgaagcctcaaggtaaccagtaagtggttttgccttatgccagtgtttctctagatttttctgtcatagagccttttgcaaatctaatgaaaattatgactcctctcctgttttctaatgaaaacgccacatgtataactagaggggtctcaaatctgagaatgcaaaaaactcactggatatgcttattaaaaaggaaattatttggccccatccaagatcaaaatcaggatctctagatgtgaggcacagaaatatacagcttgaacaagtacaccttaagaaatatttagtttaatataatgttaacatgttaattatataatgttaaattatataatgttttagttttagtgtaatattttaagaaatattgcctgttacacaatagggattctgaagggtgaaggagtgggaggggggtggagaataaggaattacttaatgggtataatgtacgttattctagggacagataccctgaaagccctgatctcaccactacacaatctatgcataccagtaaatcttaatttttgggggggtacggacccatctgagaatctgaccttgtccacaaaataatgcacatgcatatatgatgttgcatattacttcagagagcttgaaaactgactctccctcccaagcccatacactgacccccaagttttacaaggttgcaaagaaaaaaaatgagccaagaatattgccccatcccgcaacccccgaacactaaagcagacctacaaagagcaacataaggcattttcaattccgaaggtctagagtaatggttttctgcatctttaacatttatcaagagtgagctgagtcatcatttttaaaatatttgtaaatattaataaactctttggcaatactttatgtagattatgtagattatgctcgtaacatatgtttaacaaccaaactacaataaatcccttgttttattttataattagaataaacaatatttaacatttaatatattcagcttgatctcaattgtgcaaatgtaatgcatagaaaaaaagactgagtaacccaaaactctactgagacctctgagacctggggctgtgatgtttacccttctttctgcttttctgtactctccaagcagacaagaagaagtatctacctatacataggagtgtggaataggaataaaatcccagagtggctggccacatccccaggttctaaccctgctttggctaccgtaaaactgtgaccacaggcaagtcacttgagcacaacgaatcagctattagtacatgacagtagccaccttatatgtttctactgtcccctttgtcattatgcagaagatatctaggccactattccccagttataatttccctatttacaagctctgtctttccaactattgcaaacgtatccagagacttaaggagaaactttacttgttttgcttccttggccagtgcagttatttagaaataatgaagggtccatgtttttgctgagaatctcagcgccatgtaccagtccagcatttcccaaccaatgcaataataccattgtcatgtcagggagtgacaagtgattaaaaggtgattacagtatttgaaatgtgacatttcaggaaaagctgcctcggttactgagtagcgcaggtcccccgatgtggaacctagttccatccctgccagttcagaagccagagcggatatgctcctgccaacctcgccttctttccctaactgctctcctctacccacttcgggtatgccctcctcagggcctgcaaggcgcggggctgggaagaccgggaaagtcgggtcaggggcccgcccgccctactcgactccctgcgccctgcgcccggctctttttaaccccagcgccgccaggcccgcagggagggggttcccgggtttggacccggactaggaggccgcatagggcacgcggccctacctgtgagggaggccagctggagactgaacccacactcgggaaggaggcccagccccaatcgcctctcaggagtgggcgggtccgctcagggacaggggctctagagggaacggccacgccccggacgccgccgggagccaagcgccaagggaggggcggcgggcaaccgaggccaggcgcccgggacaacgagtacctggcggccgaactgaggacaactgagggaactcgcagagcagggcgggaacgcttccagcaatggcggcggctcggcggtgccggcctc

SEQ ID NO: 760 - DNA, 197714 bp, Homo sapiens
ttcatatgacttgaattgggagaccagtagtcatgtgaggaagacactttccacagtaccctccacatttgccgaaaaatctagttccatcctgaaaatcggaagaagaaatacagaagaatcttatacaagctggtatctgtatgcaaatagcagaaaaagcaaatgctttgaatcatatggctaaaatcattagcagaggtttcctataacaattgcatttgaggtcaaagatcatatgccttttgatattagttcaaattggtggacatgggaaagttaaaggatattagataacctgagattcatattagctagttgaatattatatacaatttaaatctcaattaagatttaaatccaatccacatatttcaatctcaatccacatatttttcatctaggtatgtatttgcttcagtgagtttattaaaacctctcccaatttgcaatccagtatttacataattttatataataatctctttaaataaaagaaagatattgtacaaatgattttaaaggcatataattcattttctatcccatttatttcaagcatctcgtggaggcgttagaaacacactctggagaaaagtatagaaggtggtaaaatggagaaaataaataaataaaaactgggctgaaagcaatcattagaattagaaaagaactaaaatgggagattgttccataagcagagcagttcactgaggaacaggtggcagaggtaggctgaagtgggttggtcaggacgtgatagacgcctcacgtctttaggtctaaaagtcaagactgaagacatttccagaacatgagacaaaaataggttgaactcctatcatatctggaaaaggtaatttttttaaatctaagggagtaaagatagagaagaaaactgtaggttcttgggacattttgagatggaagaatgttttgagaccggaagcttttgaagttaccttctctttctaaagcaatttaactctggagaatctgagtacacagagaagggaatggcagtaaaatctcagagttgtataattccctattccctctgttgaagtaaaaactctatcttcattaaacttattggcaaaggaaaatatgtttgcatttctgtaagtatatctggattttaccagtcagtttcacaccaggcatcagatttcaagaactagttatgtgcaacatttttgattgagatagaacttctcaacgaaatgaataatgaattaatcttgagaagttaataaaaacacaaatccttcattaagcacaattttatcatcttcagaaatagaatgttttaaaggctatgactatcagaatactaaatttcatttatgagaaatatttatataaataggagtataactaaatttacttttatcataataaataaaagtcataaaacattagagtataccggggctgttgctggtgctaatttatgtgtgatataggtgagaacacctataacctagatccagatttactatgagcagggctatgttatctaagacacaataaccataagtaatagaaagcatttcatgaagtgtacatgttagaacaccatacctgcagaaaattaagtggattctactttggataatacaacatgtgctatagttacaataattataagaataaactataaaaatagttataactatatatataaatactacataacagtctacattttcatagataaaataacaatgttatctagataaagataggaaaacatgagtacaacataaatacataatcctaattcttgaaaaaactgtgaagaatatttgttaaatgacaagtgtctccaacaccacccccatcactaaaacagtgagggaagaaaacaaaaaatttaaccctcattttgaaatattaaaacctgtaaaccttcagtaattaaagtatagtaaaaagcatacctttcttgaacatctgtatttcaagtcattagctccaaacttgagatagacaaaatctatatgtcctggcatttggcaatttatgttcaaatatctatagcctatatatggattcataaatatacaaaacctccacatgcacattaatacaaatgaatcctgtttcatttcataaattaatgttgtgctccattatatgtaatatacccattatatgcaatatctctttagtcatcaatttcatataagtttacattttaggtagagaacctttaatgctagttcatagctcagaagtatttcaaacaggctttttggtcccgcaggacttacctctgatcttcgtatgctgacagaggtataactcccctgagtgagccactttgctgtgctggatatcttcatcccagttcctgacaaattaatgctaaactgtccctggattgtaaataaaacaaagaaaaatagatggaatttacaaaatatttgattacaaataagtcttctcaattgcaaggggcaactgaattaatactatataatgttatttgtggagaagtaactctgcccaactctaggactctatgattcgacaattagaactaatggtcctgtagaaattagcaagttctgacagaaatagtgttcacggggaccaacatttgctgcactttaacatttctacacgttccatttttgacccttcattgctaacttctatgctgtttcacctatttgacatattttccagaatctctgttattgccccattccttttgtggtaagaatattacttcttaactcaccacacaaaactatctaatataatattattttcctggcaattacatccattttaaacaccagaaacagcgtgcagatgtgtgatgccacatgatttacacacattatggtgtgtgggtcccctatgagcttcatgatctaattctttccaagtgcaggaccatttttatgtcaaaatacttcagactatctttgttaacagttaaattgtaaatattaactgagaaaatgtgttattaaaataggtaacatttgtgtcatatttatataattttacagtacagatttaaacattgaaaagtagaactgcaaacaagttcagtctactgacaatgttcagtaggcatatagattcagaacaatattacgacattctttaattacctcacaatatctcaatggcttaagactcatgaatcttgagcaagattgtgatgaaacactggattttatattatatgaatgaaaatattatcttgtcataaaagcaaaagctaaataaactctgtatatataatgtgaattattaatattgctaaaacaaatagatatcaatttagtcattaacttggatttcttagcaatcttatattgtatatttctcatttaaaaacaaatgaagatcaaatattcgcataaaacaatgacaataaatggagaattttccattgcagaaataattagttttagataaatttcaaagaaaatgtatcacatacaacatcacttggttatgaaatttagaatatgaactctatgtcagtttcattgctatattcccagagcccagaacagggcctaagttctcaataagtgtttttgaatggatgaattaagtgcagcattaaaaacattaaatagtagtattataaaagtaaatacacaaatacatatataaaactcttcagactctgataatgaatgacactaaaaccagacaaagtcgtattttatgttcacaaatatttgaataaaaagaattgattcttaggatatattattctatttgatacttaatcaacctgatacaggttttgcactgtatacctccaatctcacattccttctcagataggtttttcaccaaataaagttattaaaaaatgaaaatatattctaccatgtaaatttcttgtaaccagatgctccttgagtgctcaattgggccatgcaacctaatactgttgttccattcttccatttgctctctacctccctgatcaatgtgccttaaaaatattcaaatgtatacacattggaagtaaaaggaataaatctgactgactactgagagccttaggtggtcattaacacaattagttgagtctagaactatcgattgttccatttctctgtactaattttcatgagctttacttctgttcttagtcctcacttagaaagctaaatatgatctcaaaaaaaatggtaaaacaattatctaaaatttggtatgatgttgacggaggtaaaaatacatctcactcatttgttcaaaattaactgactggcagacatggtgtcaagtaccatgaaagttcagacagatctcactctaaatctgttaagtgaaatagcatatgtacctaaaaaaagtaattcggacgggcgcggtggctcacgcctgtaatcccagcactttgggaggccgagacgggcggatcacgaggtcaggagatcgagaccatcctggctaacacggtgaaaccccgtctctactaaaaatacaaaaattagccaggcatggtggcgcgcgcctgtagtcccagctacacgggaggctgaggcaggagaatggcgtgaacccgggaggcggagcttgcagtgagtcgagatcgcgccactgcactccagcctgggcgacagagcgaaactccgtctcaaaaaaaaaaaaaaaaaaaaagtaattcaacaagagaactataagtgccataaaaaggtacttatacattcctataggattttagaagtaataaataagtgagtgtgaataagtgtgttaattccaatacttcatttaagattaaaatttaaacctcaaacctaatctttaacttaaaaattagttcaacatacgaggtcctctctctctctcactgtctctctctccatacatgcatatgtagtatgaaatgtcaggagagtagatacgtagtatgaaacttacctcttcttctactctcctgacattttgaagaagcagccactaaacaaagtaaaattccagtagccaaatcacaaatggaaggtaaaatgattcaaaagacctaggaattcaataaattggaatgtttattcttgagtaactggctgcatcaaagaaaaaggtaagtatgggtataagatagaggagaagcatatagatagatgcaagttttaacgtttcacttcttggattgactggttggttcatgtgtgctcattaaataattatgttttacagtttttaaatgtactgtacacattttattatgtatgtaatctatagatctaatataataccaatacaaattttccacccagaatctttgtacatacggagagttgattctaaaatttatatagaaaggctatggatttaaatagtcgtaataagcttacaaaagaagaatgaagctggaggacccatgctactttaacacttatcgtaaagctatcctaatcaagacgtatggtgttggtgaagacagagacatgtagatcaaaggaaaaaaaagacccacataaatatggccaatacttttgacaaaggtagaaaggcaaataagtggagaaaacattgtcttttcaacacatggtgttagaacagctgtctgtctatatgtttttgactcagacaaaaaatcaagtctataaatccctcagacttaatacaaaatttaattcaaaataaattgtaggtctaggtataaagcataaaactataaaaagtttttgaagaaaatttccaaaaggagaaaaatctcagtaatttgagtttaatgatttctcagaaatgactctaaatgtacagtccataaaagaaaaatttgactttattaaaattgaaaactgctttgtgagagatatttaaaagaaagaaaagacaaggttcggactaaaatgccgtatccaacagaagaccagaacatataaaaaaactcaaaactcaaccgtaaggaaacaaacaactcaatttttaaaatgagtaagacttgaaaacacatatcaccggccgggcacggtggctcacgcctgtaatccctgcactttgggaggctgaggtggatgtatcacctgaggtcaggagttcaagaccagcctggccaacagggtgaaaccctgtctccactaaaaatacaaaaattagccgggcgtggtggcagtcgcctgtaatcctagccactcaggaggctgaggcaggagaatttcttgaacctgggaggcagaggttgcagtgagctgagattgtgctactgcataccagcctgggcgacagagcacgactctgtctcaaaaaaataaataaaaataaattttaaaataagcataaaaagacaaaggacataaaaagagagtaggggtagcaatgttgataaaagataaaggagaatttgagtccccaatcattaaaccatgacaaggaagtgctaaaagtaataatccataaagaagacataacacataataaatattatgtatcaaatcatagagaacaacttttatgaagcaaaaactatgagatatgcatggagacacagacacaacctaataataggaaaaatcaacataccacttgcagtaacaagagagatcacatgaacaaaagtaaggacatgatctaaacaatgtaatcgaaagggtagatcttatggatatatattaaactctacaccctgataataatgaatacacattccaaatatctaacaactgactcttaacattcaaactggatgctggccaagacccactgacattagccgaatatgattatttctcttacttttatgtaattaccaaccagttaaatagatccacattacttttgttttttaaaagtttttgtggctttgcaaaaagtgcaaaacatttactttactttactttcgacatatgcattctaaagtcacaccacactccttaacttcatctcatattgcaatgtggcgaagtttattttccctaaagagtgccatatgtgtccatactcttttttagcattcctatcccagactatcctgtcacatgcaaacacagaggatttgggtttgatgaatcccaaacaacagaataagttctttctgtgacgtcaagcatctggagagtattcatgcaaatgctgtgtaacataacacagaatctggtttatatattacagaacatctccaaaaatattgggcagtttgtatttttggtaacagtagcctcaaggagacaaatacaggctgaatatagatgggcacagctccttttgacagcatgtgtctatgcccaataacaaccaattttggaaatggagctttgcgtttcagaaatgcctagaaaaccatgcaagagagacatctcgccccagtgggcaggaagagcattttattgccagttctgcctatgactttcttcaggatcttggacagactgttaacacagaatgtctgtttcttcagctataaactgggcaatcgcagtttatagctatataactttttcaagatcttatagggaaaaaagaggattacagagacattggagaaagggagttagaaagaaatggaaatagctatcttatgatttaaaaacctgattgtgcaaatatctcattcaaattccatgtacatgaagaaatattttatttgtaataattggacttatgttaaggtatttcctataagaaaattcattaataaaataaaataaaattttaattccatttgacagttatatgatttacttgtatatgcgtctcctgtgattttcttgatgtctcattgaccagacctttcccaatacaacatgtaatgacaaggaccagatttccagaactgggtgacctttccaaagtaacaacatttgttaggccttgtattagcagactaggttgcattgtcaatttacttatctctaattacatcaaatatatgaccagaaggcacagcttaaaaggaggatgggttgttggacaaagttgaccagtcttgagataggttaaccattgtagaatgtataatctccatttaagagagttgaaatggatgtgtcaccaacaaaagacatccacatatcaaggaaaaaactgttcagaatgttaaaagttttagattacacatccttgacttaagaacacgtataaaaagagacagtgcagaacttcaggagaggagggactcagcagagaaaggacagtcctgggaaggcaactgaatggaaagtagtaggtcagagtcaccatgttggaggtaggtactcatcaccaatatgggtgaaatagggaattgggaagaagaatggaaataaatagggctaaccagcctcaaagattgaatgagaacataggattcctctgcaaagttgcctgcctttaaaaatacaatcatgtgaggaaacacttctagaatggtgatgtgaggagcccatggacactctctccagtgaaacaaacatgactggtgaaaatgataactataaccaccacttaaagtctctgaaatttgttctatggttatacggaaaagggagaaacatttattcaagaaaatcttcttcaagaagacatttattcaagaagaaaatcaagaagattttcttcttgatttcaccacaccaacatggcacatgcatacatatgtaacaaacctgcacattgtgcacatgtaccttaaagcttaaagtataattagaaaaaaaaaaaaaaaggtgaaaaggggccaagagccagggaatgcaggcaacttctagaagctggaaaaggcaagaaaacagattatctcctaaagcctccagaaaggaatgcagccctgctgactgcttgattttagcccagtatgacccatttcggatttctgacttccataactgttaaataataaatttgtgctaccaagaaaaaaaaaagaatatctattaaatctaggtaagaacagtgagaacctgtggcatctgaaccatgactcaccctcttttcctcccacctcccatgactcgccctcttttcctcccacctcagcaagatgatcattctaatcatggtgaatgcagttaaggatacaggactccatttccccctagctccctgttaaggctatggtttctctttgagacaggcaggccaccagcatttctcatcccacccaagtctgtactgcagaagttgtattataggcaagagtagctgagagtctgaagctcccttcttccacccagtccctactcacagagcagtcaatctatcccaggcatggtagatcaagcacactaggcctgaaatgtccccacaaaaaatcactggtaaggcagacactccatgctgacaaggtcaaaagccaagaagaccagggattactgccatgactcagcactctatttattgagcaggggtgttactctgaggaatgggccactgtccctgtccccagatccacagtattgcagagcttcttcccagggagagaatcaagttgtaaaaataggaaattcactagcttttcctattgtgactagcttatttggaataaaacctggagaagttcaagtttaggtactttctggaaaagaagattttagtggtgtgttgttaagaggagggtagtagctcaatgaaggcaaatggtagataagattgaagtttaacagagagaatcagggaatgaggcagctaagaaaggctcttcttggggactttcctgatctcaaaaacagactataagactaattgaggccatggggcctctatttaattggatcagattatggagttatttatgcccccaaaatattgttgaaagaatagggaaatcatctagcaattagtggagactaagagctaagcatgatatcagtagagacagaccacgcataaactcaacacaatttcagggaaagagaactgaagaaagcccacctaagactattgttatccctgaaggagaggagcatcacggtcactgtgcatgcccaagactgtgcccactgaggagtaacatcaaaggctgcacactacaagggaaatagaattcactgaaacagttcagccaggtaattaaaaaaaatacacaaacaaagaagtaaacgataaccataacaagaagcctcaaaagggagggtgaaatcagtaatcacagttgctaaaatacagtacctgaaatgtccagttttcaacaaaatttatgaggcatacaaagcatgatgcatacacaggaaaaaagtcaagaaaaacttcctttgagagatatcagatgtcagactaagctgacaaaaacttcaaagcagctaatataaatatgttcaaaggactaaagaaaccatgtttaaaaaagtaaaaggaggtatgataactgtgtctcatcaaatagagaataacaataaagatgaagatatcatattttacaaagagtcaaaggaaaactctgaagatgaaaagtacaataatcaagattaaaaaattcacaaaggggctgaaattgtctactggagctagtagaattcgcaaacttaaagggatgttaatgatgcaatctgaagaacagagaggaaaaaagaagaagaaaaatgaatagggcctcagaggaatgaacgcacaccattaggtgcaccaacatatgcataaaagaagcatcaaaaggacagaagaattaaaaagagcagagaatatatttgaagaaataatgactgaaaattttccaaaatcagtggtatatattaaaataatgactgaaaactttccaaaatcagtgaaacttattaatttacccatccaagaagcttagtggactccaagccaagtagacacaaagagatgcacatcaaatatgacacagtaaagacattgaaagacaaatgcaaagagaaaatccccaaaaacaccaagagaaaaaggaccacatccatggaacccaataagataaacagctgacatctattacctacttagaagtcagacagcagtgtgatgacatattcaaagtgctgaaaataaaaaactgtacatcaataatttttaataagcaaacctatcattcagaaaggaaggcaaaataaagacactcctagataaacaaaactgagaggacttcttgctagcacatctactttacaagacatactaaaggaagttcttcaggctgaaatcaagtaacatcagacattaatacaaatcaacttaaaaaatcaagagtgctgataaagttaattatgtagataattataaaatacgctataattgcatatctcttcacttttcttattttaactgatttaaaagcaatcgtataaaccaaggtgtatataagtatattattgacctgtaatatatagacatgtaatatatttgacaataatggcacaaataagacagatggaagcaaagctgttttagagttaggaaatgacacaagacgataagtcaaatccacaggaagaaataaagagaaccagaaatactaaatgagaaggtttacgtaacaaactctatgaatatacaattgctctatcttctctcatattatctaaaagacataaaattatttaagttaatataataccaatatgttgcaagtttgttgcctttataaatggtatatgtataacaaacatagcagaaaaagagaagaaataggtcatttatagtagtactgtctttatatttcactggaaagagaggaatgttcaatagtaaaatgtaaagtacattctgataagatatatattgtaagcctttgaataaccactaacaaagcaattcaaaaataatgaaaaaactgaggaaattaaaatgttacaccagaaaacattcactgaataaaaagaaagcagtaaggaggaacagttgaacaaagacaacatgaaacatatagaaaacaaaaagtaaaatggcagatgtaaatccagacatagcgatagtgatgttaaaaaaatccaatcaaaggcagtaatccaacaaaatactctataagagacattcttaagagccaaagatataaataagttgaaagtaaagggatgaaaatatatatagcaattctaacagagctggagtggccacactagtatcagataaattagcctttaaaacaaaaacattactgtagataaagaagaatattttataataataaaaaggtcaatatgttaggaagttatgacagttatatattcgtgtacaacaaaatctcaaaataaatgaaacaaaacaaaatacataaaagattgaattgagaaacagacaatttaaaaataatagttgcagagtttcagcagatagaactaagcagaagatcaacaagaaagaaagagttgaacaacaatataaaccaataaggtctgtagtctatagaacacttcacccaacaacaacagaatgcacattcttcccaagaatgtattgaatgttttccaggacaaactatatgttatgacataaaataagcctcaataaatttagtggataaaataacacagagcgtgttttccagtcacaataaaggttgaaatccaaaaaaagaaaatttgggaaatttacaaatatgcggaaattaaactccacactcttaaataaccaatataccaaagacctaactatagataatagaaaataaaataaatgaaaggaaacacaacataccaaatattttgggatgcaacaaaagaatcgattaaaggaaaatttatgactacaaatgcctatattaaaaaggaaaaataatctcaaatcaataatctacccttctaccttaaaacactggaaaaagaagagcagaggattgtaagggaatactatgaacaatgtgtgacaaccaattagtcaacttagataaaacaaacaaattcctagggagacataactaccaaaacaaattcaagaacaacaaaaatttgaatacatctataataaataaagagagtaaattggtaattaaaacaactttcacgaagaaaagcccaggctcagatggctttgctggtaaattctaccaaacatataaagaataatttttttgcaaactcttcccaaacagtacaagaggaaaaaacacgtcccgctacattctataaggccactatttctgtgataccaaaatgagacagatatcacaagaaaaaaaatgatacaacaatttctactacaaatatgaatgaaatattctcaaaaaatagtagcaaaccaaatttagcaatatatgaaaataattacatcccatgactaagtgggatttatcacaggaacgcaaggttgtgtttcaacatataaaaataaatcagtgtggtaacactctatcaatccagtaatggacaaaaaccacaggatcttctccacagaaaatccagcatcctttcataataacacttaagctagaaacaaaaggctgtgtcctcaacctgatcaaggacatctagaaaatactcctagctgacatacttaacatacacatgaaactaacatacttactgctgaaggactgaatgccttttgcctaatattggaaaacaaggatgttcactcttgccacttttattcagtattgtaatagaagatgtagtccgcacaataaaacaagataaagaaattaaagatatctagattgaggaggaagtaaaattatctttattcacagatgacatcactgtgtataaagaaaatcctaagtaatctactgttacaactaataaatgagttcagcaaagttgcagaattcaagatcaatccatacaaatataggcaaaaattgattatttatttgggccccagatttgggttctccttaccaaccactctacctgtcaaagccttcttaatgttgagctggaacctactgccctattaatgcctctggaggaacacaagcaacctcactcctctttcatggtagttctttaaatatgtaaagatcgttaccattgtctctcactcttttcctggctaccttctccattttccttagttgacatgattcaaacccttctttctttcctgtgatctcctcctactcctaaatagattgaaaatgatgttttacagacagaaattttaaaataactgtaatgttccagtgtcaaataaaaataaatccttcagtcttgctattttgttttggaaccttacgattatattaggttgtttataaatcactccctgacctaaaggagtcatactgaactcatgctgggcgaagaaacacctatgtctttttcatgtaacatcaccactttccgtttgagtttctggacctaagttaagatgtatagatttattcaggttcttactcattttagcctgtagttctagtgtctcttgatctcctttaagttctctaacagaaaatgtcctctcttcctaatataagcgtaacttagatgtcatataatgaaaattataaatggaatagtctaagaagagactatgacaaactattaactacttctcttcaaaatgatatcaatatagtaattaccacttgtcttaggtagtagatttgattcatatattcaattagcaatgagtcacctaaaagtgctatattcatctagcttacaattcttcatctatcataaaaatgttcttttcattatctatgtaaaatctctagttaataatgtgagagaatattttcttctaggaaaacatgctctgtattggaaatcatggaaatgacataagagcatgtgaagagaactctagaaataaaggataaaagcgagaataaaaatatgaaaatgtattcaatatacattttattgataacagactgtcatttggaggacgttacagacccaggaagctaatagaactgatgtcagcagaagtgtatgaaagtcacatgcttgtgatccgttcctttgccttttgacaaatatctattcatttccatggactaaacggaaagatgaagaaactgataacacattatggaagaagaaatagaatctgtttaaaattattgttatgccttttaaacaaacccaaaattggcaaagatgcttttcctccaaaggttatctataacctttgaaacaaagcgcatatgtgaagttttgcatttctatttacttatgtttcttgcaatattctggttaaaaaaatgaatgaagagaagctataatttttttcacaaagaaagaaaattaatcaaacaaatatgaaatacctgtgggcatctgaaagcactgtagcaatctccagctgtggcaaatggaactgcatttccaaatattgttttggaaaaaagaaggtccgtagctagaaaataataaataaaactctttagcatggagacaataatgcaatcgttgttgtcaaacacagagttttcttattacttacttagtaaatatacatatttatatattaattttaaaattttaagcacaaatgccacaattctggtatatatcatagaataagctctcattgaacaaattttgtttaatataaaaatgttcatatcataaattgccctaacaaagggcaagcacatttgtaattaaacagaagagttaaaacgaaataaatgcattattacatttgaagtcatagaatatctgaaataggtaaagtggggtcaggagcaaaatcactggagaaaaaagggttatgtaaacataaatgacaaaacaataaaattgaatgcttataaacagcacatacaaaaattcatttaggtaattcaaaatctctccacaaaaaagtatgccattttctttttttcgtgtcttattgcattatgttattctttttatttttttcaaacttacttttgctaacagtgttagcaaaatttcctgactggtaataatgctgaagagtctacataaagtatcaaaaatagagccattggattaaaacaggctggaaggaacactaaaagtcagctgcttcaatcacctattcatgtttgaatcaaatattatcccaaccaaatcatctagccagtggctgtcacctccactatgtattccaaatctcttcactttcaagactgcaaaatcactgcatgtcccaggatgacatcagtccttcagaggcaattcccaaaggtagcatttctggaaatatttgtcatatctccaaagggcagtttcaaaaaccaggaagctctccatggtttaccagagccagcttgtaccaaatagtgagagccaactctgtgcatttcttcccaagcccaggtacaatgaggtcatgttggtagctcatgattggtcagggtgggaatacatacaccatgtatatattagtgcctgacaccacaaatcagactttttcttccctggataactggtcgtcattcatctgcacaccactatttatttgtggcatttgtggattatgctggggcagagcagagacacaactttcaaagcatctattgttactaactccaaaagcatgtcagtcaacagccagtttcatcagccaattacacaatgatgactcataagtatatattccagtccacctgactctgatgagttacagaacatatatcaaattcctattgggcatcattacttggatgacctacagatatctgtaatttaacatgttcaaagctaaatgcattatctttttctccaaatttatttgccctgctctatttcccatttcactaaactgtactaccatctgtcttgttattttagaaacctttctaaatattccatgtcactaattctcacaccccttctatcagaaaatcctgtagtgtctacctctttaatatttctcaaataggtatcctaacccatgttcccagtactcatcactttttatctgaattgttacattcgcttcctaatcatttttcatggatacaatctgttctgcctccaaccaactctattccttcccctgcttatgcctttatgcctttattccaatggttcctataacttgcaagataaaattcaattgtatagtttagtatgcactgttcttcatgatctgctccctgcgaacttttctaataagctaccatcccccaacctacatttgatttatgttagacaaaactagactgctttttattctctgatatcgccaaaatgcttctcccttccatgcttttgttcatgcttctccctcctcctaaaactcatttttttgcctcttttgttaactcaaagttgtcttgagattgttcaaactatctgttcctataaacctcttgagaaaagcgaggacttttaattcaacagatacttatttacaatatattttgcattgggcagtattatagatattgcgaacacaacagtgggtgaaacagaggccaatggaacctgagtcttaccaggaagagacaagttataaaacaaatattacagtatgttaggggtgatacttgctatggaaagaaaataaagcagataatagaatggggaggaagagaatttagtggtggagagtggttctggatggtcttatttagaagataaatttcagcagagacccaaaagaaatgaaggggtaaaccacacagacagctacagatgaatgttcccggcagatggaacagtaagtgcgaaggccttaagatgggggcatgcctggtgtgttcaaggaacagcaaacaggccactgtgtctgtagtaggagtgatcatggggctcagggcagcagaaaactgagagggaatagaggtggaaaggtcatggtgactcttgttgaccagtgaaatgcacaattttgtccataacagcatgcacattgaaaattcacctgacagaagttgatgatgaattacatgtgggtgtggaagaaaggtagaagttgaagatgttgctaggttttagctagactaagtagaatattattggtggcatttactgcagtggtaaacatttgggtttgacagcaggtttggcaggaaatgttagaagttcagttttggatacattgagtttgacatgcctattagacattcatatgaatatgctgagtagacagttggattttggaggttagggtagcaatccaagctggaaatgtgcatttgggactgtcatttaatagatggtacttgaaatctataaatttaatgagattcccaaataacaactgaatcctatagctcctcaacattcagagttgtagaagatgaagaataacttgccaagtcgagaaacagtgagaaagacaggagaaagagtggtcaagaaagacacaaaaccattagaggatggtgtcctgggatccaaatgctgctgatgcatcatgtaagatggaaaacaagactttatcattgaatttaaggaaacaggttattgatgactttgataaggactgtttcctggaagtgacatgaataagagattgattagagtatagcatggggaaagagaattggagagtgcagattataactcatttaagaaattttactataaatgaacacaaagaaactggtcagtggctggctggaaaggtagaggtcaagatgatttgcttgtgattatgacgaaagaaataaaatgtttctctatgaagaatttaaatgattcagcagcagaattgaggatgtgagagagattaggaaatatgctgaaataacgttcttgagtaggtacaaggcactgagcctagaggacaaggagcaggatttgccttggatgggagcatgaagagttcatccagagtaaacaggagaaagcaaggagataggtaaagattcaggtaggctggtagatgtggcagtgggaacttgagcaattcccttctgattcttattttctcagtgaaatagcgagcaagatcaccagcagtgagttagtagagtggaggtattaaaaattttgaaatttgaagctacaggagaaggtataagttagacatttagaaaagtaggagagagaatggactagggaagtgcagtaggattatttggcagtgccatggatccgtgtaagcttagtactcatgtgtttaaaatggtatcagtcagaagggctgtgtattatttgccacattcagttttatgctgcaagcacagaatgggtggagatttaatttaatcaaggctggatttttaccatgcaagtttaaggaagaaaaagagaggagaaactgtatatatttgacattgcatgcttgcatgctctgggcccagaccaatgcctggcaaaatggcagctttgttaaaaagcagtctagttaacagcaaataagctattgagtgtctattagaaacttagagcgctaataacatacttataaccatatacatcattaaataataaccaatatttatagagcatgtactctatcagggatgtctaatcttttggcttccctgggccacactggaagaagaattgtcttgggccacacataaaatacactaacactaagaatagcttatgagctaaaaaagtcacaaaaaaaatctcaaaatgttttaagaaagtttacaaatttgtgttgggccacattcaaagctgccctgggccacatgagggctgcaggctgtgggtttgacaagcttgtattatatgtaaaacaatgactagatatgttagaaatatcatctctttttttttttttttttttttttttttgagacggagtctcgctctgtcgcccaggctggagtgcagtggcgcgatctcggctcactgcaagctccgcctcctgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagtcaccgcgcccggccgaaatatcatctcttaatcctcaccaaacaagaataaaaaaagaaggaaagaaaaaggaaatgaagaaaaaaaccttagtaatagtttctcattttacacatgagggaaccgaggcttaaagacatatgcccaaagtcacagagctgataaataaagaattacacccagacagtctagagtttattattgtaaccatagtaatataatgcttccacactgtagtagatggtggatgttcagtaaatgatagccatcattattaataataatggttcataattttatgactataatttatatattatatattcatgcatatactgtcttaattttttttattgctttctatgacttatgcaccatgctaggcactgatgattcaatggcaattgagatggagtctctgctagtgaaatgcacttttttgcctcttcatgtagatatgtaactttctggacagcagcctgcatttgccaggtgcatatgaagttctataaatacgttttgacttgattgtattataaattactttctagataagcagtatgatctataatctaaggtctatgagtaggactttttttccctaatgccagtactaactgtatgaatggaacaaattgcttaacttccatattacttacaacattgtgatatagtatctgccttaactaatacaagagtgttaaaaaggtcaaatgagataatgtatgggaaaatacctgataaattatcattagaaactaatgtaaatgattactttaaactctgcaaaaagcttccacaagtagaccgaggatattaactttcttatccttaatgtacctgaggattttaaggtagagggttttatcttggaagggcagtatcttacttgttactgtcattacatttttattaagagtccccagctgggagtggtggctcacgcctgtaatcccagcactttgggaggccaaggcaggtggatcacctgagatcaggagttcaagaccagcctgaccaatatggtgaaaccccatctctactaaaaatacaaaaagttagctgggcatggtggcgtgtgcctgtaatcccagctactggggaggctgaggcaggagaatcgcttgaacccaggaagtggaggttgcagtaagccaagatcatgccattgcactccagcctgggcagtaagagtgcaactgcgtctcaaaaaaaaaaaaaaaaaaaaaaaagccccatggtgcatgtcattgcagaggaagtatgtagctaactgtttttaaaaaaagtaagtaatttttgcacaatgtcaggtccttctctgtaccctggctacaacatataccaacatattgtttgacgttcataagcaaatggaggctttttgattttaaaatatagattgagcacttacttttaatttgcatggaagtgagatcaattcttattttgctgaaaacagtgtatccagcagctaagtgtccattgtcacattcacagtcttcccttctactcccattaaaaggacattgatatggattttttagtctgtaacaacattgggatattttagtattagatgcagttacgaggccataatgtagacaaactttgggagtagaaaaataaaacacactcctgctctttaatattatagtgtcaacaagttaaacaagaaagaagcaaaaatcacttaaggtgaacatacaacattttcaatgaaacatctaagaagagcttgtagaaaaataattcaactgcattcttctagctttgattactggaattagtttgactttatgaaaatgcacatagttcttaaattcttcccttctctatgtccgacttctcacccacagtattcttagtcaatctctctgttaatagtcaatattaacaatacatgttagtattcaaggctttatttctgaacaggcattaacaacatctagtttaggtcctaacatgtctacctgctcctacattatttgtctcacatgtaagctattcaagtatcactctgagggctagaagttccaattctcttggaggaccatgaaaatgctcagatagaccaaaacacatctcgtacctaaagccatacacttcagaaaagttttcttcaccttggaccagtgttaaatattccttagggttctccaagtacatgtctgcacaataaatctaaagaaaaaatgtaaacatctagaaaaactttttccaaagtcaatgatcaatgttaaaataaaaaaggaactgttttcataatacctttattattcttcccttaatgttaaggtaatagtcaccatcctttctaatgtggtttttcacttgaatttctttgcaggtggtaaatgatttaccttcaaagacaaattaacacaacttaacacagagcaaattacaaacacagcaagaacttaatcatagaaatattgctacactctgaatatctgacactttgttttgtggagtgtgaaactactacagatatttattttaactgaaacttattagaaacccttaggtattagatttttgaagtctactacttacagtcattggcataacatttcttttgagcacctggttttaaatggtttaaacataagtcactggacaaaccatgtttggtaatgcatttcacttgtctcttcattatcccaattccacaagtcactgagcactgtgaaaagagtaaaatttgaaggcaaactatattatgaatcttaaggccataaaatccaagtctccttttcttagaccaggtatttctggagcacactgagggtcagtagtggctagatacacagaagacacaaaactatgctgggggctggatagtcgccggtgggaaaaatccttaggcatgagcctgaatctattatttctcagttactggcttcttttaattcattttgtgcagttagcaacaatacattgtaaatacttaataaacattagtcagtgatggtaattaaaactatctcattaagttatatgctaagtttgcaaagtgatatttacttgctttctatcaattaaattggaaatagaatatgatataaataacttttattactcatatattagatttatttacttcttcacttaaccaataaatatttcttaagcacttactcaaagtgcaagccactgtgctaagttatctaaggaacagaaataagtatgagttatggtctctgctttaagcgagttatagcaagcatcgaacaagagataaaatatttatataaataactggtaatgtggattttagaaaatagtggtctgaggcaactctgaggatctagttagacatacaaacagattaccagatttcccacacctagaaagtcttattcagaagttttaaaattcataattgtacaccgaccttgctccattttccaactttccaagtggccaaatgcaaacagctgttaatgcattggtaaacctgagaggaaggcaccacagggcattcttgataaactataggccgaagtcgatggagcttatgtttcttagtagatgggatctcggtgcaatatgtaatcctttgtctgtaactaaatccacagttgtttgcacactgaaaaatacataattacaagaaagaaaatgtcattaactttagccagggcctaatatttgtcagatgcttaatatatattatgctgtgtcatttccacaacaatcctatttaattagcttcatttacagatgagcaaacataggttcagacattagacaagtttcccagagttgtaccaataaaggaaagaaactcagatccaggctagattttctagctgtagtgcctgtgtgtgcgtgtgtgtgtgtgtgtgttttcattacattaccatcttaattgtatgaaactatatctcccaataggcacagcattggaggaataaaacattttgagggtccttactggaaataaagggcatctattagccttagatcactggtaactatgtataagttagcacacatgtatcttcatagatatactgtaaagtctaataacacttgactaaaataggtaagtgatttaggtgtaaattaaagccccaatccaaaaatgggcaaatagatttctgcttttagcaaaagaggagtaacaaggaatagatttaccttctaactttaaacaactaaaacatctgaacaaaatatataaagcaatggcttttaagacactcaacattggacagtaaagaatagtaatccatgacagatgagaaacaaagtgacactataaaatcattccagcctactgctttgaaaaactttccaggtcttggcacaacgaaaggaaggcagcagagctctgaccagcagtgtgtacatacctgtgaggacaccaaccaaagtaaggcaattaaccaaacaaaaggcttagaagttactttctctaatgatcacacagaaccaaatatagtgcctattccctccagctagactggaaaatttaaatacatgaggaaataggtaaagtactcaaaagggtcttgccacagtagagaggaacagttaaccctagattaaacaatatactgatctgcctacaaaatcttaagtgcaaggcaagagagagtcaaactgttctccaacaaaattaatgcaacccataacaaaactcaaaatacatgtataggaataaaaaatatctagtcagcaaaaaggtaaaattcatggctgacatgcaacagaaaattaattggaatgcaaagaacctggaaaataagactcataatgaagaaaaaacctgtccatcaaaacatccctagaggggtgacatctgtgaaaatggaagagtaaggacatctaaaaattctctcttctataatagcagtgacaaaatgggcaaaatttgcccgatcagttttttcagaactctagaaactgaccaaagacttgcagcaatccagaaggcatttattcaataaacatggctaacttttggtaagaagagcaagttttgtgatggtttaacttctcctatttccattctcttctttctagctccatggtaaccttcaaaatcaacagccctgtgattatggtgaaaccagaattccggcagccactggaggggagcagaacaggcttggatatcattcaaagcctcattcccagagaattgtcattatttgaactgtttagtggttttctggaagaccccacttgcaagaatgtctttatttgacctgacctgctcagtgctaaaaatctagggacatttgttgcgctcaattaaaaaccattgtttaactttgcagtttccaggatgctgaataacagttggagcaacaacaggctagctaaaaaggcttaaaaggaaaagctagggaataagatgtccatcagagctttgaaaagctccagtgtattaatgggatctagatggccgtgaacatgcatcagattgtacacatgtccaggtctgtctgcaagctcaggaagcatctgaggagggcctgcagcctctcttccagctgacctcaaggctctacacaagcagaaagttaagattaaggaacagttgtcaacaacctgatgagtgttgaaggccacaccctactcccaaccccccaacacacagtaccttggcaaaggctagggaaccaaaattattggttccagatattaaggaaattactgtctagtcatagctgacaactaaactaagtgagcagagacttcaatggccatgtatgacaaacaatatagacttaacagttagttcagaaaagtcactaaaaaacaaacaacaacaaacagtagcaacaacaaaccctggggaggaggaagaatctgaatagacttatcacaagtaaagagattaaatttgtaaccaaaacacttcacacaagaaaagcccaggaccaaatgcttaaagaagaattagcaccaagtctgccaaaagtattccacagatagaataaaaaggagcactgcctaactcatcctatgaagccagtttttcccaaatccagacagacatcacaaaaaaaaaaactatagaccagtagttcttaagaatatagatgtaaagttctacaacaaaacactagcaaaacaattccagcaacacataaaaaggattatacaccatgacgaagtaagatttatcccaggaatgcaagattattgtaacatatgaaagtcaatctatgtaatacaccatactaatagaagaatggacaaaaaatatgataatttcagtagatgtagactaaacatttgacaaaatctaacacactttcataatataaacatgaagcaaactaggactagaagggtacttcttcaatctgataaagggaatctacagaaaatccatagttagcatactgaattaggaaaactaaaagttttcctacagagagcaggaacaagactgaaatgtctgtttttaccacttctatttaacattattctggaatttctagacagggaaattggacaaggaaaggtacaaaaggcatccatctttaaagaaagaagtaaaactatctctatttgtagatgagatgatattgtaagtagaaaatcccatttaatccacacactaaataattaaatcccccaaaaaattttcaatacacaaaaaacaattctatttctatacacaagcaacgaataataagaaaaatgaaactaatagaacaattccatttacagaatataaaaaatactcaggaataaattaaaagaagtgcaagatttgcacactataagacacacttgaaataagttaaaacctaaattaatggaaattcattccacattcgtagataagaagacagtattattaagataataatatctaccaagttgaacaagagtcattgcaacctctaacaaaatctcagctggctcttacatagaacttgacaaactggtcctaaaattcacatggaaatgtaagagactcagaatagcccagtaatcttaaagaggaaggaaaaaagttggttcactcatacttcctgacttcaaaacttactataaaattacagtcatcaagactacatggtaataatatattgataggcatatagatcaagaaaatagaattgagagttcagaaataaaccaatacatttatggtcaattgtcaattgatttttgacaaggatgccaagctaattcaatgggggaaagaataatcttttcatgcagaaggatgaaattagacccctacctcacatcacatacaaaaattaactcaaaatgtatcaaactcctaattgtctgagctacaattataaaagcctacaaagaaaacatagatatatatctttgtgagcatgaagtaggcaatagtttcttagatatgatacttaaagccaaagaactaaaacaaaaaacaaaataaatttcacttcatcaaagcatactattaagagaaaagataacccacagaattggagaaaatatttgcaaatcatctaactgataaaagttggtacccagaatatataaataatttacaactcacccagtgaaaaaatgagcagccaggcatggtagcttatgctatagtcccagcacttttggaggtccaggagggatgatcccttgagcccaggagtaagaaaccagcttgggcaacacagggagaccccatctctacaaaaaaaaaaaaaaaagctagagatggtggcacatggctgtagtcgcagctactcagcaagtttaggtgggaggattgcttgagcctaggaggtcaagacttcagtgagctgtaattataccaccgcactccagcttgggcaacagaacaagactgcatctcaaaaaaaaaaaaaaaaaaaaaaaagatgggcagaagatttgaatagacatttatctaaagatatacaaatacctaaaacacacacaaaaagatactcaacatcattagtcattagagaaatgcaacttaaacataaaatagataccatttcatacatactaggatggttatgttaaaaaaaagatggattataacaagtgctgttgatgactgatgatgatatggagagagaaataggaacctttatacattgctgataggaaagaaaaatggtgtggccactgtggaaaacagtttggcagttcctcaaaatattaaatagagttatgatacccagctattctatccctaggtatatgcccaagaaaattgaaaacatacatccacacaaaaacttgtatgcaaatgttcctaacagcattattgaaacgtcaaaattggaatcaatccaaatgtccatcaactgacaaataaatagacaaaatatagtatattcctacaatggaatattatttatcataaaaaggaatgaagcattgatgtatgataaaacttgtataaagttttaaaatatcatgctaagtgaaagaagctagacacaaaagaccacatatggtatgattccatttataccaaatgtgcagaacaggcaaatccacagatacagaaagcagattagtggttgtctgagactaggagaaaatgtgagaataaggaattactacttatgggtgcagatatttttttgggagtgataaaaaggcctgggattagatcatggtgatgcttgcacatacaggtgattatactaaaattcgctaaattataaacatgtgcatagatgttagaattagatgtccagaagaagatgttaaaaagataatttttaaaaaaattcaagaaaaaaataaaataaaaattggaaaattttacctacaaaaataaaagtaactatgtttcatatgttcaaaatgttaagtagagatatggaagatataaaaaagctgaaattaaacctctaaagatgaagatgataatggcttagataaaaaaacagactggatggggatcagacatcagaaagaaaagaaaagcaaatgtaaagacatctatataatggaatattattcaacaataaaagaaaaaactattgatacatactacaacctgatcaaatctcaaaatacttacattacagcagacaaaaaaagtatgtactgtatgatccacttatataaaactctagaaaatgcaaacaagtatagtgatagatcactaatatagaaaacaggtaaggtcacttattgggtgaggagggaaaagagaggggggaaagagattataaagcagcacaaggaaacttttgggagtgatggaaatcaaaatggtactggttttatggctgtgtacatgtgttaaaacttattaagctatatattttgaatatatttagtttatggttcatcaattacacctcgataaagccatttctaaaaagtggacaactgtacggtgccagtttgccaaattgttcctggtggttggtttcacagttggcacctactgacacttgagacttgcactagagtttaacacatatgtcactattactctatttgcaccatccaactgtcagtggtctcattccttagattgatatgcataccatcatctgccctcatattcaaattttatacccagtttcagctgtgtcaaattgtagatccagctgttttatcaaggagcaaaaattctcaacttcctttctttaccttacctgtgatgagtctgctgttaccacaatgtaattgcaaggagggttcctgcaattcttggatgtaagagatatggttgaagaattatagactatttcattcacttgtctgatttggttatctgtgcactccattcgttgatgtgaatcttttctctcacatgatgttgaacactagaaatgcaataaccaaatgaataacacattcttatatgcagtgtctttgaaaatttacatgtcgatactcacattcagcctccctctttccatccccttgtgctgcacacagtcctgactccaacatcgcctctgagaacaaggtcgggtggactgatcacacatttcttcaaccacctgaccaacacctttcagtctgcagtatacatccctctgctgaactccagagccacaggtcacagagcactacaaaggagtccagttgatttgaacaattagctaataaataccaaattatataaaagtagccaatggagccattacatattatttattttaaatacagcctggtattaaaacatgaattagataaaaaatacatacaataagtatttttaccattatctctgtaaatgtatattttccctgtttggcataaggcacttcaagctttacagaaactctgacaagcgaatcaagttatagtagacagcatctcaatcaatgactctgtcttctacttaaatgagtataatgtctataaaaattaccacacaattaatcatgaattattccacaacattgcttttaaatgtcaattaaattcttagactatactcattatctccctcaaagaaacaataatttccaagattgtgttatattcatctttttatctacagtacctactatagtttgtacctgttatggaatctaaatacttgctaattttttttaatactttaagttctgggatacatgtgcagaacatgccgctttgttacgtaggtatacatgtgccatggtggtttgctgcaaccatcaacccgtcatctgcattaggtatttctcctaatgcaatgcctcaccttgtccccaaaccccctcgacaggccccagtgtgtgatattcccctccatgtgtccatgtgttctcattgttcaactcccacttatgagtgagaacatgcggtgtttggttttctgttcctgtgttagtttgctgagaatgatggtttccagcttcatccgtgtccctgcaaaggacatgaactcatcctttttttatagctgcatagtattccatgttatatacgtgctgcattttctttatccagtctattcttgatgggcatttgggttggttcaaattatttgttattgtgaacagtgctgctataaacatatgtgtgcatgcgttttttatagtagaatgttttataatcctatgcacatataccaaaaatgggattgctgggtcaaatgctatttctggttctacatccttgaggaatcgccatactgtcttccacaatgattgaactaatttactctcccaccaacagtgtaaaagcattcctatttctccacatcctctccagcatctgttgtttcctgactttttaatgatcaccattctaactggcatgagatggtatctcattgtggttttgatttgcatttctctaatgaccagtgatgatgagctttttttcatatgtttgttggccccataaatgtcttcttttgaaaagggtctgttcatatccttcaccactttttaatggggttgcttttttcttgtaaatttaagttctttgtagattctggatattagcgctttgtcacatggatagattgcaaaaattttctcccattctgtaaattgactattcacgctgatgatagtttattttgctgtccagaagctctttagcttaattagatccaatttgtcaattttggcttttgttgccattgcttttggtgttttagtcatgaagtctttgcccatgcctatgtcctgaatggtatttcctaggttttcttttagagatgttatggttttagatcttatgtttaagtctttaatccatcttgagttaatttttgtataaggtgtaaggagggggtccagtttcagttttctgcatatggctagccagttttcccaacaccatttattaaatatagaatcctttccccattgcttgtttttgttaaagatttggtcaaagatcagatggttgtagttttgtggtgttatttctgaggcctctgttctgtttcattggctattaattactacctcaatttcggaatttgttatgggtctattcagggatttgacttcttcctggtttagtcttgggagggtttatgcgtcctggaatttattcatttcttcgagattttctaatttatttgcatagaggtgtttatagtattctttgatggtagtttgtatttctgtgggatcagtggtgatatctcctttatcatttttattgtgtctatttgattcttctctcttttcttctctattagtctggctagcggtctacctattttgttaatcttttcaaaaaaacaggtcctggattcattgattttttgaagggtttttcaggtctctatctcctttggttctgctctgatcttagttatttcttgtcttctgctagcttttgtatttgtttgctcttgcttctctagttctcctttgcttacgaagcttagtttggctggatatgaaattctgggttgaaaattcttttctttaaaaatgttgaatatcggcccccactctcttctggcttgtagggtttctgcagagagatccgctgttagtctaatgggcttccctttgtgggtaaccagaccattctctctggctgtccttaacattttttccttcatttcaaccttggtgaatctgtcaattatgtgtcttggggttgcttttctccaggactacctttgtagtgttctctatatttcctgaatttgaatgttggcctgtcttactaggttggggacgttctcctgaataatatactaaagagtgctttccaacttggttccattctccctgtcactttcaggtacaccaatcaaacataggtttggtcttttcacgttgtcccacaattcttggaggctttgttcactccttttcattcttttatctctaatcttgtcttcacactttatttcattaagttgatcttcaatttctgatatcctttcttctgcttcattgattcagctattgatacttgtgtatgcttcacgaagttctcgtgctgtgtttttcagctccatcaggtcatttatgttcttctctacactggttattcttgttagcaattcccctaaccttttctcaaggttcttggcttccttgcactgtgttagaacatgctcctttagctcggaggagtttgttattacccaccttctgaagcctacttctgtcaaatcgccaaactcattctctgtccagttttgttcctttgctggcgaggagttgtgatcctctgcaggagaagaggcattctggtttttggaattttcaggctttttgtgctagtttttccttatctttgtggatttatctacctttggcctttgatgttggtgaccattggatggggttttggcatggacgtccttttgttgatgttcatgccattgctttctgtttgttaattttccttccaacagtcaggcccctctgttgcaggtctgctggagtttgctggaggtccatgccagagcctgcttgcctgggtatcaccagcagaggctgcagaacagcaaagattgctgccttttccatcctctggaagttttgtcccagaggggcacccatcagatgccagctggagctcccctgtatgaggtgtctgttgacccctgctgggaggtgtctcccagtcaggaggcacagagctcagggatccacatgaggaggcattctgtcccttagcagagctcaaatgctgtgctgggagatccactgctctcttcagagccagcaggcaggaacatttaagtctgctgaagctgcgcccacagttgccccttcccaattgctctgtctcagggagatgggagttttatctataagctcctgaatggggctgctatctttctttcagagataccctacccagagcagaggaatctagagaggcagcttggctagagcggcaaagctgcaagctagagttgtggagggctccacccaatttgaaaaaatgaattgtggtgggctccatcctatttgaacttccctgtggctttgtttacactgtgagaggaaaactgtctgtcaagtctcagtaatggctgatgcccctccccccaccaagctccagcatcccaggttgacatcagactgccgtgctggcagcaagaatttcaagccagtggatcttagcttgccggactccatggggtgggatctgctgagctagaccatgtggctgtctggcttcagccccctttccatgggagtgaacaattctgtcttgctggcattccgggtgccacgtacaaaaaaaaaacctcccgcagctagcttggtgtctacccaaacagccacccagttttgcgcttgaaacccagggccctggtggtgtaggcacctgaaggagtctcctggtcggtgggttgcaaagaccaggggaaaagcatagtatccgggccagataggaccgtccctcaaggcacagtccctcacggcttcccttggccagtggaaggagtttcctgaccccttgtgcttcccaggtgaggcaacatcccgtcctgcctgcttctgttcaccctccgtgggctgtacccactgtctaaccagtgagatgaactgggtacctcagttggaaatgcagaaatcacctgccttctgcattggtctcactagaagctgcagacaggaactgttcctatttggccatcttggctgatttgttgattcatgattatatttcaatggataggagttttggaaaactggctgtgtaaactgtaaacttagacaactttgtccaagtcttgtttttcttatgtgtacaattttgtgttacttgtgaaatgtcacagaacactttccatacatttattcctgtcaacagctctataaaagcggtactatggctgaggacactgggactcagagaggttaaagtcccttgcctgaggtgctgcctatagttagtgattgtcttagtctgttcaggctgctataacaaaataccataaacagaatgtctcacacaccagaaatttacttcccacaattttggaggctggaatttcaagatcaaggtgctggcagattctacatccagtgagagtccactttctggttcctacagggcaccctctcactgtgttctcatatggaggaagggatgagctagctttctggggtgtcctttataagggactagaaaaggccccacctcctaataccatcaccttgggggatagaacttcatcatataaattttgaaagaacacaaccattcagatcatcccattctttccctgccccactcctcaaattcgtgtccttctcacatgaaaaatatattcattccatctcaataataccaaagtcttagctcattctagcatcaattcaaaagtctataaagtccagactctcatctcagtatcatctcaatcagatatgagtgagattcaaggtataattgattcatcctgaggcaaatatctcttcagctgtgaacctgtgaaatcaagaaagttatgtgcttacacaacacaatggtggtacaggcaagccatagggtagacattctcattccaaaaaagaaaagtagaaaagaagaaaagggtaataggacttgagtaagtaaaaaacccagcagagccaacaacagtaaatcttaagtcttgagaataatctttgatgcaatgttccaccttctggacacactggggcagggattgggtcctcagggctctaggtggcattgccccatggctttgttggattcagcccatgccacagttctcatggattgtagtttggtgcctatggcccttccagactgaagttgcatgccagtggctatagtggtctggggtcatgggggcagctctgatgccatggcatcagcttagtggggacaattcagccaggttttttttgtttttgtttttgtttttgtttttttgccactttagaacaaggatggactttcctccactgtccaataacatgataacatgttatgatttccatctgagacctcatggcctttactgtccatatttccatgaacatatctctgcccttgcaatggccctcttccttgctcatgtgcccaagtccgtaggcagctctatcctttgaaatttaggcggaagttgccacacaagcatgactcatttactctgtgtgtcagtggagatagtcccacttggacactgctaaagtttatcacctgtgaactctggagggatggccatcatagccattgctgtacttgggaccactggagacacatctggggtagttgaggactgctgtgccagaatgtgggaagcagagccaataatgtggggtggcaccaaaccattgcagccctgttctgtccttaggccattgcactctgggcctatgcaatccctgaggagcttcagaatgctgttgggaggccatccttccattgtcttagacaatatattatggcatctgtttagatagctgtctaatctccctgttgtactgataaacagctcatagcttagattgaaattgctgattcaaactaatcaaactaatctccttatcaaattcagccacaccttttgtattctctcctgaactttctcattttttcaaatataaataggctgagaattttccaaaatgttaagttctgctttcttttttattaacaactccatctttgtatcatttctctttttaaatttttctattagcagtcaagagaagccaagttgcaccttcaatactttgcttagaaatatcctcagcctaacagccaatttcatcacttatcagttctatcttccacaaaacactggaacatgagtacagttctgtcaggttttgtttttttgtttgttttttgccactttcgagcaagcatggactttcctacactgtccaataacaatttctatctgagacttcatggcctttactgtccatatttctaagaacattctgtttgcaactacttaggtattctcaaagattgaggctctctctaaagctctcctcttctctttatgggcttttacaagaatagcccttaatgatccattcgtggcactataggctttttctagcatgcatttcaaagctcttccagctgctagtcattacccagttccaaaaccacttctgtattttagatatttgttatagcagcacctcattatcagtaccaatttttttttatcttagtctattagggctgctataacaaaataccataaactcatggcttataaacaacagaaatttatttctcacagttctggaggctgggaatttcaagatcaaggtgctggcggtgtcagtgtctggtgagggcctactttctgatctgtagaagggtgccttctcactgtgtcgtcacatgggtgaaggaacaagctagatctctggagtgtcttttataagagaactaattccaacaatgagtgctctaccctcatgatttagtcagctcctaaagtccctacctcctaataccatcacctcaaggattaggatttcaacacatgcatattttttttcaggtgtagggttggcaaatattcagatcatagcagcagtgaaaaatagttgaagttctgttcttttttactccagactgagctcttactgtgttgcctcctggggatgaaggaggacttggcaatctttcaactctaggatgtcacatcttccaaaattaagtagtaaagccatataataacagagcttaactacaagagctgtgatgccaacgttaaaaaagtgtagagtatgtctaaagatatttaatttgtgagtttcattgtttatattccttgtcattccagtaggaattggaggtcataatgagtaatattgtttggggatccattagtattcccaactgtaatattataagggggaaaaatcaggttattcaccaagttcattatttctgcaggattccagagtaactaatttccttttcacaacagtaaatatatatctgcaaaatacagttttaccctgaaagaaaaaaatttaaagcccacaaaagctaagaatttcgtttacccagtagactaaaattcctctcataaactgtgtcaacatttttactggaaaagcactttaaaatttagttttctctcttgtgagtataagcagcaaccaccaacttcaaagagaatttttgttgttttacttatgaagtaaaatataaggcatatttaaatgtataaaatcttatgcacatctacataacttacactgaccttcatgttatgcttaagcagttgaattttgccaactcattaaatattttcagaaaaaaatatacagttttttgtgtagagaataataatttcatgtgcactttgtgtatggcacaatattaaatagactaaaatgtctggatgtagtttaacgtaaatgaatctcttatgaaaatgtctagcctataaaataaagctcctgaaaacatttttcacagctaatttcagaaatataaactatatttggaaaacatcctgcctctaagcctgaaaaagaattcctggaaaaaaatagtttataaaacacagtttagcaagaagttctattagataaatataatttcctacaattcaataaaccacacttaattattggtcctttgatcctagcatgagtttttaaaaatccactaagagagcagctagctactatattttcgatatgaacctcttctctaaaaagaaaaagaagggactactacttggaagaaaaaaagtaacttgtttttcagtttttaggaataaaagtacaaaagcataaatcagtatggttttagattttaacatagacgaattcattgcttaaattgaatattccttagcctgctgtcatcaataaccccaactgccaagtccaatagaaagttttcaaatcttttcttagttaatctcccgaacacatttggcaccactgatcactttctgttgaatcattctggttctgtgattgaaactcctttagttctagggggtctcctcttacctcttgaattgctccttctcagggtcttttactattttctctgcatattctttaaatgtcagcatatcccagggctccatttataactggcttctcttaaaaagctctttctgagcaatttcttctatacatgagtaatttctaaatgttatctccagctttggtcacagttctgagttctgcatttacattttcatgtatttataagaaccgtttcatgtatttacaagatttttatgtgttttctacttagatatgtcaaaggcacctaaaatgtaacatttccatagcagaactctttcccttttcccaaagccattttcttctaaggttgtagatacagggaaaacactatcatccactcttaagtggcttactagaatggcttctcaaggtacattataactccttaatatgtatccattattttaacagtgttatagaactaatataagcatgtcaaatttcgtttttttaaaaaatccaggtaatgaatgtaaaggcattgtgaagctgtaagtgcaattataacaccacctaattgactgggatgcactacttcttcatctatattacataactcaatccagacagttcataaatatcctatttatgaaaaaatataacactgcatacattagtgctttaaagacttgagagtggaaatggattaggtaaattttagcgaatccacaggtactgtaaccattatagctattgcggagcagagataaggaaatattagattctgcattgcaaaaatgggttcatcaaggctgactcactctgctatttaataaataattatttaaaatgaaaatagggaagtcttctcttttgaagccttgtttataatttttttattatggataaggttttgatttcattatagtcacttatttgcaactatggtttatttcaagggaatcaataatatagtagtaccattagcagtagtatagtattttgaggttaaagagactctaggaataagtaatcctaatttctctttcattatgaaatctttctataacaataatgaatgagtgaccataaaacctacccatacttaacttcattgtggctatgttcaccgtattgtgaaagcagccatggcattttttaatctgcaatattagcaaatattctcttatattgaactagaatattttttaaactttaatgcattgtccagaatctgtctgtcttttaaatgtagaacaaatacatacctaatttcatgtgagaaagtatgaagatgtgaggactggaactgtggcagccattttatgaccattacaagttgaacaacagaatcacagaaatgccaatccagcaccctaatgttgtagagctgctgaattaaaattaaaatcagaaacactctgattttgttatacgaaaaataaaagtctttgtagtttaaatcactaataaaatcagggctcttgctactggcagcagaacactagacaactgacagcatagttgctaccatttaattgtttttctctagggatatggaaaattgtcaagattttacttataatctgtattccagaataggcaccacttcaaatatctgatcaggatatattagtgcccaacactttgaacatcatccttctgttaatgtaacctagtatgttagtgatttaagcaactccatcatatttaatatgtgatcaactatatcctcagttatttaccctttaacctgtaaaatctatatatataatatttcacatttatgcaacagacatttttacattaaaaacttgccatgaattcagcacaacttagaaattacatttctattgactacactattacatgcagtgcagtgacggcctgaaattgtgaacttcatgtgtccttcttggccaaaggggcaataatttgctaaggaaatataaggatgagctaatgtataatgatattaatgggataacgataactagtataatggagaaagctcaactagacctctgttcaaatccctgcccccaacatttcctgcactatgacctacacaagcttcttaacctttctataagctgctgtttcttcatctgtctaatgaacgtaataaaacctgcatttgtggggaataaaaactcttaatatagtatcaggaagtgactgtcccttgctgctcccttcttctcatttttttacttttcttatggagattcaaccatttatgccttgaaaagtttgataaatgccctaagttagagtgctagtcacctcagcctaccccaagaaaggccattttaaatatcaagaaagatgataaaggaggagcattaacagatagcactgaaatgaaaaatagaatttcactatctagaaaaaattaggaagcaaagtttaaccagcgctggaagcaggagggcatcctccctgtccctgaaccctagtctaccttcaccagtagaaatgtcactgaataccctgacatttcaaatgaagggatcacagattcttaggagctttagggacttaaaaaattaacatttactatttttcaaattataaaacatatatgtatatgtcagaaattctgaaaatatagaaataaagatttatacttatgtatttttgaaatatagacaatatggaattacagaaatacaaaatatcttaaacatctagcatttagcatacagtttctttcttttcttttttttccaaattaggggctttgggtggggagcactgggcagcagatttgtgggattttggaatttatatcacctttggtcccagctctggtcttaaaatgcaagtaagaaaatgatgggtctcaaagaaggtgtaagcagccaagaggctgatttgacctggttctacattgaatactgttgtgtgagattctttttttttttttttttttttttgagagttttagaatggatttactatatgagactggagaacacactatctgaccatacttcttaggaaggtccaaagaaaacacttcattcaccaaggtaattaagaatgcactggtgaggggacacaggctgtccagcaggtttgccatgattaaggggaggtgagaattcagaatatttttttcctagagattgtgcatttggatggcactaaagtaagtagatgggacctgagacaatgaagaatctagaaccatactagctttaaaaacttgaatttacaagtgaagctgctattcccaaatagataaaattaaacgaaaaaaaaaatcccctcgcttccaggaagtgggggtggggtgggattattttttcttttaaatgattcaattatttaatttgcatctaaggatatacatttgaacatagaggacaaacggccctgtatagcaatgtttgttcctgtttagcaacagtcattaaaatgcgttactaaatcctttcgttaaaaaaaaagatacaaatatcaaatgaagagtgttccttcaaaactcatttaagcacctctgtggtcaaaatttaccaaatgagtctttccatttgaggcatcatgtaaaatagtaataaaatgaaattattttaagagtgagtgattatattaaggtaatgttacaatttatacaatcggaataaagcaacaaccagtgattatcttgtaactacctctgaaattacgcttctgtttaatacattattatatgtagtgcaatgacagcttgcaattgttaacttcgtgtgggtgctttttatagaataaatcaaaaggcaatgacttcacaagtggtcatttgtttctggcagagatttggggactgtgtgggtgaatgcaactaatttctatgacaaggaaaactaattcaaggagaagcaagcaaattatataaaaaagcatctattttttatagtccttaaatattcatatctgtatttttgaagccccagaaatatgttcctttagcagattttatataatttcatatttggtggtaagccaaggccaatttgttaccacggatgatggattcactattgtggagctggaggttcagagacagaaagtgtctctcatgaataccaaccacagcagctgcagcagctgcaccgcagcaaaagaatctttgggaccaacaggaatattggtggccaagacacaaaaagtctctcccacttccactcccatgcccccgtggctcctgcctgatgtaggaactgggagttaactgctggacagatctgtggccgttcatattcagtgcctttacaatgtttcacacgcttaggggaaagctactttgccattatcctgacacacctctatccagatcaagtaaggcaaacctccactttaagcaaaaccacaatattggaaacataataatttaagagatggtgagtatttttgcaattagatcacagtattcaaagtaagaagtatttagcttagatacaaagctaggtgtggaaacaaaatgtccattgtcgccaagaggaaaagagatactggtctgagataattctgaacaagtgagcatgggttaggttttagtcttactccctaaggataatgcttagtcacagatgatattaagtgacacaagatgatattaagtgacacaagcatatctgagttcttctgagctcacactatgtgaatgtaaataatggccaaaatatatgtagagaggccattacagactcaggaacagatgatgatgaactattaaactagaccggggtgtgtgcaatggagattcaagagctacttgaaagagatgagagaacctgttgagtgactaactatggaggcaaggaaaaaggataaggatggatccagtatttctttcttgaacaacttagtagagagtagtgacatttacaaaataaaacaagttaatagagaaatcttttaaatcatgacctctggtaaagcatgaaaaataattgatttatttgatgaacattcaatatagaagcaaatgcccaataatacatctttttttgtgggataaaaaacagagatgcattagcatctagttttcaattaaacattgaccacaagccccagcacattaacacttgacagaggctgcctcttctacaaagaaatttgagatttttactcaatttggaaggcttttattcagtatcagtgaggcactgacataattccactccaaagctgtgtgccctgcattgacatgctgagcgcaaagagagaatgatgatgacttttgaccccaggggaaactccatttccttctagctccccaatagacataactcaaacatctgacagagataaggaagttccaacatcagaagatgggtgtctttttccttttgcaggactaggccctttaagaaatagataagctctctgaggtactactgagagcagccagatggctacattgaaagtctagacccattgaaattagtcctcaggaaattattccagttatcttttctgacttcattcatggcttttgtcctgtcaatatttcccaagctggtggtgtttgacagtcattttcaaatgcatgcctacccgaatttaaattttgatctctttcctctgagtatgccaagtggtatcaattacccttcttttacaggctaaattgtcagccagggtctcatttatttatcagcttcatttttgctgagtcttttcatttttggtgagtcttttcattctagcgcagcctaggctatctatctctgacaacttcctaactctcaatctcggattacaatcccatctggaatttaccagtcccttctccaggattcaatcttagctaaaatccaagatttgggggtagaaacaaggcagttactaaatgtatcatcatatatatttttctgttagcctgcatagaatactattatgattatcagtagcctctgctagtattcagtaacaaaatttcttgttaagtttatagtcacaaaaatcaaatgactaggctgggcacagtggctcacgtctgtaatcccagcactttgggaggataagatgggaggattgcttgagcccaggagtttaagaacagcttgggcaacatagcaagaactggtcttaattttttaaaaaatcaaatgactaatttattatttaactataaacttaggaaatgtgttaacactgtttagtattaatactaacttacagcatagtgcaaaaaagtatataacaataaattttagagaagcaaaacattcaaggttatgaaaaataagaatgaattttctttttaaatacaaaaaaatacatatataattataaaatatacatcatatacctcattccagctattggctttccatgaagggcatctgacagatctacaggctttgtgagttggaggtttctgtacttgactgcaatttgtgtcttctaatttcctttggaattggtcaatgcaaaacacttcacggtactttctacctttaccacaagaagctgagcactagaaaagaaatatgaatgcacttgattcattttcttcttgattaatttaagcttatcttaaagaagtacaaaatgtaacaatccacacataattcctttgatatttttatgaagatatgctctagtatttctaattagtgaaaagttaaaagttaccaatctgctctggaccatcaattaatgtgaatatcataaggtaatatgattacatttttataatttattctacaaaaatgtattgattgtctacaatataccaggtactcttctgacacaacaatgcttcaaatcttttaaggttagactatcctcaactaactccttttatcatccaataaaacttgtattcaatcttgtagcatcaatacccattctatttttatctccacatgcttttctatactgtaaagtatgttttctatgttaaaaaattttagtaatctctcagtgcagaaaactgattgagaaagcagaaagtttatttttttaacagcatttcagttcaggttgtttttggcatcagtctggaagatgtctttctctaccatcggccttctgatttatttagtaaacaaaaaataactgaagtctttttaaaaatataggtaaaataacgatttgacttcatttgtcagccagttttcattttatgagtgaggacagtgcaatatggtagaaagcacttgggctctggcattgagtatcacttctgccacttatagctgggtgactttaggcacatttcataacctgtccaagtcttgattttttttcatttataaaacatgagtagtagcatcaatcttacaaacttgttatgaagattaacataagataaagaatatgaaatgtctaacccagtcctactacacttggtagatcctcagtaaacattagcttgctcttctaccattttccttcatatagtctcagagaggatattgacaatttcagcatgatatatgtaccaggggaaagctaagcaaagaagtcatggagttcagacaacctttctcattcctctgagacagttgttggcatatggtttcatttagaaacacattatgcattttatgcatattgtgaactcatagaatattagactatatggcctatttgatactcaaatactttaaacttttaaaaaatgaacagtctggagaaaatttacctttttatattactagcaatatgttgcaataatgcattgattattaagaactattatcatatcttagatgttctcgacctctcctccacctcattaatacagccattccatgctgcttagagcacacttggttctgtgaaaatctctaatggatcttcatatgttgtattaagatacattctttccttctattgatctagacctacctatatgctttaccgttcctgaccatgttatcttgggcacttaccctgcctctttcttttcttcattgtttatttttcagagtataacctattctatactaaaaaaaaaaattcaaatattattgagtatcaagtatataccatggagtgtgctgactactttgagtatgtacatgttcacacatggaagaataattttcccctaaataatacttttaaattgttactttttgaacaaaggaagcatttattactccctctgctagccactttattaaaaggtaataattactgtgaatagtcatgcaaagattcattaaacagcatctcttgcttttgcccttgatgtatcctccaagtgcttataatctaaatgatacacatcatctatgaagtgaattataccagtgtaggtcttaatattgcactcaatgaagatcagaaaaacaaaaacactacacgataccaaataccattaaaaggatacaataaaaagtatgatagaatttaaaaattcatgaaatgtagccatttctttctaggatatttgtaagtgttcaaagagaagataatatttaaattcattcttgaaggagaggtaggtttgttgatggacaaagatgaatggtcttatgtgtatgtttgatatgacttatctagacattgtccagctgtgtctgttttgtaaaattcccagagttcgtttaacaatgccaagaatccaagaatcagccagtaaatatacagtaagttgttggcatttctgataagaatggccaattcatttacaaagctatgtaacataagaggagacaggttaaattccaaattctaattaagaattcagcaatacatttcctctataagcattatctatgagtggaatataaactcacacatgtagtacactgccaaagttaataattatttttcaagaaactgaatagtcttctactctataactttaggtcatctttgcttctctctcttctttgttactttaatctattaaactaatataacttattactagtctaatccagactgttattgtcattgaacataatttaaacataaatctatttttatcaatctttatattttataatttataagtatatttttatgcttttttttttgctcaagtgctaacaatggctctcttattgtcttaatagcaaaccaaacttatactccttgctttcttgatccaccaaattttagtcaacatgcctttccaacttcatattttgctgcttttcaccatgcaaacctttgctctctttaagtataattgctttctccttaatgtgacacattcgctcaaaaacagggcctaactcattattttctttacctagactaatcacttcctctaataattatccttaaagccctaattcaatcccatgtctagggtaaatacacatcaatctttcacttccctgaactcttctgagtcctaccctgtttttagcacttcatcattttctgcattttcaacttttgtcacatgcttcatctacccagcttcctgaaggtcaagtccttttagatcacccatatcacctacaaagtggcatgtgtaataactatcagctgatggatgtttattaatggtataagcaatttttaatttgcttttattaaactctaaaataatttacttaaaaattttaaattccatgaaatatatttattggttaaaaaaccaaaagtcctctaggaatgttagaaaaaaatacaaaatcaaagaattataaaataaattatgctttatacttttaaagtaaagttctttttctccaagatctgaagagggtaagtacagattctatcctcaagatttaaaaaggaatacatccagtattttatcatatctgatggaattccatctgggaatttctttaaagtaaaacaggacatgttatgcaaacagttatgttttagttggaatgaggcatccatagagtaaacaactagtgaaatgataccttcctttcaaaccataatacattctaagttgtaaggattccacaaaatagcccatttggtaggaatattcaaacatgcagttttttcttctggtatcccagcaatctgctgtttttttcccctccattttataactctgacaccatcatagtcttgaagttttatttagtgctgtataattcatttctagcattctcatcaaaagactttttctcaaaaatcagccctagttcccttaattgacatagtcttaaactgttactgagattttttttttccatgactactatggagcagtagatacagcacacaacccatttcagaagtagtgatactaaataaacatacaagtgccctgaactgataattcttataaattatgtgcagacaaatgtctaagataaaacagggcatttgaaacaaatgcaaaatttgcaaggcctgaaaatgtagtagatctttagagttgttctagttggctggtactttgccttccagaatggagagctgaagttaattagtcccctctaacatgataactttggaataagtatatttttatttttagagaaaagctgtacataattatagaataagattacttctcatatttgaggtgcggatttttttgtttatatgtaaggatactgcagaagaatgaatgtattgacttaatttgtgggagtcttcttgattaattctggaaacttaaattattaaacaaaataaaataaggaaataaaattcatttagtttcagttgtaggaaatggaagccttgtttttttttaggcttccctaaactattatattgatctggcactgtatcctttctgacagtagggggaaacatacaggtactggttagaattaatatgtacccaaactagtaattgtatatccctgaaaagtaactattacactagtcatgcataaactgtgccctttatagattttacaagctgggtaactataaaatacctatttcatatacatctctgggtaaaggtaagatgaaaggcatttttttttaaagagagaaatagccaaactaagaaaactctaaagacatctgtaatgctatagcaaaatgcaaagtaaaataaaatcaataaagaactaaaaagagtactgcagaatatcacattgattagattcaggacaagactgaaaatgtctcccataaagcaaatggaatagtgaagatgagacagatagagaagagatggagagtcgacgtatgaatgttgtttcccggaaaatattctgttcattcccagctcaagtcatcatatcattgcacatgtcatcatatcatttcctcccaccccaacacgttcacccatttcatccccacgtatttttcagtgctgagtttaaatctcatttccttctcgaaactcccttctctgatggaggatgtctgatgtccaatttagaccagattaggtagggttcttacagaatttttttagcatcctttgctatactcagtacacctgaaagtgtctgttctatgtctcttttcttttccagactataaaatctgctgagaacagacatattgtggggacacacacacacacacacacacacacacacacacacacacaaatagaaagcacccagaatcactcatttttaatttagtgtgtcatgactcattctacctttcttttacaaggaggaaataataccaacgcaccatgaaccacaggatcttgcatcaacttactgaccaatgtttgtctgaagtggtagatattctgctggcaccacatgaactgatttagatggtacatttccaacgtaatagatattttacatagtaatgatcatcctcaattttagctataaaaatccctcagctggctatttgaaaaaaatatctgaagtttggtgtataaaaaatcaaatgaaattaaaattaagagtaagcattatttatccactggatcttttaattaagcttggctacaaaagtagtaaatatccatttcatttgctactacatcatttcatctatggatgaagatatatatatttgtttttatgttaatcatctaaactttagttaaacttctctaagagtatcaaaactaatatttaatacactaaaaattagtctttgaaacacaatattagaaaaaggctttgatatcaactgtaagttttatgttaaatatttttagtgactactaagataaagttgattattgagagggagtttaaagaaaacctagtttaccttcatacatgtttccttcatataaattattgtgttataatttaaaattttctaaatccatacatagcctaaattattgccagctgaacaaactttcaatgagtgaatttggcaatgactcttttgctgaagcacagattgtttagttattccaggtcaatcagtaagaactagaagtatcttacaacagttaaactactactccttaaacatgcctccacatttgcagataaggaaaatatttaaaattaaatagaggccaggtggggtggctcatgcctgtagccccagcactttgggaggctgaggccagaggattgcttgaacccaggagtttgagatcagcctggtaacaaaatgagacctcatctctacaaaaaaaaaaaaaaaaaaaaaaaaaaaaaaaaattagccaggcatggtgatggtgatgcacatctgtggtcccagctacttgggagactgaggtgtgatgactcttggagcccaggggacggaggttgcagtgagccatgatcaccccactgcactgcagcctgggcaacagaagaagacgtcttctctaataataataataataataataataataataataataataataaattaaatatttcaaaatttgataatataattgtaaacatttcatatgctttttcaaaaaccattttgggaatggttaaaaattatgaaacttaatttttcagctaccataaataacctaactagacataaacttcataattatcatttttctccctcaaccattttattttagtcctctattgttgttattaaacaaaaaatgacgacaagaaaatacaaaactgagtaaaaataaatgaggtgatattattcaatttcactttggcttttgaagttttctgattgtttttcaaaacataataatttagaagtcatcaaatgatcagacaaaaacaaatttttactttattactagatatgtcacttctctttgtctgctttctgacagcaaggtgcataagtcatcgttgaaaatgtaagcacttataaccatatggctgggtattatgtctatcctattgctcattgtatgccaggtattagctaatttctgcagacaaccaaagaaaacatgctgagggttcatgcaaccttttcgtttaagtaaaggtaaacttaaggaaacacacatattatacattacaaattcaaatccagcttctcattacaaaccagaaatcatttccatcaagataagtgcaacttcataagatgtatcatgcaatacataaaatagagtggtttttctttaaacatccacatattataatagctaaagataatcagatgttggagtgtctctcttggaacaatttgagaggattagttgtgttttctttagtctttggcaattccaaatgtatcagtgaacttttcaacattagagtatgtattatttatcctgtttttatctcttttcaaaattaaactattttatgcatctgcagcaaagttaaattaaaaatttttaataaaaaacatattatagctattttgctaaataattctttaaatgatgtttgagtgattatattaaatgtctttagaacactattatgaaataaaagattagtgtatgaaacaacatattaaatcaggaaatgacagaatttcaagtcaaaacagaccagaaattagatattctgagaaacaaaacactatcatgtgtatgcatccctgtatatgtctttcatttttttagaagcctataataacattctctaaataaaacaaagaggctatatctaaaccccaatagttctgaaatcttccagaagccaatgatacttggagatctaagagaaaagcccactacagtaaaatcttagatatgagtttatacaactactttgtaattgagggaattacctagaatgaagaaaccttttttaaactgagcgtctcaattattagcaaagtaaaacattaaagtagctataatagagtagtaggatatatttctgcttaaaacaaaaaaaatgacaaaatatgcatattaagactagagtgtcaactctaaaatagtactgctactgttcctttaattcaatacacatgtgctctaaggagtaagacactaaatccatcaacagggaccccattcatagtgcttcctgaaagataatacttacagttttaaagtttaatggagtttgaaaatgtcctttttaacttgttacaggcattctttgactattcagctctaataagccaagaaagcatttggttttaaaaatatttaccactgaaatatttcattcaattgcattgcatctaatcatatttaaaatttgtagctccagacatttaaaaatttaaaaatcagattaatttgcaaatatatttgactctcaacttaaaggaaaaaaccaaatgattaacaacaaatatatccagcagacttcgattaaattaatatcattgtaataataatatataattttatattattttgagcatatatgtacatgtatgtacactcataatggatttacagttcttggctaattcatgcaatatgagagaacttacatgtaattcatctaactcaattggaagtaatatttaaagataatttactataattattaatattttctatattataactttggaaaagttttgtgattattttcactttcaaatataaaacctgagggaaagctgcagtaacttatgcaagtatcttgtacagaaatattcacttatctcattttataatattattttccacaaataactattagaaaatcggaacaagaaatcatcctagtgagtgagaattaaaggactcaattattggattaattttcttcaataataagttttgataaagaatcatttcaaacctgcaaacattagttattgaacttgagtttattttggtagaagcaatagtaaatgtaagtctaactcaagatgtgagcactatttgtagcaaaaaatactcaagaaaaactgccattcatttaaagcttgtaatttatatttttaactttctaataatattctttgtatgtactacaaaggggaaatgaacatttcagactcctctataaaatctgtttagcaagtgaaactcatctaaagagttcctgtttggagtttttattgactcatccagtaacatgaacctttacaagtatagggtgacatggagaaaaatggtatggttaatatgagaacaatgcaaatcttgtctatttttaacaatttctttggggccattattgtgaatttactttttcttaatgtttttacacaaatcaaatgaaacactgcttttgaaagaatgtgtgccacattccattataaaaactccactcccatcttacccctgagagcctacacccagaagcatgaccgtctgccttcctggactgacaaatgcagaaaactattcagtgtgagtagaccataaaaagctaaagagattagaaaaatatctaaagcatacctttttacaaaaatattgtcttttaaggcattactatggtaacatttacaaaattcttaaaatcaagtgccaacaaaatagcaggatttaccatttcaagttcccacaaatgttttatgtgctagctgtgggagttaacagccataaagccaagaactatgcttttaagtagggttataaaggcctaaaaaggaatatgcacagagtactctgagatgagaaataaatgagttctaaggatgctttgaaaagagaaatgtcagagttgagattaaaagaccatacccactgcacatattaatgtctgttttccatatgtaaaaaaagctgaggggagaatgttttagagattaatttcatatttcaatgaatttaagttaatttctaagattttgcctttaattacacaaaattaactatttgtatcaatatttaagttggggtttcatcattttcactagtggagagtagtagatggaatactaatctagcagtacatgggatttggtgtcagaggcctacaattgaatctcagctgtcagaagctatgataataataacacttacatctcaaggtggttgtgagattaaattagataatgtatgaagaaacctgaaatagtgcttgacacaataacctaaaagcatactaacctgtattccttttttttacttcctttctcaaatcctgagtgtgtttttatcaagagaaaataaagagaaactatcccctgaaaataaaaatactgtagttatgagagaaatgtagatcctatatggacaaaacaaaaatagaatactatgacactaaaacaataagaatgcaagacaaaccttttgataattaaaaaatataactaaaataaagaattcaatatatagtttaaatattgataaagtttcccatcaagtaaaatcaaaagacagaagtagaaataggaagataaaaacaagaaaattaggccaggcgcggtggctcacgcctgtaatcacagcactttgggaggccgagacgggcggatcacgaggtcaggagatcgagaccatcccggctaaaacggtgaaacctcgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaaaaaacaagaaaattagaagaccaatccaagaatcccaatatttaaccagaaagagttttttaaaaaatggttgcatagcaattatcaaagtgtaatacaacaaattttcccaacacaaatctttttaatgaaagagcctacagaaagaatgtatagcaaagtaaattttaagcacattcgttaacactaagtcacttcaccagaaactgtaagaatgacaggaataaacagaaagaaaataccaaaagcttcagtggaacaggcatggaaacaagggcacattcaatagggaaggaatcagaatgcatttggacttctcaataatagctcagaatgctaaagtaaaataggcaatgccttaaaaattttgagggaaattatcttcaagctagaattttatagctagtcaattattccaatataaggattgactaaagtcagttccaggtttgcacagaaggaaaattgcacctctcgttttttttcatttttaaggaaggtacaggcaggaagaagtgttttagtatgagagggtaaaccaaaaaaagagaaacatatgtgatgtaagaaaaagttatcaaaaccaaaacacaggatgagagactggtacagcagggttaaggtcatctgtgccagatcagaggaggcagactggggttggaggggtctctggaaggagtccaaaacagaggaaatatctgagcatttagaaaaaccattcatggagattttacatagctgttcaagcccttaaggaaaaaaacagtgattaaaacataacgaaactaagcaaattttaaaacaaggcaatcctccctaggaaaaatgaagagttgtgtaagaaaggagcaacatttcaaagtacagtacactacttggttccacactgacattacagcactgctgacttaatcaaaattgatttggaattaatttggaattctcaacctctataaaagggagtcaataggtaaatttgtttggatatatccagaaacagctgaataagcctattatttggcaatatggagggtaaatatcaaaagatatagatgaaaggattagagattacttctaggggaggaaagacttggatttctggaaagcagaaggcagagagaaacaactgtcttcaaatatttgccctatagaggaggaatttgattgattcttacttcagagtgcagaatgagaattggaagcaaatgtttacttagttttcctaaaaagaaatgggctatattgtattatgtatggcctccaactttaggaagtttcactaggacacaattgaagctttatgcacttcaattgaaaattgtcttcaaagaatttatgttttgtgtagataagaagggataagaaagagaaaactgcaattttaaagatatgataaaaagagagggaaaaacatatcttaaaaatatttcaagaatcacaataatttaactctttagatatatacagtatttatgaactaatgaaaacatattgcattattgttgtttactcagatgagaaaaatgcaaattctacctgaattatggggcatcctttgacagaaagggattctgctatcctttagtcttcaaaattatcaaataagtgtcaaagttttatattgcctcttttactatgacatcaggtgtctaaatgaaacctttaagttttccccagacttttaaattttaccttttgataaaattggttttcaaaaagcatctgttgtttgtttgtttgtttgtttgtttgttttttcagacaaagtttcgctcttgttgcccaggctggagttcaatggcacgatctcggctcactgcaacgtgtgcctcccgagttcaagcgattctcctgcctcagcctcccaagtagctgggattacaggcgcccaccaccacgcccagataatttttgtatatttagtagagatagggtttcactatgttgaccaggctggtcttgaacttctgacctcaggtgatccacccacctcagcctcccaaagtgctgggattacaggcatgagtcaccacgcctggctcagcatctgctttttaataccataagctaaacatctttccaagtaatgtctcttttaaaaacttttctagaatttttctaagcatcaaaaataaataaaaatataaagaaacatttcctcaatctgtaagaaactgagttttatccatcatagttttctccacattttgactttaaaaataactatgtaaaattttcagagcctcagagtgacacagaaaactttagagagaacatttaataaaatacaaagaaatctcttaaggtacctcctcaatgtataccataatattaaatcacctactttaccatatatgaaaaaatggaataccttattaacacactagaaatttgaataaaatgatgaaattataaatgagaatgctaaactcaataacggcagaaaccagttccataaatgtttactgaataaagaaatgaaccgatgctatgtaggaaaaaaccacaggagcaaacttgtatatacagagttaatcaggcttacatatgctttctgtatttcttctcaaattatttttatactttttttacattacaaagcttcaaattgtctaacatttttgctccagaaatgtaagatctgatatactatcctacacttactcttcagtagagagaaaattcagttgcttgagcatttttatttaaagggtgaagttttacaaagttgcaatgtatatgcacaacaaagaccttttaaatatgcaatctactttatctgaatggcgcagagttgaatgatctttagtcccacaaaaataaccttgaaaggaaagctacatgtaatagatctctttttcaagatttctgttgttttgttctgactctaacgggtatcctgtagatcagcagagacaagaaagttctcctgatttcacctaagattgacaccttgccaattttagacgagaaatgctgacaaggagacaggatcccatttgagccactatccgtgagccagctccctgtcacagaagaaatgtccatgagtgagggaggcatcatgtctgattatcttccctatttctagatgtgaaaattctcctaaggcccacgaataaacaataaagaggttgcccttagatagattctctagttagcagaataggaaataatttttttttttttttttttttttttttgagacagagtctggctctgtcgcccaggctggagttcagtggtgccacctcactcactgcaagctccacctcccaggttcaagccattctcctgccgcagcctcccaaacagctgggactacaggcacgcaccactacccccagctaactttttgtattttagtagagatggggtttcaccatgttggccaagaaggtctcgatcttctgacctcgtgatctgcccgccttggcctcccaaagtgccgggattacaggcatgagccaccgtgcctggccggtaataatttttttattagtgtatcagtataaattttcttttattcttaccttctcctaaaaagaacagtcacatcatttacacattatcatttacacatgatcattcacacattttaattatcacactatatttaatgacatcccaaacagaatgattaatcattaatgatacaaaatgtcttctgattttttctatcaactattatagggtttgtgtatgatgggcaaaatctactataatagaagacatgaactttcctaaatttttcaatgtttacaccttgaaaaaagttacaggaaagaaatagaaatggttctactgtgagcaagtctttttctgacaattttaatgattataagaaagtagatcttgctttggtattttaggtatgttgttactcatatttcagagatattttaatttagagtaattcttactattaataagtatcaccttaaaagaaatatttgtctcaaaataatgtgacaatcatgtttaagtatttcaataatctatacttaatgattaaacatatcaaattgattttataaaactattttttcctgcaaatttaatttcattgcaagtttctactgattttgaatggattctaacttccagaggtagaattctttaccaaacatcaaactgatatttaaaacacctgaataagctaacaataatgaaacttgattgattgagaagaaaattcatttcttcccttttcagtccttcaggaatctttcccatcccatatcccaccacactcctaaacactttcctctgcactcataagattgtgtgtgcagaactaaccacatgtatattctttcgttttaacattttttaacctcctgtaataaaaactctcttatgtcctgatctaattgtatttttatcctccatatctattggtgtctaacacacagtaacttctaggtaaatatctactgaataaataaacttaatagaaattcataaagattataaattagggatttaacattttttaaaaggagaaatagtgcagggagactaatctttcttctcttaagtaaaccagcagagtaaagtagcaagttttctctcctaaaaagtttgcctttcaaataattttaaaataaatctttgctacacacacaagccatccattctctaaacagaacagtttgctgttctctccatatttgttcactttaatcctctcagaatctcccatctatctacttaatgcaaagaaatagaaactcgtttactgttgctacttctcagtagctattcctgggattggatgaccataaaagactgaaatgaaaaggtgatacatccttcaatacatatatttaacagggtacttatatccagaacaaaaaaatagctcccatatatcagtaagataatgcagaaaatccagtagaaaagtggacaaaagacttccataggtgcttcagaaaaatatgatatcccctgggaataaacaatttagccatcagagaaatgcaaactacaaccacaaagaaataccacgacacactcactagaattgctaaaatttaagagtctgataatatcaagtgttgacaaggatttggggcaactggaattctcatacagccactttagaaaactgtcatatagtatgtactaaaactaaactagtttacactagtttatactagatacactaagatcctgcaattcaactcctggctacctaaccaacagatatggatatacatgttcaccgaaagacatgtctgagaaatgctcatcacagcattgtttgtaggtcccacattaaaaacaatcccaaatgtttgtcaactgaaggataaatattaatacaaatcatattaattcatctattcatagaagtcatacaagttatatacaagtcatagaagttatatgtttatacaatacagtactaggattgcaatgggaaactacaattacacgcaacgtaaatgagtctcaagtacagtatcctaactgtcacaaattttctaagttccattcaaaaaagttcaaaggcaggcaaatgaatctattatgtttgatgtcagaaaagggttaccttttgggaagatagtaactgcaaggcgggatgtgggggaatttctgtggtgctgatgttattggtttgagcattgtctacataggcgtgttcactttggaaaattcattgaactggaccattatgatttgaagttttgctggatgtcttatttccataaaagtttgcttaaaaaaaaagcaactccagtccaaattgatgtctctcttatactagagtacaactttctcaagtagacttgtttcagattgtttgaaatattattagccttttctactatatttggatttctaactcgaggaaaaataatatatacttactggataagtgataacaataagcaaaatatattgagcctttatgtcacaggccctatttcaaccacttttcctattccattttatccttaaaaaataccctccttagtgagctactattttcattctaagaaaatgaaatgttagaaatgctaagtaacttggcaaaggtcactgaataaaacaggagtcaaactgaggcattctaataccacagctcttattcttacctacaagatctaggatagacttaatatttaatatttcaaggcttaggaataatatgtcttcaaactcttggtaaatgaaagttcacatttcttttggtaaagtcaagattatattctcttacatgagactatctaatacaaaatcttgttatgcatcatcagatgggcccttcacactgcaatgtgtaatcctagtgctctcagattgactttttcactcactgcccaaacttttactctcctcaagtccaaacttccctgatctcaaaattacccatcacagcttttctcaactttattctgttcagatgttgtcttatacctcttttactcccaccttcagatgccaccccacccttgggtcaaaaacagccccatcaatcactcctccactggcttattctactctacctacagacacttgagtgctctgggtgagtaatccacaaacatctgatgactagctgcacgaatggcccctaaatcatcctcggcttttggaacattccctccttgacttttcgtctctagtctgtcacttttcagtttactgatattttatgatgagaattgtccactaatcttctcaagacacagttttgacacccagtccaaaaaaaaaaatcaagtttttctatacctatagaatttttaaaatttcttaggcatgatcctcattggtcttcttgacatggccttaattcatatttctaactttatgcccaccccttgttctcacaaactagtttcacaaactggcttgtcattacaaacaagtcaaactgacctttttttttttttttttgagacggagtctcactctgtcgcccaggctggagtgcagtggagcaacctcggctcactgcaagctccgcctcccaggttcacaccattctccctcagcctcccgagtagctgggactacaggcgcccgccaccacgcccggctaatttttttggtatttttagtagagacggggtttcaccgtgttagccaggatggtctcgatctcctgacctcgtgatccgaccgcctcggcctcccaaagtgctgggattacaggcgtgagccaccgcgcccggccaaactgaactacttttttctggtctctatggttttgctataggtggtctcctacctggtacctcttttcccaatcaaaatcctatctacccatcaatccttagacatataccttctcccccataaatcctttcatgtttctccaattagatgcatattttctgacttcctatgacatccttttctggcttgttatagttatttgcatgtatatttaatttttcctagactgtgagtcctttgaggagagtatgccattcttatttatcttgtttcccacaattcttaacccagtgcctggtagatatgggatctcaataatcttgagtggaatggtaacatgcaattctggcagtgcagtggccatgattcccttcataactacttctaagacctctgggtttccctgagtcacagctgcaaaatatcaaaagctgtctaataggatcacttttcagttcagttaactgacacagaaggatttactatgtgacctaataactgaactatcaaaaactttgcaatatttcatttaattcttacaagtagatgtataacatataataatgtataagagttttaatacataaaaggccatgttacaacataatgtgataacaaagtaccttcctggatatgtcctaccactggttaggaattgggtaaattagtgtatgagcttaagtacaatctagggggtgaggattacaaccaggaagcggtcaatggtggctataaaaacaaattacgtaattccaatactgactccaatttataaggtttgagagatcttattgaacatatattcctcataagtatcagagtttctaagtcacagtctttcaaaaggatatattgctcagaggtggcaagggtgattcactggagtgcccaaaacattattttttaggacatatactcatatttgttttatctaacactccaggaaaataagcaagatttactacatggggctatatgtcagtctgacatacaacatttataactcattagatttcctgacagaagaaggagaccatcactctgtcatccactttcagtgtactcactgcagctcatacatgcacactgaggaagatatatgaactctatcatacgtataactcaaaatcatctgtagtgagatgaggagtgccaggaggaactgcaactacaactgctgctgctgctgctggtggttggtttatgttttagttttaagcacacagacttttgctggttaagtttaaaatcataatgatgaatgggctcataaagatgaattaccaatttttatattaccaaaaagaggcttgttccaaatttgctgaatttttttctatgagaaaaatgtgatacctaatatctagtctttaaggtgaagaaaacatttagcagtagttgagaaagcaactacttttagaaactcctactcaggagagaacattttgaaatgtttggaaacgtttctcctgctaggtgattttgcccagggcatttgtttttttgagacggagcctcattatgtcgccaggctggagtgcaatggcgctatcttggctcactgcaacctccgcctcccaggttcaagcgattctcctgcctcagcctcctgagtagctgggattacaggcacgcgccaccacgcccagctaatttttgtatttttagtagaggcagggtttcaccatgttggccaggatggtctcaatcttactgacctcgtgatctgcctgccccggcctcccaaagtgctgggattacaggcatgagccactgcacccaggctcgccaagggcatatttttaaaactttgaagcaaacatttcagaaacgatatgccaattgtatatttctaaaatgttgaaacaaaaatttctaatctgtttaaatggcttccgaatatttcaaagtttcactgagttttaaagcttcttgttaaaatattgaactacagcttcttttagtagtacttcaagaactgaataacctggaaaatagaaatttgtgaagcaaatttcaatctttttccaataattatttatactggatttgaagtcaattactggtatatatcaggagcattcagtgacaaaccttgttatttggaggtattttgtgaggtatatttttcagctaaagaagttattgaaaccacatattgaaataaaccatattttaaaactgctatagcacaatgttgaaacaaaatgttcaaaactaacgagtctactacttttaaaaaaattaaatggttagaacagttgtgagagaaaagttaccattcacaaaataaaaattatatttaacattaattattcaacttacccttttaaatttacacttgtatatcttctataaatcacataatcatatgttagtttatgtgtgcaatgtatgactatataatacatatatatgggcacattctcaaaatgttctactgagaatgatacgtatgatcaaaaaattaaaaatcaaatgacttaaaaatgtttattcctaacaaggaataaacataaaaacgttaatgtctgagtgatgtgataatgtagaaattaaagtatgattttctcaaactattggaaggtaacacacaaagtttctataacaaaaatttgggatatctaaatgtactaatattaagaatgcttatatatcttctataaacagcctcaatatacagcacatagatattgtagaacactgacaacaatttcttgagatgcttaaacattcctaaagcattatgcctgaaaaataggagaactgccatggaaacatggacactttcactttctttaacatggaaacatatagaaaaaaacatggcctataaccatttcatattgagagtttttagggttattttatactgtacattccaacttcactcaacattataacacacacacacaaacacacacacacacacacagtctcctcttttatgatctcaccaataattagagtatccacttaaatttttcccaggtcatacatttcaaatctgcagggcccaattttgtcttcaaaattattttctgaacatcatatctaggacaaactatacatccatctacattctcttctttggtgacatatgaaatccacatgtgcagaaaaggtagatgctgcaattatgcaaaatattattcttttatggtagggaattaggacactgcttatctcttgccaggttatgacagaatagcctactagtttaggctttgtagaaggaacaattgccgaattattttactgttaaatacaatcttcattactaattcttggattatctcaacctagtaagccccaaatattatgggtcttcagtatgataaatcacatggttgttactgaaatgtgttaggaatctcacccggcattctggccacctgtttattaattacattcattgctaaactgcaaacaccttgtccacagtgcctggtttatttttagtgaccattacgatgtctaatatgtagtagatactcatacttttggggagaatcaatgaatgtactttagaaagatacagtagaaaacataataaatggaaaaatactagttaaatacttaattgttatgagaagtgtattataaaatttatttttaaaatatatttctaacctgtttactatacttatgtgtctttttcaaatttaagaaaacaattactatgttttcactgaacactccactttacaaagtcaacataaagaagtggcagtttcttgaaactatttgcctacacattgcctggctcctgctggccttaggagcaacagaggcagtttcttcctgagtgcatttctcttaaatgggagctacagggggaggcagagcccaacaccctttgctcagacccttagtgctcttttcaaatggacaaatgtcagatttaccggtgtttgctgctactacatgctcatttcttcttcttcctcttcttcttcttctcctcctcctccttctttttttttttttttttttttttttgagatggggtctcggtctgtcacgcaggctggaatgcagtggcaccatctcggctcattgcaacttccacctcccaggttcaagcgattcttctgcctcagcctccagagtagctgggattacaggcgcatgccaccacgcccaggtaatttttgtatttttagtagagacgggggtttcaccatgttggccaggctggtctcgaactcctggcctcaagtgatccagccgcctcagcctcccaaagtgctgggattacaggcatgagccactatgcccggcttacatgatcatttctgacagtgcttctatttgttgcattccattatatcatataatagatttagtacagtatatatttttttctgcacaatgtttcagaaggacattttttttaagaagaaacacaaagtgaatgcgccagaatttagggttcaagtagcaagctttcatttacaaaaaaaaaaaaaaaactttctctttttttgtgtgaggaaaaacaatctttaaggcaaaaaggaaaaaaatatatattctcttccctactgttggatagtcatcattcccaaagcacactgaatacacactatttgtttaccaaatatgatttcattctatgtgaggaataaaaacattccaagaaaataaattacttctaaaatgaaacttagtgagaaaatttaagtaatatgaatttacttaaagagcatttgctagttgaattgtgttacacgtaatgtcccttactatatatgaatgagaaaagtaaaacttttactcaccttttaaagactaccttggtcataagcatatctatttttaacttattaaataaatttgcttacatcattaatttgtattcattgtttataatatataaagagaaaattataaaaatttcacagtatttaaaaattgactgctaacaaataagtcttatacttttaaatcccagtgttagtttctaacaagaatattatgtaaaaaatacagtagcttatacataaactaaatacaattatgaaaacatatactattcaacaattaaatgtttaataagagaaattaacagtttgttatttaagaaaaacaccaccgaaagaaaggaggcattccttatattaataatataagatctgttcagtgactcggaacattttaagtgcaaggagtaaaaatacaacatacatatgaatgacataaagcacaaagccacaatacccactaataaacgggttaaaatacaatcatttcacgctgactaatcaccaaaaatgtagccattaaattaacataggctaagatttatttattcctttttttattacagcacaagactttctacaacatgaagaaaatttaaatgtatcttaaagctttctaataatattttaaataattttacatttcacatttcatttgctttaaaatgaaaaatgtttctgagatttcatgtcactcactcatacacacacacatgcatgcatacacactcttaattttctacttagtcaacaggatctgttgaagttaaagttatccatgaaagaatattaatctaatatgctaataagctattctgaagtttgtctaatatgcaccaacactgaaagaggtaaaatgttatatttggtattgacaacagaacttcagatcccctaaacccatttaatataaaagtctaatttaacaaataaatatgcttcatataataaaagaaatccagtcactctaataatatgtaagtacttcatacatataaaaaagtaaatatgattgtaaaaattctatacaaacctttattgtgatttttaaaacttcaatacattcaacttatcaaaaaaataaaaatactacatttcttcatagtgcaaagagtgaattattcaatgaattccttttgggatatacatgtaataacactaaataattctgcacatctgtcttactatttggcaatctgtgattattgttttcttggtcatttgtttttgtgaggttgaaaagtcatctatacagaggactttaatgagcattcagatttttcacttgtgatataatttacatacaaaaaatagcataacaaaaatatattggaatatagtatagatacatttacataaacattgcatgaatatcacagtggatatgtagagaaggttgataaaccttaaaatgtaaaatatcaaaggatcaaaaacatctaaaactgacctggaatgaattatttgtaattttaatattctataaatctaagtacctttttatgttaaacttaaaagcattataatgtttattaaatagaacaggggtcagcaaacttttcccagaaaaagttagatagtaaatatttcaggctttgtgagttacagagtttctattgcaactaatcaatgctactgctgtagtgcaaaaccagccatagataacacgtaaacaaatgagcatgactgtgttccaatagaacttattttaaaaataggcaacaggccagatttggtacctggaccatagtttgctgacctctaaaacagagaatctgactcacaaacacttaattttaattgcttcaatatctaatataaagcatgagacctaagtaaatgtttaatgcttggtgaattgaagtcatgaatgggtagggaaaataaaacgtctatgctcagaaacaaatgccattacaattcaatctcattagcagttaggattctgctctcctaattgggaaaaaattccaagaaagtaatccacagtcttcttaagaactaggcttgcaaactaaaaccaataaaatgaaagaagatggaacagagacacagtaagcagaaagtggatttccaatctaagatagctaataaaaatatctttttatagtgagttcttatagtatttcaaatctccccaagtaaactgtaaactccatagggataagaaatatgtttcaattgtctctggatcacagtgcctaggatatagtagatggtcagtaacgacatttattaaatacatatgtgagtgctttccatggcaaaatatgtttttcattagttcccacaagatgatggtcctttgaggcagcaatttcactttaagatcctcctataaagttaaaatgttctgttgtttaatatcatcagtcacactttgactataaagatgaatttcagcctgaaccagagcttgacctactcttcaaataacatgacttgaaacttgggtttatatcttattataaagatgtttgggtagggcaaaacaaaacaagagcaggcatcaagggttggttataaaactggagttataactaattttcaaataaagaaccacatagctttataaatttaattacaaatagattataaactcaaatcagttcacttaatggcaatgtacttggtcattcttgatttaaaatatcaatggtaatcaaaatgcctatttcaatatagttatatattaattactcctcaaaaaaaagatatttgaaggctactaaataatcatgaacaaagtttatgagttttgtctatggctccaataaaaacccagaaaattaaaatattcccaaaccactaactccacaaagtgggagaaatgcataatctatagattattacataaattaaacttttgcatgacatatgtaaaaaactgtaaacaagttctgttatggaagtaaatttctctacttttataaacataatattttcacatttccaaacaaaataataagttggataatgacaaaaaacaagttttaaagaatactatttggtttttggagcagttatggatattaacagatgaaagccacacataattatatgcctaaacaagacacagccttaatttgccatttttacaagcacaacgtcaacattatatataaacataaataatataatagtcctgattaattgacagcaagccaaacataaaacggagaaaaatatttccattagaacagtagtatggttcaaagttcacatattaaaaaataaatatataaaaaaactattatatatgttacactacttgaaattaaatagattcctcttccaaactatcaaatttcaaaacacaaaccaagagggccaatgatatactttaaaaagaaactggagaagacaaagtgtatgcatcccacaatttataaagagaataaattaaagcaaaagagacaaaacaaaacaaaacaaaaaagaataagaatattatcataccatacatagcacagaatactatgcagccgtaataaggaatgatatcacgtcctttgcggggacatggatagaattggataccattatcctcagcaaactaatacaggaacagaaagccaaacactccatgttctcacttataagtggaagctgaatgatgagaacacatggccacatggtggggaacaacacactggggcctgttgggggaggagtgtggggggcagggagagcatcagaaagaatagctagctaatggatgccgtgcttaatagctaggtgatgggatcatctgtgcagcgaaccaccatggcacacatttacctatgcagcaaacctgcacatcttgcacatgtacccctgaatgtaaaataaaagtcgaagaaaagaaaaacaatgaactctccctcactcagactcaaactttaaagtatgacatgttaacagacaagagtgctatcataccgatgtccatggttcctgatgccatgacacatcagcagggcaagcatgcatatgacactgtattacgctaggtggcttgtttacaatttcacagttgtgatcttctaatatttggccattgggaaattgacatattacaagtcttgattttattcctcctccacatgtttgtgaacactaaaaacaagaataggaaaattcaaaactgtggttttaaagagaataatgtattgcttcattcaatgtttaaacataattagtaattatgtttattctagtaattttaacataattagtttactctagtaatgttactctagtaatggtagcgtttaagtttataattacttcataattatcaacatttccccctagacaaaaaaataaatcaaagtttcaattccacgactttaaaaattgaccagattttgaggattagtatcataatatatttcagtaagatatccaggacctataagataatgttggcaggttaagccagaatcaaaatttatttatctaagtcatgagcattaattacataatgtacaatatccaatcaacaggttactaagtaaccatgaaagctattaataataaggtacgtctaattttataaacatgaaatgttcagtatatataatataaaaacagcaaataacaaaacagctgtataatgtgaaccaatttctaaaactcatgcagaacaaaagcctggcaggaaatataccaaatcttgctaaaagtttgtatctctatttggacatataatttgaattttcaaaataagtgcatgtaaactcagaaatagaagtactttcgttttggaaaacagtaaaactgtatcttaaaaatgtgcttgatatgtattaacacctggtctgggtgtactttaaaaacatggtttcaaactcccaatgaacagaaattatgtgctaaaaatcattaagcaaaaacatttgactaagtcattcattttatttatccaaagctaatagaaatctttgcttcttatttattaccattccacattacgaaggaggttagtattaaaagtgactttaaaaaattatctttttatttccagttcctagagagtgccagtgcatgaagcaagtgctcaataactgacaactatctggcttaaagaaaaagatttgccaaatgcataacttagtaataggattaaacatgttttatattttattctagttttctatttttatatcaacctaattttctaagaaattaagagaataaaccaattttagaaagatactagtaattcaaagacatattgcctagcatattagagtctgctgaaaaatctagaatatgcattttttaaatcatgaatgagtgacctaaaccatgacagaacatctattaaaagaacttggtttaatcactcaattaaaataaattagtcgggagaatcacttgaggccaggagtttgagaccagcctggtcaacatggtgaaattcccatctttattaaaaatgaaaaaaatagccaggcatggtggcacacacctgtagtctcagctactcgggaggctgaggtgggaagatcgcttgagcccaggaggtggaggttgcagtgagtcgagatcacgacactgcattccagcctgggcaacagagtgagaccctgtctccaaaaacaaaaaaaacaaaaattctttttctacatagtatagtgaaatcagattattgaacagtataagatgctttttactttcagtcttcagagatgtaataatctcacaagtttagaaaatattatgacttacttctccccaatttccgtagttccactgtggacaaggccctggaccacattgctgtaactctggaggcttggaggctgcatcgcagtaactagcactttgtccattttcatcctggcagaccacagccctatgctgaagacctccagaacaactgctggagcactgacaagaataaaacacaaaatatgcacaaactgcggattccacataatgaatttacatggtaaaaaaaaaaaatcagcattgactcaatcaaaatcaaaccctacattagaatctccttcattggaatcacaatttgaattgagaaaatctatcaaaacacttgagttatactgggagcttcattagaatttgttgatgaaaaggtgggactttcaagtttgcattaggaaacaattttcatttctatcataagtgttaagtaaaaagaaattaaagtttttgagatctcactagaaaggaataaaagacagtattaaattacttaactttacactggtgtttttctttattttgtattatgaatgttatgtaaaatatgaactaaaactataccatttgtagtttgtcatgattttataccagcttattgtattgctatcataataattttgggatttaggtttattcataaacatttatagtcttaccccttaaagcattttcttttgtttttattacaatgaattctaatcagattgttttacagtacattcctctgtaatcataataacacattagtgcataattcaataagaactctagcatttgtaatgagcatcaaagacgcttaatctttttaatatttaaactattgatcttgaaataaatttagcatttaaagtactgatggcatcatatacatacctgttaaaaggatgtaatataacaaaattacagaattaatataactcaataaagatggcttactgatccccatggtccggttctccactggtttcctctgactgatggatggaccacctgattttcattatcttcaagtttttgagttaatggcaaattcgtgcttagataatagcttggctgcacaggggaactaggaaagtggctgtgtgcaggagggcaggctgccaggctacattcctgttccatcaaagggcgaacttcaggatcacagtaattctcatcaattggctgatggtagttcatgcataaaacttgtcgagttgtttttccatggccacaggaagctgaacactgatcaaaaatttagccaatggtaatatacaacattaatttatatttaatatcaaatatatttaaatttttcattttctttttttctcataagaatacttacgggtgaccaatcccctgcttgccactctccacaaggggtaaaacagtcccatatttcagcaggtcggggtaagtgggcacaatatgattcatctgctattctatcaagagcatcacgacagcttacatagcgggcttgagtacctcttccacaagatacggagcactttttaagaaatcaaattgtatccgggcattatacagtagtacctcacccatgtcccttttacatagctgttactcacatttctaaaacatccagtttcttgagaaattttaaattattatagataatattacctgacatcacttctgagtcaaataaagatggggtagtgaatattccaatcagtttagatcataaatttcacaaataatgtatagtaatttcaataatacataaatataatgatttaaaataatgcttagttatttgctaaaattaaagatacttaaaatattttaggtaagagaatcttatgatatcaataaaaataattttgatatataatatctactactaagtaacagatagatataattccataattaaaatattcagagaatatatgaagcttaaaaatacatattctacaagattttagcaacgtatactccacatacgttaaagctttcagtgtagaaaaacaacatgaaaatgtttgtagttcaaataaaagccgatacagcctaatactaaatctgattctcataacaacctgtgacgtaagtattattagtattcccattttgaagattagaaaatatactcagaaaacttcaatttcttgtccagagacacagagctcttgaaaggcaaaggacttagccattaattcctaattctaaaccctatacttctttgatgccatcaaaatacctgagaataaatgtatacattgtgaaatctctagcaaccattttgttgatgtctaaaagctaccataatagaaacactgtatctattaaagaaattcacttactggggtccaagaaccatgtcgccattgtgccatcttttttatgagaacagttggtaataaagcggtctcaagtttagaaataaatgagcaaggtgtaagtacacagctctgttcagaagaaaaatggttctcgtaaaacattaattaatgactgatttatacaaaatctaatacttcacttcttctgtatgtctcaagaaccgttccatactaaattagaaattggtaatatgaatgttttcattttcaaaagcactaactacagtatcgtcaagtgtcaatagtggataatgactgaatcctaaagtttggaccattctgtttgattgctgaaaaggaaaagagcttcagtcctttaaaaatactgctcagctaaaacattctgaacggacacaaaactctaccttaaaaaacacaatacactttaggagttcatgatatttataataatagatataaccttcttcttcagttcaaagaatggaaattcacaagttaaatgagtgagcccttagcagataaagagtaaaaaaaaaaaaaaaattcattgataaagctacaaagctggcaaaaccaagaacaacaaattctatttttttgcctctctctcacacatacacgtgtttaaggcatacaagtttaagtggaaaaaaataagtaaagaaataattttaacacatcaataatctttctgtctcataaatctttttgtttgtaaaccatgattctttttacctgtctgtcactggggcgactagcttcatggcattctgtgtcctctaacactgcactagctagctcattgacacatttaacatctcgcatctgatacccatgtccacatgtggttgtgcactgaaagaagaatatagatattaaaaaaacattgtttcccaaaagttacacaaacttctattttcttaatgaataccctgttaataatatacttttaataatctttttatcaatcctttatactagatttaagacttaaaaagagcaaattcaataaatatgcatatttattcaaattaagtaaataccaaatattgaagttaaccaaactgtacaacaattaatgtattctgaaaagttgtcatataaaaatataaatagaggcctgatattttagaaagcagtcaatatgatttaaggaaactaaatatttttcaaacaccacctagtgtatgcatgtcatttaatatactaagtaaattttaaagagacaaagaaggaacagcatataaagttaaagggaaaatgagagaaggcttcctgtcaactgtggcaacctctacagaataataagctactccatcctcatccagcctgatcattgctcatcctgcagactcctagctgcctgttcagcaaaacgtctaaacgatgcctatcctaaaaacaataaagatatcaatgcagacacagagatgaaaatatttataatctaaataaagctgataaaagcataaagtctgtagcattttggttaacaaaagggaatttaaaagcaaagctgaaatatttattacagaaaaattagcagtactatcaacatgttacacataaagattcacatttcagggttgctgttgttttttaataaaccaagccaaattccattgcatccactaagggaggagtaaatataacacaacttttgtgctattctgtaaagatagatcaaattagaaaaacccatatcatatactcacaggaccccatggtcctacttgccaggaagcacatgtatgaagttcacatggactcagagattcaggtttggtacttgaattacagaagccatcactcaagtgatctacattcagctgacaccatacctgccgctgctttgttcctttaccacatgtaacaaggcactgtaagaataaaactgatcattatttatttgcagcattagtcaacacaaatgccttaaactgatgcaatgatcaatttgcatatagaaatacagttgaaaaaccattcccaaatgcattttccctcactccaccagagatattcactgggtaaaatcagcctgcccctaacttctgctgcccaagtcccactgaaacatccatttatcctagaaacaaaggtgcaaaactaaccttagaataagtattcatcccaggctgctgtggaccctggcactttcttatgcaaagggttatagattaaatatcagttagtgttattactagtcagatactgtaaatagtataaagacaaactatcttgtatatttctttttttttttttgagacagattctcactctgtcacccatgctggagtgcagtggccaatctcagcttaccgcaatctctgctcattgatactccacgtcccagactcaagcaatcctcccacctcagcctcccgagtagctgggaccacaggtgtgtgtcaccacatccagctaaatttcactatgttgctcaggctggtcttgaacatctgagctcaagcaatccacccacctcagtttcccagagtgctggtattacaggcatgagacactgtgtgcctggcctgtcttataaatttctgacagctttgataatagttatttacaaaatgatgaaataaatttaagcacttttaaattttgtaaagtcttagattacaaagctttactaacacaatattttaatagttccaagcatcatgtgtttaatgtacctcgctccattcactagcagcccaactgggacaggaaaattcattgcaattctctctcgtcactcgggacagttcttggcattcattgtcagcaagacgatggccaaagttattcatacaataagattctcgagacctttcccctcctccacaactcctggaacactgattaaaaaaaaaaaagtggtaactaatggaaaaaaatcagattttcaacaaaattatacttcagagtaacataaatacgtaattagaaagaaaggggcaactttttttaagcaatcatttttattgtacctgagaccattctgaataatgccatcttgtgaagacacagttaccatggcatagttcttgggtaggaggtttaagctggtcaccacagtagtggtcatcaacttgaacagtctgtccttcatgaatggaatacttcatgcaatggatgtccaaggttctatatccttgaccacattgggatgaacattcacttttgccaataacatgccaccttgaaaaaagatgttactatacttaggaggtatattacataatttaaaaacagattcagagacactcatgcattcagtttttaaaatcctaaaagttgatagacaaaccaccaaaaaacaaaaccagtctgcagccaggaagccagcattatactactgacctcatgccagcacttggtggtagctttggaggtgcgtccaaggaaccccaagcttcctcaaaaacctctgaaaacaactggtttagattatgattacccaattacttagtggcagatttaagataataactgaacatatctgactgccaatcagatagtttatccctatgcaatcctctataagtatttcgattttatgaccagggaacgtctaggaatttgactacatcaataaaaataaagcatttaaaaagttaactagtttttgcaaagtacactacactttctcattcattcctgtaatctatatttagacatgtttccaggtaaaacatgtcttccacaagtaaaaatgttagttatagccaaattatcccaattgtagtctagcattcatcaatgtgagggcaccagtataacaaaacacagaattcacagaattcatttccgtccctaatagcatctcaagaatttcactgtgcttccttttactactatgtagtggatgcaacttatataggcagttctactactgtgcttctgctatgccttcaaccaacatcataaatatatagaaattctcatcaagtgaaagaggttctggccatacctgaatgttaaatggcacctgctacaatgctaaaaataaatgtataaatatgatagatggactcattgtataccatgtcactacaagaccaatcacgcacacacacacatgcacacacaaacacacacacacacacacacacacacacacacacacacaaaccaaataacaagaaatttaaattagaagtataaacttgctgtcatgatctaggatcaatttccctaaagtttaatggacaaaatactgatagaatgtcaaggaaatcaatcaatttgatttctccaaacttcagaagtttactggttcattaattccgtggaaagtaaagaatcatgctaaaaaatttattgtttcagatctttaaaccatccattttcagataacagtttacttgtatttattttacagacaaaattacaatctttttctacataaaatattgaggcctatatactggtattcagaaaatactatgaatgaaaattcaaatcaattatgtactgagttttaccataaaatagtgagcctgaaattttttcatggcatggcagatgatgagtaataattgcatgtccatgctgtgtcagtcactgtgttagacattttaatcttagctcacttattaatctggttatattacatattatttctcttttaccttagttcacagtctgtattgcaactttgagtaacaaatgatggaagtggcaagtggtcacattctttatcagacacaacactatgatcactcttatgtatgcaagttatgtttcttcgctgaagaccttggccaaagtcaaatgaaaataaaaaatgaaagaaaaattcacagttagatgttccataattatgtaattctgctaatagcttaaaggagccagctaagcaagtaaaaatttccaatgcaacatacaggatatactagtatattaatctaatgaggaatgacttttataataagtaagctgaatcctgaatgactgaaagtttgcttaatgaagagatgtacagaagatgggacaggcattggagtaaaatgaaattcactatagtgggatagagtggttgttggtgaataattgagtagctaaggacagcactgttgctatacagtacactatattactgtcatccatcagctacctcagctacctcccattttcccataagaggattgcacatctctattgctgcaatgttatagtaacttcctgtaggggaagaactctttcctgttgattggcatcaggctttttatcaaccgactgaaaaggaacgtgacctattccagtcccacccagctctctttcctttttccctctgcctccagaacatcatttcccagatacagctgatctttcagcctggaatcatggaaaaaaaaggcatagacaggcaataaaaagatcagtgtctgtcaccagttgtgggggaaggaaggaagaataaatagatgaagcaaagagatttgtagggcagtgaaactactatgtatgatattatattggtgaatacatgtcactatacgtttgtcaaaccatagaatttacaacacaaatagtaaactctaatgtaaactatggactttaattaataataatgcatcaaaattggctcatcaattgcacaaatgtgccacattaatgcaagatgttaataatagaggagtgtggaggagaatggcagagggaagaaagatgaatatgcaaactttctgtactttctactcaatttttcagtaaacctaaaacttctctaaaaaataaagtctaggccgggcgtgttggctcacacctgtaatctcagcactttgggaagctgaggcgggcggatcacgaggtcaggagatcaagaccatcctggctaacaaggtgaaaccccgtctctattaaaaatacagaaatcagccaggcgtggtggtgggtgcctgtagtcccagctactcgggaggctgagacaggagaatggtgggtgaacccaggaggcagagcttgcagtgagccgagatcgcaccactgcactccagcctgggcaacagagtgagactccatttctaaaaaaaaaaaaaaaacaaaaaaataaaaataaaaataaaataaaaaaagtctataaaaaaaaaaaacatggatacagataccaagttggagtagacccatagccaattagcagccaaaacatgacatgagcaataaataaacctttattgttccaagccattaagatttggtggtttgcatgcaggataactacagcaaaagcaaactaagagaagtggtcataactgaccagagtcatttgaactttatgctttctgcaatgaggagacagtaaagagtttaagcagtcagtgacatgaacaaatttctgttttatcaaagttcaactttgtgcttccagttaactaaacatgattatatacgttatctctgctcctttctcaatatcttttgaaatgactatgagaaattctgaaaacgcataaacgtaaaagaagaaaaaaaggaaaagaaaaaaaacagcaaggaaatgaaattttgaatatgaaaagtagatggaaataactatttaacagagccaaggaattggaacctaagcctgcaaagtgggaaagtaaataagcaacaaatcattcatgacatagaacccaagagaggcccaggaatggaaaacaccaggttcctctgacagggcgaatgtgtgaggggtaggcctgaaataataaagaattaattgaaaagtattttaaaagaatggttagaccactagcttcctagttgagaacagcactatccaatgaaaacagaatgtgaaccacatctggaactttatattttctagtagtcacgttaaaaaaaaaagttaaattaattttaataacctttatgtttagccccaaatatttaaaatatgatttgaacatatcaatataaaattattaataatatattttacgttcttttttcattctaagtcttccagatttagcatgcatttaacacttacagcacatttcaatagattagccacacatggctagcggctaccatattgcacagcatagctctagaaaaagtgaacttgagagcataagacacagctgagaaaagctgggaacacactctactgaaacaaggtggctaaataaaattccccacactgaatgatgtgatcccagcccattcagcgctcaatctcctgctggcaccatgccaacttctgttatcccgcagcaccctcatgacaatcagaagatgagagaattcctctcttgcaggaccgtttaactcaagaaaaaagatcaactgacaataacatttgagacttctctccaatgacatatgagagggctacttaatgaccaaattactctataatgaaacttctagttaacttgtctgacccacagagggctttcaatcagacttttagtacttttaaaatatgaacaaacagcgcaaggtcagtagacattctaggaaagcctctaacacacacaaaaaaggtaaaataaacaaaaacaaaatagacctaggaggaaacacatataagtgagggagcagaagaaaacttaaagactatgattaatacactcagagatatgatagaaggtattatattcataaaacaaaagcaagatgttatgagaagaaacattaagaaaacaatgaatttgagagaataaattagaaaagaaatatcagtttaggaatgtgaactagtttcccaaagataaaagagaaaagttaatgtgaggaagtcatctaagaacatgataaatttctcaagacaaagatttatgtttccaaattggaatggcatcttaattaccagaaaaatagatgaaaaaacaaccaaatcaaggcatattgtcctgaaatttcataccactagaattaaagagaggatccacaaaacttccagaatacaacatgtcatgtacaagcatgacaagcatgaaattggaaaacaagccagaaaacaagaacttcaaaattctaaagaaaaacattctctatttataccagctaaactattgatcgagcatgagaatatagttatgtcattttcagatatgaaaggtctcaaaaatattctcttctcaagaaaatactgagggatatgttccacccaatgaaagaagtaaatcaaaaagagggactgagaggatttagaaaacagggaatctaacacagaatactgaagagaattcccaggacaataatgaaggaaaatctcaaaatgacagtcattaaacaagcctaaaaaacaacatgaacaaattagagaaaagagggccacagtagccaaaggtaaagaaaaagtgaaagaaaaatcaaattgataaattctataatatgcttgacaatattaagacaaaatgtagagttctgataaaaagcttgaggactgataactttcagtacacagaaacaaacaaaagagggaatttaactttaactttagagaaactaaaaaaaatacacaaaaaaagggaatataatcagagttcactatatggtaaaagaaataatagttgcttttcccctgcacgcgattgtttaagagaactctcctgctttggactcccaaatcgtctcccaccatgtttttccaaacttccattttgaatcttgttattctctgtgtgttcactgcattttaaaatgttccttcattctcctgtttctgaaatttctccttctagctccttatatccacggtcacagatgagcttacccactcaagttggaatgctgatcccagctccccagattccaattatcttctaaaaggatattcaggacctttctgtcaaaataaatttttccttcttctatgttaaccaaagctctgtgttttctacctctattatccccgtctatcttgcatcatttccttgtatccctccactgagacactgctaaaataggaacatttgttcccatgaaatcattctgggaagcactgtccagatgccacaggaccaagactgtgccttttcctgaatagggcaccacagttcctttggcacctcgtcaggtcagatggtagactgttcttcacattctcaccacctttggtcaccgcctcttgctgcccactttctatgataagctcatctccacatggttcggagcttcctttgccctgacccactcctgccctaattcccaagctatttctctattcttcatgaaaacttttcttccattctatacaaaattctctatcttcagcttcagtctcctcaaaaactgctccctccaccttttctgaggtccacactgtgcgtatctatagtactgtatttaccattttattaatacattaacatatatattcatgcatctgtttcaagcactaaaataaaacatgaattcagaattgggatcttattaataatctgagcatattccctcaataaatatgtactgcattgaacataatattacacaattaaatattcataattacagactgcagactctagtctttccacttttttccctactataaattgtcctgctgttcccactctgctccttttcccactctatttctttccatttttcatgccatctatacaattatactttctcatggtcagggaaggaaaataaaagacaaaagaatgtttgatatctcaacaataaaagaggaagccaggttgttgagaaagactgtgtggagatgagtggaagaaaaggcagatatttcaccaggaagcaggatatatataagttagagaaactttctgtggctgtgaaaaagagaatgagaacgggaaagtaaaagaacagtaatagatagagaagggtgaaaagagtagcattaaatagtgctgttaagtataagaaacagaaagaattagtgaaaaaagtagaaaggaaaaaaagattgaaaacttttgtatgtctgtgggatatgtgtatggacagtggggaggattccataggcagccaagactcaaaagtacccaaaatgatgccagaatgcacagtcagtcttttctcccttattgaatgccagcgtaccttgacacattttggtacagccttcccatggtccataggggtcccatgtgaacatgtcactcctctcttccaaagggatattgaaggaataatgtacatcagggttgtataaattacccacacacaacacctcaataagaatataaaagaacatacaattaatacataaaaatatattcttgacatcattttatatttgataatgttaagcacttaaccagtagtttactaatataattaaatccaagtgttattactgatgactgagaatttacctgcaaaataagttctttctcttgtcgattagtactattaattctttcaactgcgttatttgatccactgtattcaataacagttcttgttccttgcacattgatttctttttttgacgtacttagaagaaaatttccattgaaaagaaaattcccttcagcgtcagataatgctgtaaaagaataaagcataactcatgaaatagtaacaccaatcaacaatacagaaaacacttgtttaacttttttttttttttttttttttgagacggagtcttgctgtatctcccaggctggagtacagtggcacaatattggctcactgtaaccttcgcctcgcctcttggattcaaacaattctcctgcctcagcctcccgagtagctgagattacaggcatgcgccaccacgcctggctaatttttgtatttttagtagagacggggttttgccatgttggccaggctggtctcgaactcctgacctcaggcaatctgcccgcttcggcctctcaagtgctaggattacaggcgtgagcaaccgcacctggccttgtttaacttttaaagttcaaatccttttttgaaattaaagaatgcaaaagtaaatttatgttgaggaaataaactttattttactgtaatgtgggattttaacaataagttaggtaacttcagcacatcagccaaagatattaaaataaattcactctatacttttctatctcagatggtcatcttctttcatgatgtatgtagcttcagaacaagcagtgggaaagcagaaagaagtcatgaccccagcagacagattagttcaatcatcctggtcatcaatggtagggaaagaaggagcagccagactgctgcatcattccatttatgcttatcttagaaaaaaggtacaaagctttaaaactctagggtcgggaggccgagacgggcggatcacgaggtcaggagatcgagatcatcctggctaacacagtgaaaccccgtctctagtaaaaatacaaaaaaattagccgggcgtactggcgggcgcctgtagtcccagctactccggaggctgaggcaggagaatggcgtgaacccgggaggcggagcttgcagtgagctgagatagcgccactgcactccagcatgggagattgagggagactccgtctccaaaaaaaaaaaacaaaaaaaaaactctagggtcaacattctagaaggccatgcaatgactatgccattctctatacaaacgtctagatcttctatagaaaagccctctatccctgttaacacatacgtgggtatctgcttttcagaataatactcctatttccttctctgttcatgtccccttcttgttctctctttttcccagtgacagacattaatatatacctatagaatatgtatatgtgtgtatatttatttatatactatatatatacaaatagagaagacaattatatagtatgtattagtaacattactttttaaatataaaattacatgtcacccaaaatcatgcgtagtaaaaagaaatcaatgtgggataaaaacaatggatttaagtttaagttgttgtgattaatgtctatgtaatcttggacaaacctcatgctcagtttcctaaactgcataatagaaataataaacatttctatttcagtcttttaatcaggatcaagtttgaaaaatgtttgtaagtgtgtgaattgtaaagtactgtgctatttatttttaattttcaagaggatgtgtaatacctaaaattttacactaagaaaacccccatattaatcaaatacttttttgcttgcttaagttatacttttcaatggaataataacctttccagaaaacatttgtttggcattccaggaaacctcaccgaaagcgcacaattatctatggctaacttcctaatataaatacaatacccctctgaaaaagcaatattgaagggattattgtaaaataaatttggtgtttctgtgtatatgtggactagtataactgtctttatgtattacgctgaattcagtgaggaacaaacaaagatctatatttagtctatgacatagacattcctctatttaagaatctgcgctttatcaaatgtggctaggtctatttaagggattattggttatgttaaatttaagggaaataaacaaaactttactggcttagaaaaaaagtctacaaatttcactacttttagttaccaaacgtcataaacataaatgttttaaaaattccttctattgacatcacatgtctattttactcacttcaatttagactttgatatttccgtttataattttctcacaaagtatattgatactttattggtgaacatttctttttttttttttttgagacagagttttgctcttgttgcccaggctggagtgcagtgacacaatttcagctcactgcaacctccgccccccagattccagcgattctcctgcctcagcctcccgagtagctgggattacaggcatgcgccaccatgtccggctaatttttgtatttttagtagacacggggttttgccatgttggtcaggctggtctcgaactcctgacctcagatgatccacctgcctcggcctcccaaagtgctgggattacaggcatgagccaccatgcacagccaacatttctaatttttaaagttgagaataacctgtgatccagtcccagaaagatatatttgtctacatttggaatctaagagatacctattaaattatttatctccaatatggtagcatatatctatgtaaatgtactgaagcaatatttttagcacaaggaaaagaatttcaactaaatgtaaaaggctaataaatcaaactatttatgtttgattttaataaatattttgcatcttgtattgaggtgaaactgatataacataaaattaaccatcattaaacgaacagttcaatggcatttagtatattcacgatgacgtacaaccatcacctctatctagttccaaaacctgttcaccccagaaggaaaccttgtactcattaagcagttgttccccttacatttggctttatagttccaaatgcaattcctgagataggctgttcattatagattcagattgccagttacataagttaattatttgagtcaatatttcacatcttattaatgtacagcagatgctttctcaatatcagctctgcaccattacctacctactccagcttggtgaattatagataactcgctattaagatatttcacaggcagaaggaaaaggtttttaaagcatcattttcatgtttgtgtctaaagtgaaattctttaagcctgaaagctaatttctaaaaataaataacataaattaagtttatactttagaaatagctaacagacaatatactgtgactacattcattaacatataaaaatgtgaaaccacagttctttttctgacttttttaaatacaagagcttttacaaaactgtatttaaatactttagctacatagtaaaaaaaaattaagaaaattatttaaaacatttaaccccaaagaattctacaattaatattagacaaaatgatagaagagaattttattctaaatacacatgcaactaattgaatataatttctggttatctaaaatacacgagaaaaaaactgaaaacaaattattgttcagaatttcattaagttttttttttttaagtaatacatttttgagtgcttaagaacatatgtatagggagcgctaagctcagtatgaaatgaaattgcatgcttgctaaagggactcctgttttccaagaattcacatcaactacagacttccatgaaattgcacataagccacatactggctgttgtttacgagaaatgtttaccaaggtaactgtcatctggttgtccagaatagctgtactgacgaatgtcaacgtttgttgctcctgcgggaatctttacaacaacattataacctgcaatataattttacatatgttaaatttcacaaaaagcagatggcccagaggttattactgctgaatggatgaaaaattcgaatagcatagtcagacttaattttgttgtgtctttacaaaattacacagtggttattctttttgagtcagtaccttacacaaattactgaggattgagaaaaagtggttgttgtcaagaaacagagtttaagattcttaacttttcctaatcttttcctacttctaatattcttaatatagaatggaatgaagctagtattttagctcctgagacccttagtacacatacccatttttaagctttgttaatgcttttatattttatactgggaaaaaaatagaagatttcaaatacaattcacaagtccaggagatattaaaataattggtcattgctatgatatattcacacagactcagtaaacagcaaaataatgaaatttttcaatttcattattgaaaaatcataaaaaaagaaaaagtttaaagctcaagttttagtttgtagtataagcaggaatctcttcatctattccccaaattttacattatttttacaagaatactaataaacttgttatgagaaaagtaaaaagtttactcaagtgaaatgaatgtaatatttccattttatgaagccaaattcagcgacattggcactgctcaaaagaggaaacattttatctaacatatattaagaaaaaacattttcatgaaaactaaaaacactcacattacatagttgtccaaatacgcaggtttttaaatatacaattagttatactctaaggatattattctaagtttttccttttccttatttattaggatttcctcctagttaactgcaccatgagtaaaaagtaatttttctcatacactacctttgataaatatggaattaacttaagaagacagttcaaaaagagcttaaatttacaaccctaatgtcagactatcttgcatgtgttttagagcagacttatttatatctaaggcatcacatttttagtgtaagacgataagaaatagtttcatgattcggtatacactatatgcctactggttgtaggttattgacctacaagaataattttaattaacctccttttcactataaaatattcttacccactacttttactatttatatctttactatttattatatttttttcaagaaagcaagcctaaggcattgcaaaggtgacaagatgaaggctaccaccagggggcagaaatgtgacaaatgctaatcagaccttgcaaatgagtttaacgcattgttctatttgcaaactgattaatgcacagtacaattttcacaagattacatatttgatcttaatttggttcatgtggctttatcctggaaaaaatatttttcagtaaatacagactgtaataagtatgtgccatgcattatagaagggaatcaaatgtgtgtagctcccaagaaataactagaaaaatcatatatcaaatcatctagtaaccgagatttgtaaatatcagagtataaaatgtactatgtttttcacatacataaaaacataaatattaagttttaaattatactgttttaatggaagtaagtaacaatttgaacacacatgaacacaatttaaagctgaacagtcagactgtaaaaaataggctaggtgtggtggttcatgcttgtaatttcaggactttgggaggccgagatggaaggatcccttgaggctaggagtttgagaccaacctagcaatacattgagacccatctctacacacacacacacacacacacaaattagatgggcatggtggtgaacacctgtagttctaggtactggggatgaggaggtggaaagattgctggagctcaagagttcacagctgcaatgagctatgattgtgccactgtactacagcctgggcaacagagtagcaccctgtctctaaataaataaatgaataaataaggttgtaagaaataaatttaatttgcaaagaaagttttaaagatctgctttaattatcataaaaacaaaaaaaaattgcccagaaaacattacaatggaaaatactttacatagtctcatgatattttggagaaaaattaaattatggccaatatgtgatccagatactgcctggaaaatcaaatgtgacaataattctgaaacatttaattcagaaaatatataagataatggtttcacccttcaccttcaatcaacattttctatgtactattaataagaaatgtaacagataggtcaagtcataccaaaaaaagaaagtgattcaagtaatgaaaatatttgaaagcaagtttcctgggaaaaatcacaaatatatacattttaggttatagggaaaaaaccatttcattaatgggaggattattcacatatcacacatcacagtcaaatagcactgaatttactctaagaaatgcacctaatacatttttaagaatcagatttgcctggggcaggtgaattcattaatcaaggatacatctggtctaatacagtatttaatttttttatatttaggaaatttttccttaacaatcattttggactaagggtatagagtagacaaaacagtaacaaagaattactgttacaccttctttacagactccattattatactaaataaaagcgaaatctagaaacaaatacacaacttaccataatgagaactgttgaagacacctgttattgtcttgcatgaagagttgtccccaccacacactccacatttgtctatcttggcactggagtttaacacgtgatcacaaccagctgccttcaagacacaattacaatcaatattataagaatgactaattatgaagaaaagagagaagatccaaatacatacaatcagatatgacaaaggggatttaccactgaccccacagaaatatagataactctcagaggctactatgaacacctctatgcacatgaactagaaaacctagaagaaatggataaactcctggacacaaacaccctcccaagactgaaggtggaagaaagagaatccctggacagaccaataatgagctctgaaatggaatcagtaataagtaggctaccatccaaaaaaagcccaggatcacacgattcccagctgaattctactagatgtacaaataagagctggtaccattcctactgaaactatttaaaaaattgaggaggagggactcctccctaactccttctatgaggtcagcatcatcctgataccaaaacctggcagagacacgacaaaaaaaaaagaaaattttaggccaatatccttgatgaatactgatacaaaaatcctcaacaaaatacttgcaaaccaaatccagcagcaaatcaaaaagcttatccaccgcaatcaagtagacttcatccccggggtgcaaatttggttcaacatatgcaaatcaacaaatgcaattcatcacataaacagaacaaaatacaaaaatcacatgattatctcaatagatgcagaaaatgctttcaataaaattcaacactccttcatgttaagagctcttcataaactaggcattgaaggaacatacctcaaaataatcagagcgatctatgacaaacccacaacagctattatactgaatggggaaaagcaggaagaatttcccttgaaaactggcagaagacaaggatgccctctcaccactcctatttaacatagtactgaaagtcctggccagaacaatcaggaaaaagaaaaaaagaaagggcatccaaatagaaaaagaggaagtcaaacaatccctgctggctgatgacatgattatatatctagaaaactccatagtctcggcccaaaagctccttaacctgacaaacaacttcagcaaatttgcaagatacaaaatcaatgtacaaaacttactaccattcctacacaccaatattaacaaacttgagacccaaataaggaacacaatccccttcacaatggccaccaaacgaataagatacctaggaatacagccaaccagggaggtgaaagatctctacaatgagaattataaaacactgctcaaagcaatagagatgacacaaacaaatgaaaaatactctatgcttatggataggaagaatcaatatcattaaaatggccatatttcccaaagcaatgtacacatccaatgccatttctataaaactaccattaatattctttatagaactagagaaaactattttaaaattcacatggaaccaaaaaaagagcctgaatagccaaagaaatcctaaccaaaaagaacaaagctgaaggtgtcatgctacccaacttcaaactatactacagggctacagtaaccaaaacagcatggaactggtacaaaaacagacacacagaccaatggaacagaatagaaagaccagaaataagtccatacagctacaaccatctgatcttaaacaaagctgatcaaaacaagcaatggaaaaaggactccctattcaataaatggtgctgggataaatggctaaccatatgcagaagactgaaaccggaacccttccttacatcttataaaaaaatcaactcatgatggattaaagacttcaatgtaaaaccccaaactataaaaaccctggaagacaacctaggccataccattctggacacaagaactggcaaagatttcatgatgaagacaccgaaagcaattgcaacagcaaaaactggaaaatgagatctagctaaatttaagagcttctgaacagcaaaagaaattatcaacagagtaaatagacaatctacagaatgggggaaaatatctgcaaactatacatctgacaaaggtctattatccagcatctataaggaacttaaataaatttacaagaaaaaaaaacaatcccattaaaaagtgagcaaagaacatgaacaaacaccttttaagagaagacatacatgcagccaacaagcctacaaaaaaagcgcaatatcactgatcattagagaaatgcaaatcaaaaccaaaataagatagcatctcacaccagtcagaatgactattattaaaaagtcaaaaaataaaagatgctggaaagattgcagaaaagagaacggttatacaccgttggtgggagtgtaaattggttcaaccactgtggaaagcagtgtggcgattccctaaagagctaaaaactgaactaccattcaactcagcaatcccattactggatatatacccaaaggaatataagttgttctaccataaagacacatgcaggtgtatgttcattgcagcactatttacaatagcaaagacatgaaatgaacctaagtgtccattaatggtagactggataaagaaaatgtgatacatatacacaaaggaatactatgcagccatagaaaagaataaaatgacgtcttttacaggaacatggatggagctggaggtcatcatccttagcaaaccaacacaggaacagaaagccaaatattacacgttctcacttgtaagtgtgagctaaatgatgagaacatatgggcacaaagaggggaacaacacacactggggcctgctgagggtggagggtaggaggcgcgagaggatcagaaaaagtaactattggatactaggcttagtatctggatgatgaaataatctgtacaacaaaaccctgttacacgagtttacctgtataaaaaacttgcatatatacccctgaacctaaaataaaagttaaaaaaaaagaatgaccaactataagcatggtgctttaaagtttacaaagttcttttcacaaatatcctttcaattaacaggagattcagtacaacagaattgtttcaaaatatatactcatctagttgtatgtaacattttcacatattcatttaaaaagccaagtttattaaagggtcatccacagacctcctgcatcaacatcacatggggtggtatttaaaaagacagtatcccagatcttctgaattataatacttggaaataaaacctaggaatctgcattgtaacactgacattgattccaatacccactgtcatttgaaaaccactcttaaaagaaatgtaattcaaagagactaaagtatgagtatgtaagtaacacattagaatactccaaaaagatgacttccatggttattattttaactcatgaccttagaactctgcaaatagtcttagcttcaaataagtatttaaaagtaaagttttctctaaaactaatacccagcataacagtgcttatttttaaaaatgaatgaataaatgaatgaatatacaagtagatggcttgttccagaaatttcaaaaaaacaaatgcagctcctctccatgaagaagctgtcctctgcatacattgcaataactctttccattgtttggaatggccttctaaatttagtgatcagcaaagaaaatttcttaagcctagtgaatttttttatacacaaggcagatattttcaaaatcaaaatgttaagcatatattttctgaaagtagcatgcctctatatgttcagataatcttcatcataacttttgcattgtcatatgactttatgctgctaatttaaagcacaacttttttcaggccactgaataaccttttcagtatttaaactgtttccgacttaaattattttaattctctttgaacatctcattagctctttgggtgaacagcctttatcactgagataaggtaaaaggtatttgttcatggggagatgaagttggccctatagagctccactttaactgaaggaataagttcataacttatacttatatttttaattattttttatcttttattttcaaactgacagataacattgtatgtttttatcatgtacaacataatgttttgaagaatatcaatacattaaggaatggttaaatctagctaattaacaaatgcataacctcacatagttatcatttttgtggtgacagcacataacatccactaaaaatagaactaccatatgatccagcaacctcactacttccaaaggaaatgaatttagtatatcaaagagatatctacactcccatgtttatcacagctctattcacaatagccaaaatatgaaatcaaactaagtgtccatcagtggatgcatggatttaaacaatctggtttatatacaaaatggtatattattcagccataaagaagaggaaaccttgccatttgtgacaacatggatgaacctggaggacactgggttaaatgaaataagccagacaccaaaaatcaaatactatatgatcccattcatatgtggaatctaaaaaagttgatctcatagaagtacacttactatattctttagaccacattcactatcttagttctcaaactcgccatccattctcaagactgccattgcaatgtttgtgctttaactcagcatctcatctgctctgacctacaaccctgttaaatggaccacctgcctccaatcttctaaacccagtattttgaagattccaatatgcaaatcgaatcacatctctcccttgacttcaaatgcttctatgtgtttccaaggagttaagaaaaaaaaaaagtgcatttgacaaccatctgctagtccctaactccaactctgctcccatacttcctcatcttcctaaaacctactcatttcaatacttagcacaagtcttatgcgctccataaaaggttctctgaatcctttacccacctccccataaaataagaaactcctttcaatatctccatgctaccttgcagatgacccatagcagtgcattctaattgtttacatgcctatttcccccacaaatctgtgaccatcttggaagtggggttctctgctccagtcttttatcctggtgacttgaacagtatctgacatctagtagctactcaatcaatgtttgttgaatgtacataaaaaataagtgacagagagctggaaagaggaagggagaatatcaatggtttcaacggacaaggaaaacattactgtagaagcttacacttaaagtagcaaaatctccttacaatccttttatcttattattttctatctttttaggaagctgacctcattcctattttgattatgagtacaatagaccacagaaagtcatcaaatttatcttaatgctttgttgaggcattcttgatgacagagaattcccagtaaccaggctaaccatacttctatagatagcatgataacaaaggttgctttgttggaatgcataagaacatatgctgaaatagtaaaagtaatatttggttatataaatcgaaaaaaaacattattcttaaagtcactttaaatctaatagaaacttatagtttacttaccatacactggccttgaacacagatgtcatgagtttcagttccacaaggagtaccatcttcaaccatatccttcaataggtagaaataattggttccagcaacctgacaatagagtttacaacgatcctttgtgccaactgtaaaaaagaaaaaggtcaaatttttaatgtataataataaagctatgtgttcttacgtctcagaaaaatttacatcaaagaaccagcataatttacttactgccactgtatcttggaagccacctcacattagagggaatgccactgatgtccaaatgtttaccattaaaatcagagcactgcttctctcgaaagtcttgtgtgccttttggacatgaatcagtattacatgatcgaaatttcatcctgcggcccacacagtaatttcctccgtttcttggcctagtcaaattcattacattttaaagcacatcagtacaacattatttgtgccacttacttctaaaagttccattcttttccaggatctagaaaaccagtgaagtcccactaacactttttaacagaagtatgtaacatgagttttacgcaattctatgcataatgaaccacaaaaatatccaccttaacgtggacagtgagcctagagggcagaaacgataccttattcttgactaggttaactagcaagaaaccaacaatggaagttttttcttaaacttccaaaaaagggtttgctcactttctggaaagaagaaaagacatgtggtgagccaaagacaataacaaaggcaggtgccatgttaaataaaaaggaaatgtatacacatctgtcatgtatatcttatttatcactcaattcaaggagttttatggtatcaatctatatccatgttattttgacttatgctggaaaataaaattttttgcagaatttttggaatataaagacttctagtataatttatcctaaaatttaaatgagccaagattttattcagagtaagtcacatttctgcattaaaaatgcttattaataatactttaagtaaagagtatcatattgcttaccaacttatatatcatatatacaacaaaaacattaatttaaaatcttaatgcaatatctaagcccttttaaatagtttgatgagggggagatatgctttagtacttattcagctaaagacaatgatgcgtctataacacaagaagcagagaaaataaagtatcacatgtcacaatgcacaaaacggtaaaaaattggtaaccaaactatatatgttatccagaagatccgaaacataagtgaaagtagccaggatgtttcattaggcatacagtaaatgtgaaaatgacattatataactgtgattcatatttatatctcaaaatttatactaaattaaaaaacaaaaaaatgaagaaaatggatctcagttcagattataaaatttaatctatttatgtttttttttttaaatgtctgaatctaccaaaatataaatcaatgtgacttaaagtgctccagaaattttctgaatctcagaaacttacggactgacctccagttttagaagtgagtgaaactgatgtttactttctggtgccttgagataatcttaatttatagtgacataaaaaagacatactcaggacgattacagcgcctggttgcactttcgattccgcctccacatgttcttgaacaagaactgtaaggttcccatggtccccattcaccatttacaggacgtgtttccgtttctttgtttacacatagcccatgacggcaatgctataaaaataataagcacaaaaagaaatgatgtgtgtctctaattagaacatcacaaaaattataatagcagcataaagatcaacagaagaacaaactaaacaatttgaagctagctgttattaattcagattacatttgaaatgattttatgaatatttcctacctactaagatctgtggaatagaaaaggagtgtaatatttcttctggctttaagatttagagtgtcattggggaggaaggaaaaattaaatagtaaaatggaatatggcgggtattttttgaatagaagaaaccaaataccaggttaatatggtatatttccatccttccatttttttactcaaagtatctatacactcttccactcttataaaaagctttctactttattctatccgaagtctcaaatgacaaccttgttcctttactttcatcaggaaaatggaaacttacagaagaatctacccacagtctctcaccacctgttctacccattcaacagcatctgcactcacattcagccttgctacctgttagcacacatggaaaattcactatcccagacaaagtcaatccccctgcttgtgtacttaatccatcccttctcactacaccaaacatcactccagcaattctctcatctcttctatatcatcatttcagtgatagctaatcaaagtatgaccatgcactcatgccagtctatgaattagtttccagactgagagacaataacacaacttgagagtaagcattaagaaatttttgtaagatttttacagagaaattttatgtctaagtaaataatttaaaaattggcttatgtttatttttaattgtggcaaaacatgcataacataaaatttaccatcttagccatatttaagcatatagttcaatagtgttaggtatactcattgttgtgcaaccaatctccagaacttttccatcttgcaaaactgaagccctatacccattaaatgacaactcccattttgtcctccctgctacctcctggtaaccaccattctactttctgtttctatgaatttgactactccagatagttcatacaattggaatcatatagtactagtcttcatgtgactggcttatttcacttagcataatatgcccaagcttcatccatgtgtcagaattttcttattaaaaatgaataatattccattgtatgttgtcttagtccattttgtgctgctatataagaatacccaagattggataatttataaataacagaaattcatttcccacaggtctgagatctgggaaatctaaggtcaaggtaccggcaggtttggtgtctgatgaggcctttctcttcttccaagatagcaccttgcacactgcatcctctgtagggagagaatgctggatcctcacagagcacaatgcagaaggaccgagacagctcaatcctgaaggcccttttataaggcattaaacccaccggtgagggaagagccattatgccctagtcttatcaaacaggccccatctcccaatactgttacactggcaattaaatttcaatatgagtttgggagggggcaaacattcaaaccataacatacgcatttaccacactttatttatcctttcatccatcaatggacactgggttgctttcatctttttttttttttttgagatggagtctcgctccgtcacccaggctagagtgcagtggcgtgatcacagcttaccgcaacctccgcctcccacattcatgtgattatcctacctcagcctcctgagtagctgggactacaggcgcacgccaccacaacccgctaatttttgtatttttagtagagacagggtttcaccatgttggccaggatggtctcaaactcctgctttcacctttagatattgtgaaaaatgctgctatgagtatgagtgtacaaatatatctttgaaatcttgctttcaattctttgggtatatatccagaagtagaatagctggagaatatgataattcgattaataattttgtgaggaatggccacactgtttcccatagaaaaatatggcttatattttggatgtcttttttgcatttcattttcctagtcaataatttttattactttgtacaaaagtatcagtttataaataatcagaaattttaaaaaagaacaaagacaatattttactacagataatttgcaaagtggtttcctagattatcactacagataattcacaaagtagttgcctagattattctcattaacatacaaacacagctgttatttctctcactttaagaaaacaatagcaacaacaaaacctttcttagatctcactgcccttaccagctactgctctgcttctccttgaaagagtcggccatgtacattctttaactccctgtctattctctcataaccccgccccatgaggaatatatcctattcctccatgaatctgctcaaattgttagaaatgcaaaatgcttgttcctcggtgctgcaaagaaatagcactcgaacataaatttaagtttctcagcaaggcaatttttcctttctgcaaaaagggtgctcctcacagatggaacaatggcaagagcacacctggacagggcaggggcaggagttcttactcctgacacagatagaccctactgctgtgtcattccctactggctagggttggactgcatagtctaagctaattccgattggctcttttaaaaagagcaggagtacaagccagagtggcggggtgagtagtttggtgggaaggatgggtaggaacaggtaactaaagatgacttaggtcagagcaggtaaccaggggaacagatatgaattactgattaggaatggcaggaaagttgtttactgaaactagagacaaggaggcaaaaagaaccaggaagttaaactttaaaatggagaatcaaagaataagagagctgaacatactgacatactgattctttgaagagaaacctggggttcactatatttaacaatgtgtaggacaccaatagccagttcttattctctgtcttccttgacttatcagcaatgtgtgcacaattaatcatgcttcttctttgacataatttttttctcttcatttccagggctctacacacttggttttcttcctttcttcaaaactaattgttctcattttcttctgttgttttttctttttctttgtgacaacttagtgttggaatgtttctccaggctcacatctagtttttttattcttttctgttaacagtcacttctagtccagatctctctcttaaattatcttcttctctgtgacaacttaatgttggaatgtctctccaggctcatatcttggttttttaattctttactattaagagttacttctagtccagatctctctcctaaactccagactcatatatatgcctgcttacttatgactatttactagaatgtctaataaacatttcaagcatagcatatccaaaactgaattcctgccttcccaactcaaaacctacttttaccaagttgatctaagttgttcagccaaaagcctagtcatcatttctcttcttcctctttgaacactccacatctgatacattagctagaataaatgttctagttccttttaaaatatatcaaaaattgacctttcattatctcactactactactctggtttgagcactagcatcccttacttctatcactgaaatagctaagtagatgtctgtttccactcttgtccccgacagtttagccttaacacagttgccaggatgatctctttttaaactaagtcaaatcaggtatgaatccattcaaatctttcattattttactttgagtaaatatgcagttctcacaatggcctgtgtgaaccccaaaaatttatgacaggtctcagttaatttagaaagtttattttgccaaggttgagggcatgcccatgacatagcctcaggaagtcctgatgacatgtgccaaaggtggtgggggcacagcttgtttttatacattttagggagacatgagacatcagtcaatacataagaagtacattagttctctccagaaaggtggagacagctcaaagcaagcccctccccaccccccaatggggacttctaggtcacaggtaggtgacagacagatggttgcattcttttgagtttctgataagtatttccaaaggaggcaatcagaatatccatctatctctgtgagcaaagtgatgacttgaatagactaggaagcaggtttgtcctgagacgttcccaagttgaagggtcccaagatatttttctttcacacctgcaatgccctacgaaatcttccttcagttacttcttataagtctctttctctcttcacttcactccagctaaaatgtcctccttgctcttctttgaatactccaggcatactccagacttaggagctcagctgttccctttgttggaaactcatttaccccagatatcctcatagctaaccctctcatctcctttaagacagctaatttggtaacttcatataatgtctgtcctgaccatcatattttaaattgcaatctgccctctcctactataaaacttctaatcagcttcctgctctatttttctggtgtgtggcaccaatcagtttgatggtactattatattaattatttgtaatattctagtctccctctagaacttgagctacataagggcagagatcttgttgagagacaggactagctggattacctaggctgactaagaatccctaagcctagctgggaaggtaactgcatccacctttaaatacagggcttgcaacttagctcacacccaaccaatcaggtagtaaagagagctcactaaaatgctaattaggcaaaaacaggaggtaaagaaatagccaatcatctatcacctgagagcacagcaggagggacaatgatccggatataaacccagacattcgagcctgcaatggctaccctctttgggtcccctccctttgtatgggagctctgttttcactctattaaatcttgcagctgcactcttctggtccatgtttgttacagctggagctgagctttcacttgccgcctaccactgctgtttgctgccatcgcggacctgctgctgacttccatccctccggatccaacagggtgtctgctgtgctcctgatccagcgagatgcccattgccgctccccacagggctaaaggcttgccattgttcctgcatggctaagtgcctgggttcatcctaatcaggctgaacactagtcaccgggttccatggttctcttccatgacccatggcttctaacagagctataacactcacagcatggcccaagattccattcctcggaatctgtgaggccaagaaccccaggtcagagaaaacgaggcttgccgccatcttggaagtggcctgccaccattttggaagtggcctgccaccatcttgggagctctgggagcaaggaccccctggtaatattgtctgttttgttaactcatgtatcctacagcaacagaagaaaatgagaaatagtgtacctaaaatagtgcctgacataataggcccttgttaaatctttgctgattgaatgaaacctacagccaagcttatagcagtaaaaatgctttgtgctctccattagaaaaagtcattcaatataagaaagccatattagaagtgaaaaaaaaatcataatgtactatgtgcgtgtgcattttgttagcatcttgcacaaaaaatttaagtaatccttactctttttaaaaaataatttgatagactagagcatgaaaaagttataacgttatactattcaccatgtagtaaaattaactcattatcagaagggttcaccatggcttcacacaaattgatttactaccaaaagtgttcagcacacacactcattagatagtcacaagataaacagaataaagaagaatgttaaggcaaaattatagaatatttgtttcaaatgtcccttcaataaaaggtttatttaatactgaatacagctaaatatataggggttcactgtgttttattaatttaaaaaagataatttatacctattataatccacatgatgctaccccaaataccacctttgctttcaatctgcattggctctaaagtaaatcttagcatctcatcacatttaccttgaatctcaataaatccatgcctatcctaccatctcattgggaaaatattcaaatggctaataagcatatgaaaaaatgcataagattgataataatcatggaaatacaagttaaaaccacaatgagattccattttatacctagtagaatggccaaattttttttaaagactaacagtatcaaaagtcggcaagaaatacagagtaattggaactttactccattgctggggggagtctaaaatggtgcacatacttcagaaaactgtttggcactgtcttatgatgttaaacatacactcaccctataatccagcaattctacaccaagagaaacacaaacgtatgtctacaagaagacttgtacagggatgttcatggcagctttattcataataaccaaacacaagaaatgattcaaatatctattgacaggagaattgataaattatagtacatctgtatagctgaattatactgtggtataaaggaatgaactgctaatgcacacaataatatggatgaagcttaaaaatattatgttgaacaaaagacgcctgtcccattccactccttcaaaaaagatgacgctgtatagttctacttacaagaacaagaaaaaaacgaatctctggaaataaaaatcagaataggagttttctctggaaggaaggagagttgcctagataagaggcacaactaaattatatatatatatatatatatatatttttttttttttttttttttttgagacgaagtctcactcttgtcccctagtagtgcaaaggcgtgatctcggctcactgcaacctccgcctcccaggttcaagcgattatactgaatcagtctcctgagtagctgggattacaggcgcctgtcaccacgcctggctaatttttgtatttttagtagagatggggttttgccttgttggcccggctggtcttgaactcttgatctcaggtgatccgcctgcctcggtctcccaaagtgctgggattacaggcatgagtcaccgtgcccagccacaactgaactttttaaagtgatagaaatgttctcatttttattgggatgttggctgtatgtgcatccacatttgttaaaatccatcaaattgtatacctaagatctatgcattatactcatatataccttaatttcaaaaaatcatgtttatgccctaactggatttagaatattaataaattagctataaatagtatatctcttaatatttgtaaatatatcaatcacacttttgccacgagcaatcaatcctgaaggttcatggcatacagtaacttgaaaagttgctaaggaacagaggaaggtgccagtcctggattttaatcaggtgaacatcttggagcacatcttcaaatgtgcccatatcagcagcccagcattcatacttcaaaaagattttttttcctctgctgagcctcaggtagtcactctcacaaataccacctcttactcaaaaagctatttactaatactagtcacaggaaccgagaaaaaaataaagtcctttaaataactcttatccaccaaacagaaacattatataaagattgaattttaaaattcaaagccagctgaactgaaaaagcccactagaactttcgtcctaaaattacaaaaaggttattagtgtgttagatgatttcaatgagtacttcagctgctacaaaacttgaagttccaaataatatattagtaaccaattaatttgtgatgtgagcaatattcacaggaaacacacaccttttgatgcaagtgattcaagagaaaagcaatagctattataaatatttcaaggaagcaagaagtggtaaaggcaaagttcagctactgaactgaccttatttttaagcagtttatcttttttggctaatgtgaaggtaacaaagaggcacaattagccaatccattgccaaggaagtgttccttttacactgagggagctcagagatgctgacagactaaacacttaatgtagtcaacactggccactgaggccatcctggagcacaaagtacactctgacttcatcctctcacaagacacttttcattatcatggtgagcgttattcaacatcatgttgacagctttagataagttcatgactgttggaataataaagacctagcatggtaggtggttgattttagcggtataatgtatcttgatacacttagaaacaataaaggtctaaagaagccacttaaaactttcaattgtattaacggaattttaagggagaaaacgtatgaaatgaaaacatccctgaatttggagaatttgccaaaatattaggactgttatatctgtcctcaattttaataataatgttataatatacatagataactatatatccatgtaattatttatatgctaactatacaaaactttaatattcatctgccatagcttagaaatagggtaaaattaaagatttaattcattgacaatgtactatatcaaacaaacatggcaataacattaattcgactagctgaagaaaagttgacagcaaataacaaacagagtgctaaaatgcagagcaatcacatccttggataatatcttcatacaagactcacccttcaagaaaacctaccattccaggaccgcagtctgttccatctgctggtggcacgtgttgagtgaaacagcctttgtgaagcttttctgtgcttgtgcaccacagatgcatgcatatattctcctgagtaacaaaaggcaggcaagccagtgtaaagataacaccacaacactggttcaattcagtattacacattgatttataaattgatctgttacctagttccatggtataagctgaaactaatcagcaaatttttttactaagttctagtcattaattttcttctaaatacataaaattgtgacattttctttaaaactttttaaaaaaattttattcatacattgaataggagttatgaattggagtggaaattttcaaaattatttgagatagttttctctctttacaagatatctttctaaagaactttttattgttaaatattattcataagaatttgccaaaagccgcttttgatacaatagtggaatgtatgaataatctgcattgaaataatgtataatgtatactgaagtttcctattttgtgaatataatgcatactttcaacttttgaacaaagggctctgaaggtttcgaaagaaacaaaagtccacagagagtcatacgagctatacccaatataattcctttctttttctgaatttaaattcaaagtttatttagtgtctaaatcagattggaaagaaatgtatcttttacaatgatattttaaggtaaatcttccccatttcacagtaaatgtttaaaggcttattgaaatttaaggttttaggaagaatagtcgctatatgaaataagttttgcctgtcctacattctctaattaattaattctttcaacattcaataagcatttattttgtggcatatactgtgcaacaaatcctaaactggaccctaggaatagatatagatatttattttaatgactgaataagtctacattccggaattggtccaatgatcctcacaacctagtagggagggaagcaattaggcaaaaatatatagggaataaggaaaactgaatgagtactctacatggaaaagtaaagcatggattcaccaaagcagtgacatttattctaaactaaatcctaaatttacccccatataaaagaaaatcataattatagatctaataaaagtgttaggatcaactatttcaatgacaaaggtatctcatctatgaaaaatcctcaaaatattataaaataatagctcaatgaaaaactaaacaatatgccccaaatttaattcttttgaattcaaatatatgtaaaggaaaatgtactctattagttagattcctggtgcctttaaaacaattcagattcaacacacctatattttctccttaacctcaaaataatatcatttgaaaataaatatttcaatgattttattttcaaattatataacttccctattttctaaatgagaatacttcataggaatttgagagttaacaaagataatttttaagtacccaaaacagtacctgacacataataagtagtcaataagttttaattttccttttcttaacctctttttgataaatactaaattatcagacttaaaagctatatttagttcaagagaataaacacattttgaaatatattctaagataactttatggcagttttcgaacaaaataaaggaattttcttttcttactatatggggacacatttgtgacccaggaccaaacgcaagctcacactgcttgtttccatcatatcgtgatccaggaagttctgaaggcagattatatatttcttcatctggtttgtcaagaagacattccccgtaaccagtactgtaacagtgacagaaaataaaatattgtgaatacacatggatgcattccagtatgattctttatcacattttttgtagttctttactttcaaagagaatatcagtatttattcataactttaaaaaccaactcacatcaatatcagtatagcaatgttcgtacacataaggatgacctcacagtttacaaaggatctttaatatgcatgtttgcacttaatccccacaaccatcttgaaggtggcaattttaaaaaatgataagcaataaacacaaattcatcagaacattatttatgaaacatacatccatatcacacttttggtctactttgctatccaatagtaatgcctcaagtgtaatgactaactgttaaaatgttggaaaaataagttttaaaatcacttgagaaagtatatttctagtcctaaacaacaacaacaacaacaaagaagcttcaaaaagttttatgctgtctccacctcaagaggtctttcaaggtgggagtatagcagagtcaagatcactggctttgggagcttacattttggttcccatcaattcctaagatgcatggccatggaaaaattttttaatctccctctctccctgaaccacagtctcctcatctgtaaattgagagtggtaatatcttttaacatgctatcagaatacatgatatgtttgaatgacttaggaaaaacatgagaaatatacatattactcctaatttaccatgcaatgtccggtatgcagaaagctctgtggaaatatacagctattccaattgggctaagagcaacaatttgtcccactgcaataattaaaataaatcttttttgaaaaattttactggctaaaaggaaaaatataaattttccaattaaatgaacatgtaagcttaaaaatttcctttgaagaaaatcaaaatattactcccttctaaaaagaaaagtgcaccattggtatttttacatgtcacatcagtatttttaaccattgaacaaagctatatacaattctgtacagatcagcaagtattaagttgtgcttttaagtcaagctcctatagaagtatgtactatcactgttggttataatttgaggatatatttataaatatatgttccaaagcatgattttatttttccccataggtttcataaagagggaattagaaaataactgatgataattgatgatttagaatacatccatagaagaagtgaagtagtgttacatttatacaaaaagattattgggaaggagctcaggcttgccttttggaaaagtttcagtgactgagaaagaaacaccatttggataaaagaaattgggaagcagagaaacctgaaggaaggtggagaaatgaggcaagaaaaacctggatctactacctctctgcagagctagaaagagctcctgaaagaatatgtaaagttagagacttggcatctctgtggctttagagaactaacagaataattcgtagtttgactttagctattctctgtccttcaggggcacctcaaacttgagccactcaaatttctctcaaaatattacctagtcacttcgaaaaaattcaaaaacacataaggaaactggaattcccattaagtctcccatcaaacatagttttcatcacaagaaagaatccagaataaaaaaataatagctaggtctaaactacaataaaaatatttattttaaagagtgaaattatatacatgtatatatatatatatgtacacatgaacacaactcttcttgttcttaaacatccatttgtacagtgaaagtaaacataaatttaaacaagaaaaagctaaacagaaattgaaccacctttaaaaatatcaatttcaaatcttataatcgaatacatgttcaattatttaacataaatttacttactctaggaattcagtaacatatttccgactacagtttgaccagctccaaggactcatgtgaaaacttaaagcaggggccattacatgatactttgtaactttcatttctttacatctaggattatcatcatgttgaacaccaagtctaaaaataaaaataaacacttaaaaggaatatcaaaagatgcttacgatattagtaatagatcctttatagtcacattataatacaatataaaatatagataaatctggttatatcataatttgaactccatctatccataaggccttaacagtgttcatgtttagaagtacctgatgactgagaaatattataggctggtgatctggcatctgaatctacacaatcaaaatatttggactctgttgcacctcatcacaatatggaccacagcattgacataaaagtgcctgcaggttcaacatggatatcccatgttgtggatagagaagtgtgtggatagagattaggtaaaggtaataccacactaaattctagaccattgactatggctacaatatcacaagaacttcgtgaatccccaattctcaccattctacagtatccatctattttatatgaaagaccctaaatactattttaggtccatacttcctaagtgatgcccaacagaactagaataataaaaacattcctaaagggcagtcacatcttcatgacttaattattaagtaattagcaggttggcagcagatcctatacaatttggggggaactcaagtataagctcaagtttagaaggaacactgaaaccacttaattcagatccttgcctgctaaaatttgtatttaaacaatcttttaaattaaacaacttacccatatactagagacacctaaagagtttctcaggaagaaaacaaatatctaagatagtactctctgcaaaaatcgtcttctactggttagtagccttgaaaaccagcacatagtgccacccagatgttgccgcaatacttctactgtcctcagatattctgttcatcctatcccccgacttcataaacaacttacaaaataaagtgtgtagcttgttgatgattatgagatataaccatgcaaaaagggaactgaagagatgatcgtttactaaaaattatctccatttgaaattattattccccttgaatgttctaatgatttctcaaggcatgactaggaaattaaatgtggtcaaactaacagaggcaactctagactcaggtccttattagcagataacaaagaaacaccaggagttctgaggggtacatttagaatcttttttcagaggatacatttgtaggggtttctgattttccatgggagctccaagggtatcatgagaaatcacggcctctattcttacaacacagaaccccagcatatttttcagtaatacaggaaaaggtaagagaatcccaaatttttatgagcaactatggaaaaagtgaatactttaaaaaaaatcttttagtaactaagaaattcccatgggcaatatcctctgttggggcacattactgagagcaagaaatgagttggtattacaaatatttgggggagtcccccagaaccaggagcccatgcaggccctcccataaaatggtagaggacagtacctggtcatatataggataacaagagacagaggccagaagtgcttgtcatgtatccaatacagtaaaggaaataaaagaactcccaagttctagttctttgcttagtctgttgatctgtgcagcctgtctgacctaacatagatcacaaaagagccagagttagcatttcagggaagaaaattacactaataacattttatgaagaaacaaaggtactaattactcaactgaagatagaatttcaggcattctgtgcaaagataaatagaatgcacattaaggaggtgacagaaggtacttacgtgtgcccaagctcatgggctatagtaaaagcagaaatgagtcctttttcttcattaataaagcagctttgtaaaggatcacatatggtacctaaatatgataaacctgaaaaatttcacatttgtatttcatcaaaatggaaaacactaccaaaatcataaagaacttaattttgaagcatttaaccattgatgttattacttagaaaagaatgcagaattggctgttaatattgaataaacgttttaaaaggtgaaaaagagaatggaatgatttatttgcagttgaaatcatctttgcaaattttgggaatctactgaagtaaataatccaaaatgtagagtgagcaaacaactttttaaatatttttaaaaaatttttaaaaagaaaagaatatttgcaggaagtatgaagtgttttaacacattagcgtgggtagcaggaaagagattaaatgtgttgattggtaatagaaaagctaataagagaaaaaaatggcacagaactctacaaatctatgaagtttctttacttttttaaggtttaaagcagtatacaaatattcaattatcacatgacatgagtaaaaaataagtggtcagaataatgtctggcatttaatatatgttaaataaaataaaacgagtttataatataagaattactgccgtcactgaataattttgtaacatttccgcaataggaaatgtattgcaaatcaggatatatttagttctatgtaaagaataacatgcaactcaaatgtgctgttgaaagatgaaggtatgaactggctggacaccaaagacagcaataattatcatatatgcagtcctctaaaaataatataggataagaaactcaaaataaatattcattacaacaatccatacttcaccaccaatcatgttagtttttcatttacttattttttagcttaacataatcccatgattttgctattattacccttcaatttggttgtaaatttatctgctttcctagaactcttcctttcacaaaaaaaagattttttcatagataatcagtttcttactgtaaagcttttgcatttagaaatgtcttaatatagaataaacagacttcattagctcctagtttagctcttccctgctatgtcatcttttattcttaggagttaaaaacttgaacatcttcctagcatttaaggtagatgtcctaacaactagaatgtttttgttgtgctttaagagaaatggaagttaaactgaggaatccaaataagctggggaaaagccaaaagatgaagaagttcattagccaatactttttaataaaaaggaaagatttgctctctttctgaccacaccatcaaaaggtcttgcttcggcaaggtccctccagaaaacgagctttttccttacaaggaagactaaaatcaagcaaggaaaaaaattaaaaagaacaaaaaaattatttctctgtagagaaattatttcctctgtagagtgtgagggaattactggtttccttaagattctacaattcatgcttgcatgttcagttgtttagtggatcatcatcttattatatgtttctcttttgtcaggataagtttaagggaaacgcatttctttcatggacatcctacagtaggatttattagtattttcaatttgccaaattacacaattccaatattttcatttttagcactatgcagatatttggaacacattattgagtccattaccaaccaaactttatgtttcatgcttaaaggtatatacattttaaactgaacattttagtcacataagagatttgtaaaaatatgtatcaaatatgattagagaccaagctcaaatattcccgtaagcaggcaacacctacaaaactcaaagtaaatggttaatattatggaaacatgccgctggttgatggtttgtgtctagactcattcaagctaattctgggttctctaaaagtttaaagatagaataaggcagcatgggcccaagcttgatacaggttccctgtgtttggaaatacaagaagctgcatacagccacccaatctagccatcctgaagaatgaaaatcattctgcaacatattttgcaaaacatggtcagggactgaggcaacaataaacgtaaatggagatataacagaaaatctagtaattactaccaacattttgtgtttattattaagaactctccttagtttgttattttcacatatttcagatgagaaaataaaatactaacatttgcattaatataagctgtgtggtcttctgcaaattattcatcctcatctataaaattagaataagagttgttcagatatagtatctcataggaagcattcaaataccttaactatcggggaggagccaagatggccgaataggaacagctccggtctacagctcccagcgtgagcgacgcagaagacgggtgatttctgcatttccatctgaggtaccgggttcatctcactagggagtgccagacagtgggcgcaggccagtgggtgcacgcaccgtgcgagagccgaagcagggcgaggcattgcctcacctgggaagcgcaaggggtcagggagttccctttccgagtcaaagaaaggggtgacggacgcacctggaaaatcgggtcgctcccacccgaatattgcgcttttcagaccggcttaaaacacggcgcaccacgggactatatcccacacctggctcggagggtcctacgcccacggagtctcgctgtttgctagcacagcagtctgagatcaaactgcaaggcggcagcgaggctgggggaggggcgcccgccattgcccaggcttgcttaggtaaacaaaggagccaggaagctcgaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcacgcagctggagatctgagaacaggcagactgcctcctcaagtgggtccctgacccctgacccccgagcagcctaactgggaggcaccccccagcaggggcacactgacacctcacatggcagggtattccaacagacctgcagctgagggtcctgtctgttagaaggaaaactaacaaacagaaaggacatccacaccgaaaacccatctgtacatcaccatcatcaaagaccaaaagtagataaaaccacaaagatggggaaaaaacagaacagaaaaactggaaactctaaaacgcagagcgcctctcctcctccaaaggaacgcagttcctcaccagcaacggaacaaagctggatggagaatgactttgacgagctgagagaagaaggcttcagaaaatcaaattactctgagctacgggaggacattcaaaccaaaggcagagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaactggaagaaagggtatcagtgatggaagatgaaatgaatgaaatgaagtgagaagggaagtttacagaaaaaagaatgaaaagaaatgagcaaagcctccaagaaatatgggactatgtgaaaagaccaaatctacgtctgattggtgtacctgaaagtgatgcggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccaaagttgaaatgaaggaaaaaatgtgaagggcagccagagagaaaagtcgggttaccctcaaagggaagcccatcagactaacagcggatctctcggcagaaaccctacaagccagaagagagtgggggccaatattcaacattcttaaagaaaagaattttcaagccagaatttcatatccagccaaactaagcttcataagtgaaggagaaataaaatactttacaaacaagcaaatgctgagagattttgtcaccaccaagcctgccctaaaagagctcctgaaggaagcgctaaacatggaaaggaacaaccggtaccagccactgcaaaatcatgccaaaatgtaaagaccatcgagactaggaagaaactgcatcaactaatgagcaaaatcaccagctaacatcataatgacaggatcaaattcacacataacaatattaactttaaatgtaaatggactaaattctccaattaaaagacacagactggcaagttggataaagagtcaagacccatcagtgtgctgtattcaggaaacccatctcacgtgcagagacacacataggctcaaaataaaaggatggaggaagatctaccaagcaaatggaaaacaaaaaaaggcaggggttgcaatcctagtctctgataaaacagactttcaaccaacaaagatcaaaagagacaaagaaggccattacataatggtaaagggatcaattcaacaagaggagctaactatcctaaatatatatgcacccaatacaggagcacccagattcataaagcaagtcctgagtgacctacaaagagacttagactcccaaacattaataatgggagactttaacaccccactgtcaacattagacaaatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaagccgctcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggaagctggttttttgaaaggatcaacaaaattgatagaccgctagcaagactaataaagaaaaaaagagagcagaatcaaatagacacaataaaaaatgataaaggggatatcaccactgatcccacagaaatacaaactaccatcagagaatactacaaacacctctacgcaaataaactagaaaatctagaagaaatggatacattcctcgacacatacactctcccaagactaaaccaggaagaagttgaatctctgaatagaccaataacaggagctgaaattgtggcaataatcaatagtttaccaaccaaaaagagtccaggaccagatggattcacagccgaattctaccaaaggtacaaggaggaactggtaccattccttgtgaaactattccaatcaatagaaaaagagggaatcctccctaactcattttatgaggccagcatcattctgataccaaagctgggcagagacacaaccaaaaaagagaattttagaccaatatccttgatgaacattgatgcaaaaatcctcaataaaatactggcaaaccgaatccagcagcacatcaaaaagcttatccaccatgatcaagtaggcttcatccctgggatgcaaggctggttcaatatacgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttggaaactggcacaagacagggatgccctctctcaccactcctattcaacatagtgttggaagttctggccagggcaatcaggcaggagaaggaaataaagggtattcaattaggaaaagaggaagtcaaattgtccctgtgtgcagacaacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagagtcaatatcgtgaaaatggccatactgcccaaggtaatttacagattcaatgccatccccatcaagctaccaatgcctttcttcacagaattggaaaaaactactttaaagttcatatggaaccaaaaaagagcccgcatcgccaagtcaatcctaagccaaaagaacaaagctggaggcatcatcacactacctgacttcaaaccatactacaaggctacagtaaccaaaaccgcatggtactggtaccaaaacagagatatagatcaatggaacagaacagagccctcagaaataacgccgcatacctacaactatctgatctttgacaaacctgagaaaaacaagcaatggggaaaggattccctatttaataaatggtgctgggaaaacttgctagccatatgtagaaagctaaaactggatcccttccttacaccttatacaaaaatcaatttaagatggattaaagatttaaacgttagacctaaaaccataaaaaccctagaagaaaacctaggcattaccattcaggacataggcatgggcaaggacttcatgtccaaaacaccaaaagcaatggcaacaaaagccaaaattgacaaatgggatctaaataaactaaagagcttctgcacagcaaaagaaactaccatcagagtgaacaggcaacctacaacatgggagaaaattttcacaacctactcatctgacaaagggctaatatccagaatctacaatgaactcaaacaaatttacaagaaaaaaacaaacaaccccatcaaaaagtgggcaaaggaaatgaacagacacttctcaaaagaagacatttatgcagccaaaaaacacatgaaaaaatgctcatcatcactggtcatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtacatacccaaaggactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaatcatcattctcagtaaactatcacaagaacaaaaaaccaaacaccgtatattctcactcataggtgggaattgaacaatgagatcagctggacacatgaaggggaataccacactctggggactgtggtggggtgggtggaggggggagggatagcattgggagatatacctaaggctagatgacgagttagtgggtgcagcacaccagcatggcacatgtatacatatgtaactaacctgcacaatgtgcacatgtaccctaaaacttaaagtataaaaaaaaaaaaaaaagtgtcagacatgatacaagatgatttaaataaaagacctctaaataaaaaaaaaaaaaaaacaattaccttaactatcattataatcattactcttgacttaagggataataatgctttcatcatcacattatacgtttctaaatgtcattataatttatgtacacaggagtggcagaaagctataaaaccataattggggactagaagaccaacaatttctataggaatagtccagaatgtctagcattcaagcactaaaaaaatagtaagaaatgacagatactcagtaaaagttcatactacttaagtttaaagatgggacaacagggtatagataatgcaagaaatatattcagtagattcttattaagtgatctcataaaatactcttaacaaacccagagaatagtttgtagggaggaagaaattcagtctgttgtaaaaattagagcaacaagtgcctatttctacaagtgtggaagactggcatttccaaagaaccccttaacataaagaaactagatatttaataaaaactaggttttaatgaaagcctagctcacatgactagtgaggactatcaagtccaaacctcagtgatttagcacacatatgcactctctctctcttctttgtctctttctttctctctctctctctcaatacacaagcatgcaggcatatgtacacacatatacacacattcatacttttcaaattctaggcggtaagcaatgaataataaggatagatgctattctgagggcaaatactgataaaagtaatatggtccaaagagtaagagcttgctagaggaagcttcaaggtgcatgtggatgttgagttttcttcattaagccagggactcaagttatgaacaccctttggactccaacaagaaataaaaatctctagaagaaagcacacactttttgagctagcaatttttcaaccccatggcttaatattaaataaatataagctcaaaatcaaagaccatcaaacaaacaaataaataagagaacatacgtaaaagaagaaataagatgtatggctatcatgtatttcagatatgtgaattttcagatacgtaatataaaattattccacataagatgtttaagaaaatgaaattcaattaaaaacatgcacaaatattttttaaatgtaaacaaaacgaacaggtagatttttaataagaactaagtagtatcttttacattgaaaaatatatatattttaaaatgtaaaatgtgaaggatgggtgaaataccagattagacatagctaaagagagagccaaatatactaatttatattagtaaaatggaaattagagctgcttgaatgaagcacgaagagaaaaaaaatgaaagcacagacagcagaatgagaagatctaatacagatgtagtagaatcccacggtgaaaacagataaaataataggataaaatttgaaagaaaaaaatgaaaattttccaaaattgctggaagataaacagtagatataggactcatgacatagcccaagcaggataaataaaaagaaacatacctatattaggatgaagttttaatgaaactgctttatattcaagacaaagagaggatcttataaaagacagatcaccaaaaaatctacaactaaacccactacagatttctcaatagcaaaaggcaggcacaacacaatcatatattcaagatattgagagaaaataactgtcaacctagaattggtaactagaaaaatatattttgaaaataagagtatttgcctgttaaatcaggaaaaaactgaaacctatgagttattttagtaaattactgaattagaaagagtgggttgtgagaatccctgactttgcagctaactcagacagatgtgtaggtaccctgggcacctcatacttgcaactggtgcctgaagtaaggacggttttataggactgagcgcttaaacctgcggagtctggcacaaactcagggtagttaagtatcagaaatgaactgaattgtagagtatttagtgtctggagagttgaagaactggttgttgatgtggaaagaacccatacatttattatgagtgacaacagctcagacacaccaactctattttttctttaaaaagcattatcagagataaagagagtcactacacagttgtaaaaggttctattcactaaactatgtatctaataagttagccttaagctagacgaggtaactaattgtaaaattatatgaagaaagtgatagagatatacttcatgtttcaattagtaatgtaattagtaaataaatagttgatttgaactacacaattagcaaatttgatttaatagacaaatacagaactcaaagaatatacattcttttaaagtatacatggagtattttcttaaattggctacataatagatcataaaggaaatatcaagattgcaaagaatatcaatagatcacattctctaactgcaataaaattaagttgtaagtcaataaataaaaataacaagtctccacacattcataaatatttaaatgcatttttatgtaattcatgaagcagcaaataaatcatgatggaatttaaatatgatttacatacatttagaatttttaatgacatggaaaataccaataaaaacttatgggacacaaaaaagtgataccttaaagtaaattgatagtctcaaataataaaattagaaaagaagaaatcctggacattaatcagttaagcaatcaacttacaaatagaacagcaggagtaaattgaaaaacaaagctacaagaaagacaacaaagagcagacattcatgaaataaaaataagacacaaaaagcaaatagttggttcattaaaaagacaaataaacaatatttcagtgaattgacctattaaaaaagagaggcacaaacaatatcagaaataaattgagacacaactagagtgagaaagcttaaaacaataagaaaatgctatgaaaatcatttaagctaataaatgttactagtaaaagaaatagtcaaatatctagaaagaataacttttcaaatatatttaagaagacataaataaaatctgatttccactggagaaactccataaatggttaaccttccgcaaagtaaatcttctagacttggggaaaaaataatacaccttaactcattttataaggtgaatgaaaccttataatcaaaattagaaaactacactaaaagagaggaaaattacaggccatcttcactcctgaaaatatatgcatgaaattagcaagtagaatctagcagtgtgtggggggtaaagaaggaagagtcttgttcaaggctggtttactgttagaaaaatctatgctgcaataaacatggaagtgcaactgtttcttcatcatactgatttcagttcctttcgatatatacccaggagtgggattgctatatcatatggtagttctattttcagctttttgagaaatcttcatactattttccataatggctgtagtaatttactttacagtatacaacataagtatacatcaatgcataagtagataaagaaaatgtggtatatatacataatggaacacaattcagcctttaaagaagaagaacattctgtcatttgcaacagcatggatgaatctgtaggacattacgctcagtgaaataagccaggcatagaaagacaaatatcacatgatctcatttacatggaatctaaaaaagtcgaactctgataagtagagagaagaatggtggtttccacatgctgagggagtgtgggcagatattagaggtagggaatggggaagttcttagtcaaagggtacatagtttcagttagacaggagaaatacgtttttgagatctattgcacaggagggtgactatagttataataatgtattataataactaagaaagtatgtttcagatgtctcaccaaaaaaaagaataagataataggtttgttaattagcttgatttaatcattccacattgcctacgtatatcaaaacactacattttacccccaaaaatgtatataattatgatttgtcaactaaaaataatattaattttaaaattctatggaattcaccagattaacccatttatacaggaggttgcacattttttgtgtgtgaaaaatcagaccttggtgatgaccttgagcagtaggatataaataacttccacaagcttagcgttccaataatggaacactaggcctaaatgggttaagatgaaataatcatatgatcatttcactatctgcagaaaaaacacttaagaaaataaaacatgtatcattttttaaaagactcagaaaacaaggataataaatttatctgctaagaacctacagcaaatatttttcttaatggtgcaaccttaaagtattccttttaaaatccagaaacgtctcttcatcattctataagagatttttatcttgcagtaagacaagaaaagagttataaggattaaagaagaggaaatatattgccataattcacaaatataattattcacataacaatcaaaaagaatctacaagtgaaactatgagaattaattaaagtgatgaatcaggtggctgcatttaaaaatcaacaagccaaataatctgttgcatttctatggaccggcatcataaaacatttactttaacaatagaaaataaaagtcatttttttgttttattttttttctccaagatggctaactggaggtatttttggcatgcctctcccacccggaaagacaaaatagcgtgtggaactcacactgtgaacttttttccaagaagcaacacaggaacttaaccgaaaaatggaaagaaaccacagaccctttgaaggaagcaatgggcaacagcctacatcatgaaccagacggaaaatggagcctcccaagggtgaattggggagagcctgccaccgtgacacacactcccactgggaagccaggaaatccaggccatggggagaaggcgttaaccctacccagtgctgcagctgatttagtgagcagcggggaatatatgagaaggaacggcatcagtgtgtactcccagtctccagcagggatggaagaaagccatttctgatccattctcacaacgaacctcgcaaaagttggccagctaattcaggcagtggtcacaggttgagagaagctcccaaatgaggtttgcaatataatctcaagtgggaacgaacctcgttggccagaccagaggagcgagcctgaagtgtgttgtcaccacgggggcaggagctggacacctttgcttcatgggcagacaggaaagggtgtggcgtgaaagtcactccatctccatagggaaggcttatagtctggggaagtttcgagttctgaaacaagctgcctgaaacccagttagctgctgttagcagatcactgtgggtgtaagacttgccttgcaagagtgtgggagctgagtggggcttactgccacctcccagtgtagattcttttgtgtagcagaggcagctgtgctcctccccggaacattactccagcagccagggagctgccttctgcttcccactggggctgctgcttgtgcctacatgtggagagccagagcacagacttgcctgacccatccccaacctagctttacccctccacctgccctggtagcataacacaaaagacaaggacacttgggagttccatggctccacccattgcctgagacatcagagtacctcccctgggtaacataaggcaagcacaaattccactgctaccaccataactgctgtacttttgaaagcaccatctcctggctggtgtgcaactgaacagccagttacaacatctgtaggtcagataacagattgtatcttcttcctggctcaggaaggagaaaacctttgcacaacctcagctgtcaccactgcctgcatcagcctggctaaccaggagatcttgagtctgtccatgagccagtatatcactactacagctgacatttgagaaagccaacacactaaggctacttataatgaaagaaatctcagagtctacgtcactcctcttccacctccatcagagctggtactggtacctgctactgggaaactagaggacaggtcacatctctggattccttgcagacattccccagcaccaacctggggtgtggcagcctcactgggcagctagacccaaagaagcagcaagattcacggtagcctggctctcagggactgctaattctagggggaaggggagtgttccatattaaggaagcaccctgtgggacaaaagaaaccagactggaggccatgagcccctgaattttccacctgtggggagtttcagcagaggcataggtacagtactgagctcaagagtcaggcagccctggtgctcatgaagggtcttagagaagggtacttctccccctcaccatctgtggacagccttactggagtacttcagggtgacaacatccccacaggaggaacaccctccaggtccaggcttgcacaagaggtagagtcacaacccctctctaaatggaacatcagcattcctaaaaatgaaatgaggtgtttgtctgatctgaataaccagaacattgggttgggaatgtgactgggtggtggatcgctttcctgctggcttggaaggagagtcacggtggctccttctcttccccttgaaaagtcctcagtgcagcttccccagcctgctctgtcaaggctgagatgtctgcccaacactggggtattgcatttactcacctgctttagccgcagccagtttttacccatgggtaccgcttactggcctgaagcatgaactattcaatccagtgaataaagtaattgggataaaacactttttaaagtgcacaccatggggcaacaagataagtgtcatgagacctcttccattccagccacacaggagacagtgaacccatagacccaccacatcactacgactaccagcatctgagaaacccattgcatgaagattttctataatcaaggaactcatactgagtccaccactgaaagcagccagaaccaaagctaggtgacaataaactataaacattaaaagcacatcctcaagggggaaaaatgaaattcttaaaaaaacccagttgaatcaaaaataaatacaaaaataattagaagacatagtctacccaaatgagaaggaaccagaaaaataattctggcaatattaaaaacagggttctgtgacatccccaaaagattatactaactctccagaagtgggtgtaagccaaaatgaaatctttgaaataccagataaagaatccaaaaggttgattattaagtaactcaaggagatacaatagagaggtgaaaaacaaataggatttttaaagaattcaggatataaattaaaaatgttctaaagagatattttaaataaaaaaacaatcagaacttctggaaatgaaagacacatttacgaaactagaaaatgcagtgcaaattttaacaatagactagaaggagtctaacaacagactagaagagataatttcagagctcaaagacaagactttcaaattaacccaatcagacaatttttttaaaaaagaatgaaaagaaatgaacaaagtctccaagaaatatgagattatgtaaaatggccaaacctaggaattataggtgttcctaagagagaagaaaaatcaaaaagtttgtaaaatctatttgagggaataactgaggaaaacttctctggccttgctagagatttagacattcagatacattcagacattcagaagctcaaagaactcctgagaaaatcattgcaaaaaggatatcaccaaggcttacagtcatcaggctatctaaagtcaacatgtaggaaagaacctcagggccagacggattcactactgaattcgatcagacattcaaacaagaattagtatcaattctactaaaactgttccaaaagatggaggagggaatcctccttaactaattttataaagccagtatttccctgataccagtcaagaaaggacgtagccaaaaaaaaaaaaaaaaagcaacaacaacaacaacaaaaccactactgaacaatatccctgatgaatataggtagaaaaatcctcaacaaaatactagcaaactgaagagtgcatcgaaaacataattcaccatgatcaaagaagtttaattctaagaatgcagggatggttcaacataaacaagtcaataaatgtgattcatcacataaacaattaaaaacaagaactatatgatcatatcaatagattcagaaaaagaacttgataaaatccaacatccctttatgataaaaatcctcaaactaggcatagaaagaacatatctcaaaataataaaagccatatatgacaaacccacagccactatcatattgaacagggaaaagctgaaagcattctccctgagaagtggaacaagacaaagatgcccactttcactacttctattcaacatattactagaagtcttagccagagcaatcaggcaagagaaagaaataaagggcatccaaattggaaaagtggaagtcaaactatctctgttcactgattatatgattgtatacctagaccatcttacagactcctccaaaagactcctagatctgataaatgaattcagtaaagtcttaggttcccaaatcaacatacacaaatcagtatcactgctatacaccaaaaacaatcaagcagagaatcaaatcaagaactcaatcccttttacaacagctgcaaaaaataaaataaaatacctaggaatacacttaaccaaggaggtggaaaatcgcaacaaggagaactataaaacactgctgaaagaaaacatagatgaataataaatgaaacaaacagaaatacatcccatgcttgtggactggaaaaatcaatatcattgaaaatgaccatattgccaaaaaatctacacattcaatgcatttctatcaaaatatcaatatcatttttcaaagaattataaaacaacaattataaaattcatatagaaccaaacaggaacccagtagctaaggcaatcctaagcaaaaagaataaacctggaagcaacacatacccaacttcaaactatactacaaggctatagtaaccaaaacggtatggtactggtataaaagcagacacatagatcaatggaacagaatagaagacccacaaataaagccaaatacttacaactaactgatttttgacaaagcatacaaaaatataaattggggaaagaataccctatttaataaatggtggtgggaaagttggatagccacatgtagaagaatgaaactgtatccctatatttcaccttatacaaaaatcaactcaagatggattaaatacttaaatctaagacttgaaaccataaaaattctagaagaaaacctaggaaaaactcttctggacattggcctaggcaaagaatttatgactaagaccccaaaagcaaatgcaacaaaaacaaaaataaataaatggaatctgattaaattcaaaagcttctgcacagcaaaagaaataatcatcagagtaaaaagacaatgcagagtgggagaaaatatttgcaaacgatgcatgtgacaaaggactaatatccagaatctacaagatactcaaacaaatcggcaagaaaacaaataatcccattaaaaagtgagcaaaggacatgaacagacatttctcaaaggagatgtacaattggccaacaaacatatgaaaaaatgctcatcattactaatcatcaggaaaatgcaaattaaaactacaatgagataccatcttaccacaaccagaaaggccattattataaagtcaaacaacaacagatattggcatagatgtggtaaaaaagaaatgcaagtacactgctgataacaatgtaagttagtataacctctgtggaaaatagtatgaagatttctcaaagaactaaaaatagatctaccatttgatccagtaatcccactactgggtatttacccaaaggaacagaagtcactatatcaaaaagacacctgcacacatatgctatctcagcacaattcacaactgcaaaaatacctaactatccatcaactgatgagtgggcaaagaaaatgtggtatgtatacaccatggattactactcagacacacacacaaaaacaatgaaataatgtcctttgtagcaatttggatggaactggaggcattactctaagtgaagttactcaagaatcaaaaaccaaatactgcatgttctcacttataagtgaaaactaagctatgggtatgcaaaggcatacagagtggcacaatggacactggaagctcggaagagggaagagtgggagggtgggaggggggtgaggagtgaaaaactacctattaggtacaatgtacactactcaagtgatgggtgcacgaaaatcttaagacttcaccactatataattaatccatgtaaccaaaaaccacttgtatccatgaaactattgaaataaaaaaattaataaattaaaaaattaaagtctagcaacagttgtacatgacacattgaaagaaaataatttattattgaatgacattttaaaagtcttacctaaacagacagataaatgttttgagaacttgacatgctgattctaaaacttccacagatgaacaaaagtccaaaaatagccaaaatattcttgaagaaaagaagctggtggtatataccccactgattaatatttattatagaactataaaaatgaaaatattatggaactgatgcatggataaatagcaaatatggtcccataaaatggtggcatgatgttgcagactcaagtgcataccgaaattttatatatgacatttcagattctaagaaaaagagaggaattattcaatgtatagtttggggaattgattattcaaataaaaaaggattatgaatgtaatttcacagtgaacttcaaagcagttgtttattttgagggttagaagaagagtttttttgtttttgtgttgttgtttttaaatcaggtacaactgattttttagagtggttcaatttggggagttgagcgagggaagaaaagatgttaaaaagtaatgtttagatgaaaacaaaaggtatggatgtggttatagagttcaggtttaacagggaaaatttttggctttttttaaacttatgtgttatatggttaaccatcgaggggtatgacaagttattccagcttttccaaatattaattatattggttttaagaagtctccataatcacaggtggcattttcccttcatctgtgggagtagatgatgcaacccacacagtgacttcgaacttctttgatagaatttccactgccttgttgaatttctcactgtatcgcatgtcttgccaagtgtgaaataatgagtttatgaaaacttcaaaactacacatcattttgcatgaataatacccattcgagctaaggagactgacatgttttgtagcatttccgggtaaatgaaaattttattggcattcaccatttactagctttgtacaatattataaaggtagaagcaaaacagcagcacattgtgcttggcttataaggattgctttagcaccattacgttaaataaacaatgtgcatagtgtattgtaagtgcctactcttgcaaatttacaatacttaaatatacttaacattctaatgtattaaaagtataaagaaaaaactaaacagacatttatagcaatactatgaaatctccaataattgttttgactgttgcctttggctctttagtgcaacttttctacattgtaattactatattgtgttgctttgtgtttcctatttgttatacataacttcagagttaagtaccagtacaccaagtactgcaattacctttcagttattgtacgtgcaatgtaacagcttacagttttggtgcttaataatattcctttttttctttaataaaggatatttatttgaattttttaaaggaataaaactaaatgtctacctaatatgatgtcaaaaaaaattaccccaatggattagagatttaaatgttaaaggacaaattttaaaatatttacaagaaaacaggataatatgtttagaccttgagttacacaatggtttcttaaagaagaaacaaaaaagctaactctaaaagaataggtttataaattcagctacattttatattttcacacataaaagaatgaaaacaaaccaacaaactgctaaaagatgtttgtaatatgtataaaccacaaaggatttggtgtcaggaagttatcaagaatacctgaaaagcagtaagaaagcaacaaataccacaccacaaatatgggcaatgtttctttcattgatttcattccttacagaaaaagaaatacaaatatatgaaaagatgcttgaattcattagcaatcagtgaaaagaaaattctaatggtaataaaatatattacatttagactaaaaaaaagaaatctgaagatacccagtatttataaagatataatcaaaaggaatgtttattgataaatgtaaaaattggtataacccctttagaaaataatttgttatatcttataaatgtgaatattagctcacttaatggcacaggcatcttaatcctagggatataccctagctcttccagtgaagttcatgacacaaaaaagtagaatcagcccaaatacacactaatatgatatagatatataaactgtagatgaaatatataacagtgaaaatgcatgaactttgactacagaattcaaaaataagcaaaagtgatttttgtttaggaacacatatatatgtaataaaagcaaatagtttttgtttaggaacatacatatgtaataaaactatttttcaagagacagaaggaattggtaaatacaaaattcatgctattggctacctcatggggaaaagtagagtgatggaaaatgactgagcatagaccaagcaatagtagtggcaaagttctaacctaaatctaatggtgaattcatggctattcattttattatttccctttaaattggcatataggtgattacgtattatttctcatgcacagcatttgatattgagtaatttgcaaataaatgttagttcttatcattttgtaaaatttacagcagcagaatgaaataagtgacaagtgtaataatttatcaagataattaatcaaaattactaaaatgtaaaataaatggaaaatagcctaaacattattgtaaataattcaataaacaattacataagctaaacttaattgacaaaataacttacctaacatgttacatttctctttagatgaacaaatgtcttcccttaaaataaaagatttattttgaagcatttttggaaaatatttttgcaacaagccaaaataaaaataaagaagctttaactatgacatgactactaccacaaactaacttctaaaatctagttcacattaacctctcaaaaagtctaaacctagagtaatgcaccatttgtccacatcaataagcaatacgtactataaaatcagtgttgtaaatagttgaatcattaaccaagttcaatgaaaaactttctattttaaatgtctctgcttttacttacacagtatatgtaatatagtttaccctcatgatgattcaatgtcatcatcagcttcagttatcattctctcatgcaaaataatggtgttctcagatgttacgaagttgataaattttttttgcttctgcattacttagtccatggccattcaatttgacagttctcgtgtctcctttcttatcacctctttctcatagccctttcttcctcccatatttaatctgctatctccaatctctcctgcttggcttttaactacaatccaaggaagaaccatggactatatataacataatactatgtataaaattaaatcaattctactttagttttgaaaagagattaaagtacagtcatgcactgcataacatgtttcagtcaacaatggactgcatatatgacatcggtcctataagattataataccatatttatactacaccttttctatgtttagataggtttagatacacaaatgtttaccattgtgttacaaatgtctgtagcattcagtacagtaacatactgtacaggtttgtagcctagggccagtaggctataccatattgccttggtgtgtagtagactacaccatccaggtttgcataagtacactctattatgtttgcataaagactaaatcgcctaatgatgcatttcttggaatgtgtccccgtcattaagcaacacataattgtacatgaactacatgttagctatattacattggctgaagtttttcatttcaggattctagaaagctgagatttcttttgagtttgatgcctaaataaaggatttctttggttagtcaaccaaatatcaaacctaggatttatatattctggtagtatcactgttgctgaaagaaaggtgtaaattaacaatgtatagcattgcttgtaaaatgaataataattttataacagcagaagctgtttttcatataaataagtaggtttgagaacaaccctagcaaaggtagcctggtaattaaggcaggcattaagcatcaaaacgaggaacagataaacagatttttaaaaggaaagggagtccaaaaagtggacaaacgaaagaagaacaaagttgctcttctttccaagcaactgaaataccaagaagggaatgaacaaaacctgctctcagttccataactatgttaatttcttaattctctcattctgtcactaatatcgtaaggaaattgtcttgtttagatcaaaccattactcagcaacctgacattgctaatttcctagagaactaactagtattctggtttgaaagaatagaagaatgcttttattcgatagtttcttttgtaatacaaattcttatagaacacttctgtgtattattaacaaagaattaagaagaagtggccgggcgcggtggctcacgcctgtaatcccaacactttgggaggccgaggtgggtggatcacgaggtcaggagatcgagaccatcctggctaacacggtgaaaccccgtctctactaaaaatacaaaaaattagccgggcgtggtggcgggcgcctgtagtcccagctacttgggaggctgaggcaggagaatggcgtgaacccaggaggcggagcttgcagtgagccgagatcgcgccactgcactccaccctgggcgacagagcgagactctgtctcaaaaaaaaaagaaaaagaaaaagaaaaacaaaaacaaaacaaaaaaaagaattaagaagaagtatcagtcatgcaggagggaagagtaaaggattgtatgggaagggttatttctataatcatacctagtgataagaacagcagtgtcatggtgggaagggtgaacatcatcaaggtcattctgagtttgttgccatgaacaaaagttctttaatgtggtagcaccatcaaaattaatgactggtccttcctatgcaaaataagcaatgcaatactatgtcaaaatattaacgtcctcttttccttccaagtttatcagcatctgcacaatttatcaaatagcattctcacaggtgaatgaaggagtgacagcatctcttcttcatatattaactataacgtattttagcaatatctaaaacattatgatcaaaactgaatctaattagatcttcttaatacaaccatccaatatttaggaaaaaaacttttaaaaacgactatattctaaatcctctgacattaggattataaaaatgaatactaaggttttcaatattttatttttgaattgtttattcacttttgttacttcctttactcagttaaacactgttgtcattctattttatttccatcacaacaaataagggtaatctcattccttctcaaatcaagtcttttaaaattttaaaaatatctcatttctaataagagttccataatctctacgtattgtcactaaaaacttactacaactaaggttactaattttagacctgtttcttacctcctcacggtgaatcataactaattttaccactactatgtgtatcaaatttccaatacttggatctttgtagattgttgcaacctgcatgtaaaaaaaatgtaggattagttgtttaaaatgaatatttcttctcaaaagtaagttgaaatagtcacagagtatcaattctctaattgcactgcacgtaggaatcttggaatctcttagagtgctttaacaaatcctcatgttcagaccacatcccttaccaaataaatcagaatctgcaggattgagactcaggcatcttaaagattctcaaaatttgagtatcttaaaccttgctactgagactgatccatggatcagcagcatccacataacctagagctgatatgaaacacagaatctcaggccccaccctggattaatgattcagagtctgcactttaacaagatgtcaagtgatctgaacacatgttagagtttggaactgctgttatggatgattcagcaagaaattcacttcattctgtggcataatccacaatttacatgactacaatattccataaaaatatgtaagttttacctattcttttctgatagttcacctaatctttcggccacagttgcatatttccaactccaaatatggttattatttttaaagtttagcatcaccagaatccatagaggcagatccatctagaatcatataaacagccctagaagaggtcatgagtcacaacctggtcctcaattttccaggattggagaatgttaggcactctgaatgggctctgcatgggctcatttatgattcatgatcaaagtgccatcccattcgctaattcatattctcttcttgtagccattatagaggttgccactgcagtaggggtgtcttccatggccaatgcctctgcctggtacttaattagaggcatatcccactctggatctgggctacctgtgcaatgaaatctgcttctaaaccctagatcaccttcttgttggccactgcctaagtcaaggcagcaattgctccagggtgtgctacttccctcagttgtttaataaagaaatgttcagtatctactcattgctttgttggctagagaagcagatatagataagaggacaaaggccctgaccttatgaagcttacagtttgttagaagtatcactaccggagccctcactctatcaaagctgcttcaccacaacatataacatgactgctaccaatgtctcttgtgccaaaaggactactaccagaactagagccaaaagcatctttagagctgctgacactgtagggtcagcatgagcataaatacataatccagcatctttactactgttatagctgtgcagcctcaaatatttacaggtttgtcatctgtacctatagtgatgactttggctctggtggtagcatgttttggcaagagtggaggtagccccagtggggttgacagtaagttaagactgggatggtcagctgattggtgatttcaagcaggtctgttagcaatgcagtatttctcactttaaaataggagctgtgaatttacagttgaatttatatattcattttacaggcaatgttttaaaatacatctaccatggagaaaaaaaaagcacacctgtaattatgattttggagttactttgatcctgtgagtttaaaagtggatgcttttctaagtcaaattacaaggtaaaagacaaacctcaaaggtatttataaaagctctttttcccctataaatgaaaaacagctgtgaagacttctgtgtctcagaataatatgcatatccagtggtccacagaaaaaagagcatatgcactatgaggtgtctacatggctaactactatatccattgtcccaagtattttgactatgaatgaaaatctggatgttataatatcagctataaaatatataatcacaaaaatatttccagtttcggaaggaaacagatgctgcacctttatttaaaagtgacaaatctgcaagctagaatttggaaaaaaattcccaatattctgatagtataattaaaatatattactacagcaaaatatccttgaatgtaacactaaggaaaagataatgcaaacaattgttatgcaaggtggatagtggctataaaacatagttatttaagggaaacagacacaggttccaattctaagagccatttgataaaacctacttctaggctactataaggattaaatgagatggtctgcaaatagtatttagattagagccaggatcatagggatcaatcacagtggctattgttcttattgctacttataaagctttttcagaagaaaaggcataatacagatatagatatacataatgctagttctagtacatgtgtttcaagttaattatcacagtatgtctaaattggaagcaaagtatccaaaagcatgattgctttattatctcttttagtacttactgaatatctattgcccatcaaaccctgtgttgcttactaaatatacagagccaaacaaggcataatctctgcccttaactcacagtcctctgggggtaaaagatacaaaaacagatggtttgatttaaataatttttacttcccccaaagaaagtgatattttgcttttacactaaaatagtatatttcattaaataattaaggatgtcatcatgctcattttttctaattgtatctcttattgttttactgacctttataatttaagtgctcatataggatatacgtatacctttaactatatttagatgtttaaaggtgatgttattgaacaactctattcaataaagctaaattgtgattcaagcaatgaatagccacaaggcccatttggtactcagagaatttttgaagcagtatgtacaatgcacttctctccttcctaaaactaccaccccaaattagattgccttgatgataggatactacgtttgctataaataataaatgagtaaatattaaatgatacataaaatatttattcaatgtttattgtgtgccagatgtgttcaagtttaaatgtattaattcatttaattatcacaacaaatcttatgagataggaactattatagtgtccattttacagataagaacagtaagatacagagaagttaactaagacactgaaagttaggcagctggtagcaaacagaacccaattttcattctgtacagtctggctttagagcactgactactttatctgatctttattcagcattctgaaccaattagttcttggtacaaaacatttgaagacatttcaaaaccctgctgcaacacatcccccggccactggtattgtcctgttatagtcacttgcccgtggcctcagagaagccctaggcagtcagcagacctggtctttagttccagctctaaacaagtagctacaagctagttgttcaaccctggaaaatgagttgattttttttgtcttaatgtctttaatatccatgttgaggcactgggtacccttgggtcacaatgtccttgcatattggattaatattaaccaggtgctgttgggaagagttgtgaaagacatttgttttaaagaacaaaatcattccacagtttgagaaatgagctaaaataattagatatcttcatggaatcttgaataggctaacacacatacacacacacacatacacatattaaatctatgagacagagatattatatacagcatttcatgcaactatatgaccgtagtccttagccccccgaccatggagcgtatcataggactaatattccattccatagactacactttaggaaacaccagaccagatttctaacgtatcatcctattctaaaagccttgtaatattttcaatatattaccttaatcactacattttagagtgctatgtattcgaatttttattgatctacttaaaatgtatttaatctttcattccttaaatgttagtttccttcacttaagtagttctgacttgtttataggtttcataaaatagtaaatattattctttcatggatatttaatgaaaggtgaagaagaaatggtatgaattgtattgttgaaatctttaagaaaattctaggcaaaatatacttcatacaaagcatgaaacaaattgctatcaccattaacttaccaaccattttgaaaataatttctagatagagctttagcaaacattcacatatggtatgttcataggccaccttcattaagaagtacaaagtcatctataaaaaactgattttgacaaacaaattttgtttacaaagatcattactctttacttctttggaaagatcttttcatttttaaattgaaaatgatgaaattctacatacatacaaagcgaatatgtgcaaataattaagaatatgcagagcactaaattgaagggaaaagtaatataaatggttatacctgaagtatgaaagcatatcattagtttttattttaatatagttaaaaatcttccccatcctaataacgtcagtaaaagcaactaacaagattgaaagtaatggtataaaatcaatgtaatgcaaatgagggtttttagttgatatatgcctctaataatagtaaccataatttaatgaaagggttaattcttgaggattacatgatgctccttaaacttacattattaaatctgcaacaggatgaatattatagagtcaaacccttacaaacacaatgaagtgtggaagtctttaatacttagtaaatatttaaggtctattaaataacaaattgagtatcaaaataaatatactgaagaaaaaactgctctagtttacatacatttttagtagcttaataatgcatatatatatgccattttaacctggtgttgtcacccaaattccctatgaataaaggttttagaataacagctgagtatctctgctcatttaacacaaacactatttcactagatatattagtgtgttcttctccactaattttaatgttaattccagaaacctttaagtaagaagggtctctagcctattctaacaacattaagtgcaactaaaaagtgaatcaagtcacattctttatttcaatatcactgcactcaggtatttcgttaaattgttgaaagcaaagaaaaagtttaagaagacagcacaattgtttacttcgtgcaggatgagtaaggatagataatccaagttgtgtatataatccatttgctcaatcctgaaagcattcccctatttccccctttatatttggagctcaacagacaaaaattattttttcatcactttgaacttgtctttatcatataccaagcctatgtcacattgtcttgaccttttcctaaattaccgtgacagaatatcaccaataatccatgtgtatgtttgaataaatgcagttagtgccttctaaaaactggaaaaagtatgcaaaacctgaacagctccttcctaaactagaaatatctgtggacacttatgtgcaaatagcatttctcttacccctttaaagcggtttttgaaatggtcttaacaagtaacaataaaacaagttggactggatttgatcgctacacagtgtgatcaacagtcccagtttgctcaggactgaagggtttccaaggacatgagactcaataccaaaactgatcaagttccaggtaaaacagggagagtttgtcaccctttctcttaagttccctttcacctttaatatttttgcaaccataaatatagttgtgatcactgttttttaaccaataaaacaacaatttatgtacagaaccatagggtctactaattttcctatgtcctcacttgaacattctttcagtgagagagaagaaaagcactaaacccaggtagcttagaagtcatctgaaattgggcttcttaggaagaaagaaagcatatacaaaaactcaaagtatctcaaaagggagacttaccctccttaatttttcctcctaccccacttatatttggaatgcacaccttttcctcaactttgctgcatctatctccctaagaacaaaagcttaacacaaaccagatgactgcgtctataaaaattctgtcttcaacagaaacctgctctctttctactaggcctaaaaatccagaaaatgataagcacatgcattggtctgttgtttcaagcaatctcagatgcagatttgctttccatgaagtcaaaaggtctgtctccattcccttcaattaactctggctttaaaccttccatggagaactttagttatctcaaagtatgtcacaatatcttctaacagtgatgatactgattttttttttttttttttttttagatggagtcttgctctgtcaccaggctgcagtgcagtggcacgatctcggctgggaaccgagattcccagtggcaacctctgattcccaggttcaagcaattctcctgcctcagcctcccgagtagctgggattataggcacacgccaccatgcccagctaatttttgtgttttcagtagagacagggtttcaccatgttggccaggatggtctctatctcttgacctcatgatccacccaccttggcctcccaaagtgctgggattacaggcgtgagccatggcgcctggccaatactgatttttatgtaaaatatagataacaaaacctttctgagggtggtgatgtcaccaagaatgcatgaaactattccaaaattggtcctgtgtttattcctttattccttctagtcagtatgcccaaagcactgacaatagttatctgtcatttaccatgttttaaaatctatcaaatctagtattttccttcagtatctctcccacccaactttctttccttattgcttttttttttttgagagagagtctcagtctgtcggccagactggagtgcagtggcatgatcgcggctcactgcaacctccatctcctgggctcaagcgattctccagcctcagcctcccaagtagctgggattacaggcatgtgccaccacgcctggctaatttttgtatttttagtagagacatggtttcactatgttggccagactggtctcgaactcctgacctcaggtaatctgcatgcctcggcctctcaaagtggtgcgattacaggcgtgagccactacgccgagccccaactttcttaatgaatgtcatctcctttaaccattttctattgcaaagtatatcccattgttccatataattgatacaatcttgtacatatcaactgacatcctccacaccatagttttcattagaatcccttcataatttagagtttgccataccaacatttagataattattcatctaggtaatatatgtaggtaattttacttcaaattcagaatttaaaaaaagtaattaggataaatttctatctatacttctgttgtcattttaaaaaattcaattgaagtaaacaaaataagggtaaattttacacaatttcaaaaaatcattttatatatttgtttttatttatcacaatgcactgaattctgaaaaaatattacttttattaatactttaaccatgtctccattcattctttcagtaactatttattgagtacccacactgtatcatatactgtgtttaggcaacgtagactatggtataacaataagaatttaaggtaaaatgtcatattttagaaaaatgattgtctcttatgatcttcatgtcacaatgaactgggatctagctaagggaaatttacaatatcctatagatatgcccttgctaagtcttttcaaccaagtgggcctgaattccctatatgtgaatagaagtacttccagcaatgagatatgttccaaatacactgaatctataaataggtggctatgtaattcttttttttttttttttttttgagtcatagtttcactcttgttgcgcaggctggagtgcaatggcacgatctcggctcactgcaacctctgcctcccgggttcaagcgattctcctgccacagcctcccgagtagctgggattataggcattcaccaccacgcctggctaattttttgtatttttagtagagatgatgtttcactatgttggctaggctggtcttgaacttccgacctcaggtgatcctcccgcctcagcctcccaaagtgctgggattacaagtgtgagctaccacacctggccagtaattcatcaactaaactagcatgaaaagggctacccttagtgattactctaaaataacaggcctaattcaggaatgtcccagggtggtggagggggatacgcgcgcgcgcgcgcgcgcgcacacacacacacacacacacatgtaaggatgaagcgtgatgccacttacacaggattgacacccttcactagctctagaattcagttctgtgggtactagcactaccactgcttgacaaagatagtaacatcagatcaaggacccttagagttatcgtgaccttatattccaaatttgttaggactgttgcattagtaataatctatccctttaacgccataaatacatgtataacttaaaatattaagcgtccaaatttctgatttggagaatatagccataataaaaatagtatcttctcccctctgtgcagaaatagggtaaggttttaaaattcagtttcaaagagcaaaaagatcaatgcaactaggatagtcctgtcactagagggcagaagccattcatgtgagaaagtaaagaataattcaagcattttctataagaggttttggggatttttaaatgttttagaaaggtgtccaagtaacagaataggatacttgctataactctatctaaactaaacttcaatgaaatcttatttttggcttaaacctagatacaaaattacatctaaagagtttggaaaaaaaatttaattcgacatgaaaaaatttcattaagctaaacattttaggaaatataaaagtcatattaagtttacttacaattgacattagagtcagtatatagttttgcaaattcgatccatgagcagaaaccactttagcatcagctgtaaccataatttcaatgtatcttggatatgatataagacgttttttcctggaatgtcttctttcatctttcaatggtacattttttgatgtgtgtcctaaaactctttctttcattacattaagatcttcattcatgttgctgtaggtatgaaagggtaaactggtttcctttatttgactttctagggagaaaaaaagaatataatgcagagccattaaattggatgtgacgaaaaatatcgcaaaaaatagaacagccaaaaatatttaatacttacatatctgttcccaacatgaaaataaaagaacaaagagaaattgttatttaaaatagtattgtacagcattatcatgaagattgctttttatagtaataaaaagtttgcaaaagttcacattttcttagattttaccaacaagaaattttatctaagtcatatttgaaaaggaaggtatgacgattcaaaagcatttattaactaccaagtagaaaataaaaatatccaggacttcttatgtttttctcagcatgtaaattaggttttcaagtcaacaatgacatttaatctcattacagagtagtaccattttgtagggtgaaacttcataaaatatagaaaaaaacaaactttctttatactacatgcgaaaagcaccaagaacaacagaaaattaagcaaaataacaatatgtgggtgaatctattgaatccagaaaggcaaatgttcctataaattttttagtacttgattatataaaatacctgatttattatgtttgcttatatataaatactgcatgaaaaataattgaacattaaagattattacagtgaagtaatatgcatttaagtcctacgcacttacagaaacttacacatttatgcctgtgcgtttaaatcttaattaattgccctaatggaaaaaaaaattcataggctgcacaggtgcttgtcctatttctctccccttcattttgttcctctcctttcctctttacttcttccttttttcttggctaatttttctgacaattgtttggtggtggtattttcaatagaaaagcggaccaaaggagtcaagtgagaagaaataaaggtcctggatagtttagaaaccaagtaatcaataccaaaataatcaataaccaagacatggctgtattataagaattagatataaatataaaaacatatttcattattattaaaataattcattttaagtacgaatgtaatcctatggctgtaagaaagaaacagaacactttagacattaagtttccacagatgaattttttttaattaatataaaaaattttattcgtcttattcttttttttctatttaatttttattttaggttcaggcgtacatgtgcaggtttgttctgcaggtaaactcgtgtcatgggagtttggtgcacagattatttcgttacccaggtactaagtatgttaccccatatttgtttttttctgatcctctccctcctcccaccatccaccctcaagtaggcccaggtgtcttttacttggtgtgtctatgtattcttgttatctagctcccacatacaagtgagaacatgcagtatttggttttctgttcctgcattagtttgctaaggataatggcctctagctccattcatgttgttgaaagaacatgatcttattctttttatgactacataatattccatagtatatatgtaccaccattttctttatctagtctgtcaccgatgggcatttaggttggttccatgtctttgttactttaaatagtgctgcagtgaacatacacatgcatgtgtctttatagaacaatttatattcctttgggtatatgcccaataatggggttgctgggatgaatgccaattctgtttttagttctttgaggaattgccacactgctttccacagtggctgagctaatttacactcccaccagcagtgtgtaaacattcccctttctccacaacctcatcagcatctattattttttttattttttagcaatagccattctgactgatgtgagatggtatctcatcatggttctgatgtgcatttctctaacgattagtgatgttgggcatttcttcatatgtttgttggctacctgtatgtcttcttttgaaaagtgtctatgaacttctttttctaattcctaaaaacatctagcttttaatattgttatgttcctaggttttaaaatttatctcagtggaaaattctggaaatttgacaaattgtgcagtcctaaaactttttcttgccattttctcctgaagtgacttggtcactaaaatatccatgaccaattactggaccctagaggagatcccagatatacctgatatatagaaatctcaatcaaggaaaagataaatatttatgctttgatttatttgttaatttaaaggaaatattgcatgtctaatccatatcaggaaacatttaggtattgaggagcaaatagcacctcataaagcttacactctagttgaaagaggcaaaaaataaattaacaacatagtaaagataaaatttcaggtatctttaggtgcttcaataccaattcaaccaagagacaaaaaaaaatatgattctacctaccagaatgactaaaattacaaagagcaataatacctactggtacaatcactttgaaaaccaatctggcaaattttaaattagacatgcatctaccctatgacattgcagttccacccctaggtatttatctaagagaaggaaaatatacattcacaagaaaactggtataagttcatagcaaaacaaatatatagactgatgaactgcaatagagaccccagatataaacccttgtgtatatgatcaaatgatttttgacaagagtgccaagaccactcaatatagaaagactaactcaaaatgagttacaaatctaaaagacccaagatattaaaactcctagaagaaaacatagagaaagtgtttcataacattggatttggcagtgatttattggatatggcatcaaaagcacaggcaacaaaagcaaaaatagacaaatgggactacatcaaacttaaaaaattattgttcaaaggacacaatcaacaaagcaaaaaagcagcctatggattaggagaaaatatttacaaactatatatctgataaggaattaatatctagaatataaaaaaattcctgcaactcaacaacaggaaaacaaacaacctgattaaaaatgagtaaagacttgcataaacactttcccaaatacattatacaaattatcaacacacatatgaaaagatgctcagcacaattaatcattaaagaaatgcaaatcaaaaccacaatatcacttcacacccataagaatggctactattaaacacacacaaaacagagagaaagagagaataacaaatgttgacaagtatgtggagaaattggaaaccttatgcactgttggtagtgttgtaaaatggtataaccactacggaaaacaatatggatgttccttaagaaataaaaatagaactaccatatgatccagcaatcctactggggtaaatatccaaaaacaatgaaagcagggtcttgaagagctatttgtacacccaggttcattgcagtattatttacaatagctaagaagtagaagcaacccaaatgtccattgacaaaggaatgaataaacaaaatgtagtatacacatacaatgaaatattattcagtatataaaaggaaagaaggcatgtgtggtggcatgcacctgtagttccagccactctggaggctgaggtgggaggatcacttgagcctccaagtttgaagctacagtgagctatgatataccactgcactccagcttgggtaagaatgagattccacctctaaaacaaacaaacaaaaacaacaacaacaacaacaacaaaggaaggacatgctgtgacatatgacaacatgaatgaaccttgaagttatcatgctaagtcaaataagccagtttttttttttaaatcctgtatgatattacttaaatgagatacttaaaatagtaaaattcactgaaacaaaaagtatactggtggttaccaggggatagagaaagggaaaatggggagttgtgaatgtatatagtctcagtttgcaagatgaaaaagtcctggagatctgttgcataacaatgtgaatatacttaacactactgaagtgcacacgtaaaaagggttaagatggcaaacctcatgttacctttttttttttttctttttgaggcagagtctcgcctcaggctggatggagtgcagtggcgcgatctcggctcactgcaacctccgcttctcggcttcaagcaattctcctgcctcggcctcctgagtagctgggataacaggcgtgcgccaccatgcccagctaatttttgtatttttagtagagataggatttcaccatgttggtcaggctggtctcgatatcgtgaccttgtgatctgcccgcctcagcctcccaaagtgttgggattacaggcgtgagccaccgtgcctggccacctttttttttttttttttaccacaattaaaaaatgtttcaaagaatgtttatagcacttttattcataatagtaaaacctaaaaacaacccaaatgtctgtccacaggagaaaactagaaaggacaagaactaagtttcacaaagggtagaacagtggttgtcaggagctggggagtgagggaaacgaggagaggctggtcagacatacaaacttctagttataagatgaataatgtctgggaattgaatgtacagcatagtgactataattaataatactgtcttatttaatggaaatttgctaagagaatagcttttatgtgttttcaccacacacatacaaattggtaactctgtgaggtgatgatgtgttaatttgattgtggtaatcattttgcatgtatacatatatcaatcatcatgatgtataccttgaatatatacagtttttatcaatgaattatacatcaataaagctggggtgggggaagtgataatgaacaaagcttcagcaagagatgctttccttgtccatacgtggcatcctattctgggaaaggctgactatgctagctgatgtagcagcactggatatgatttgcaatgtgggactacaagcggccctcatctaagaagagaaaagccttctccacactcctcaaaagaaagcatccctcttgtcaagtaatttaccacttgtctctagcagaagaacaaatcccatcttatcttctactgcctgttaatatcgcactgcctgcagaatctcccaaagtctgtctggcctaagtgctaagaaattatatatctcaatggctaacaataataagtaaaaaacaacacaattcaattaagaaagcactatggtttgaagaaatcaggctgacagagactaaactagaatagatggtttctgtgcaaactaaaataatgaaagactgccacattattcataatcctaaatgcccatcgatgacagaatggataaagaaaacgtggtatatatacaccatggaattctatgcagccataaaaaggaacgaggtatcttttggaggacatggatgaagctggaggccattatccttaacaatctaatgcaggaatggaaaaccaaatactgcatgttctcacttacaagtggaagctaaatgatgagaactcaagttcacaaagagtggaacaacagacactagggcctacttgagagtggagggtgagaggagggagaggagcagaaaaaaaataattattgggtactgggcttagtacctgggtgatgaaataatctgttcgacaaacccctgtgacacaggtttacctacataacaaactggcacatgtaccccaaacctaaaataaaagctaaaaaataaaataaaatgatgaaagaaacagtttctgtctgaaatgagaacactgaaggagatgataattagatcacagaaaaaaagtctgcaataaaaaagcataaatttttaaagaatattattatcattatcattgaaacatttaataacaccaaataagataggtgctattgttaatctcattttacagatgaggaatctacaacatacagagcttaagaaactcacacagttgctaagtaatggaggtagaaataaaaacaaataaaaggaacaaaactaaacagatcatttaccatgataaaactgaatgggttgaatttgtccaccaaaaaacagaaactttatagaaatgagttaatgaacaaaatctagccatatgttaactaatcagtagcatggctgggattcaaatcctggggacctggttcagagtgttttcttaattaaaatttttttattattaaaaaatattttgtaggtacatagcaggtatatatatttatggggtacatgagatattttgatagaggcatatagtacataataacatcagggtaaatggggtataaatcatctcaagcatttctcctttccttgtgttgcaaataatccaattatactcttttagttattttgaaatgtacaataaattattgctgactgtagtcaccttgttgtactagactttattcattctatctaactaggtattaagcccagcatgcattagctagttttcctgaagttctccctcccccaaccctgacaggccccagtgtgtgtttttcccctccctgtgtccatgtgttctcattgttcaactcccacttataaatattgagaacataagttgtttggttttctcttcctgagttagtttgctgaggataatggcttccaactgtacctatgttcctgcaaaggacatgatctcgttcctttttatggctgcatagtagtccatggtgtatatgtaccatattttctctttccagtctatcattgattggcatttgttgattccatgtctttgctattggaaatagtgccgcgatgaatatatgtgtgcatttatctttataatagaatgacacagggactctgcttgacaatgacgtttaaaaacaaaaggaaagagaaccaaaatttaacaacaaattttggttgttgttattgatattgttatcaatataaatattgataatgttatcaatacagatctcaggggtttaatttcatcagcaatggaatcaaccataagagaacattctatacaactctttggcaaagtaattgaacaatttagaagagatctataatttcttacttgaacacacaacagtgttaataaatgttgtcactgtaagtaaggaaagtgagaaaattaaatccaacatagtttttaaaatatagttaaaaactaaaataaaaatatatgtcatatatgggtataataacatcacgtaagaagaagaaagcaaggagatgacaaacatggaattaagaatgctggttgcttcaggtaaggggaggcaagtgaacaaaatgggtgacggaagtgaaattatgtggttgcatttgggttgttatccaggtcttatatattgtattgggtcatatattcatcaatatgtgttatattattaataagttcttagtaaatagtaatataccaaactgactgctataaaagcaatatgctggctctcatcactatcatataaaattgttttggtaatactagctaaagcaataagaaaataaaatgaaataaacagtatgaatattaggaagaaaattttttcattgttctgattttattttgtagatgaaagccttgcataactgaaaatcccaggagactaaataagaaaccaattaagacaataatcctcaatagagaagtagttgaataatgtaatgttaggcagttgttaaatgaatgaattaggtctataaattttgatatggaaggatgtccagaatgcatttttaagtaaaaatataaatggtgtgtgtagtttaatcccagttttgtaaaaacaaactcttccaaatatacaagtactcataaaatttgtataatgagcctaaaaggtatacaccccaaacatttaacagtaagtgagacagaagacagagacagtaaaactattacatgctttctttaacatctcggtgccctttaaattattacaatgagcttattttattactgtaattttaaatttaaattattatttttaaaaacagcatatattactattttcttggctaaatatctaatctcattactttttttttttgtatttatacctaagtggtgttacaaatgttgatacaattccttacctttccaaataccctacataaatggccactattcaaagcacattggccagttcaattacatcatttctatgtaatacatccctttctatttaggtcccattgagtcaaatgttaaaatactgtgttgtcttttattaataacaagcgtattaagacccaaaactaatttagaccaaaccaaaatacaaaatcacgcacaccatgcaacaatgataatctgcccactagagcataaaacacttgaaaattacaaacattgaatatctcttataacagcatggtgtattctagaatgcaaggaggatgttaaaataataataagaatataaactactagaaaattactgttaaataataatataattagaatcccataattctacttggatgtcctactggcacctcatatttaaacatgcaaagctgaattcatcattttcttctcccatacaaagtttatctttctattaatgtgagaaatagtctcccgatacctataactgatattcaaaactgaacattaccattgggctcctcctatccctccttcaccctttgtatctagtcaccaagtttggccatttctccttcaaaatgctccttgtattgcttctcctgcagagtccttgcctccaaactcattcaggtccttctcacctcagaacattattagaataatgaatacaaaattagacacggagtctcccaaatgttcccgctgtcttcaatctcttgtccctcccattcatccttcatttatgtccaaaaagattcatttttagaaacattccttttatctcatccctatttaggatgagatataatggatcctcactgcccataagataaaatctaagcctctccctactagcccacccctaaacacagtcaccaccaccaagctataaattccctaaagactgagaacactgttgggcaatatgttctgccttttataagtgctcagtaaatgttcgtggaaagaaagaaaaaggattaggttgaagaaaggcaggataatggaggagagagatagaaagaagaaaggtagtgagagagggaaatgaaagaaaagaatatattgaagagcaagacaaaagagtttatcaggccagatcttcagggtaggaacaataattgtgatgtacaataggaacaattcaaagacagatatgtgctctttgatttgcctaaaattaagtacaatgttaattctgatgtctgtacacaggctagaattgatataatgctctatatttgaccagataaggaaacacattttacacttcttcactaacatgcaacaatccattttttaaatgaggacataaaagtgaaataatacttgttctagacttaacatctcaaacaacttgctgaatgtgcaacagatcaaatacctgggtgacccttgagataaagtgtgaccatatcagatgtattgtgaaatctcacattttcttatgatttaaattgttttctggatctattatatgccctatgttgccacactattgagttttcttattaatactattatcaataacaataaagatataatactgagtgcttattacatatcaggtactcgtacacttcacatatgttatctcatttagcattaacaaaaaccctatgaggtaagtactattattatcgtcattttatatatgaggataatttttatatgatgataataataatcataattttatataagataatattttattatatataaggaaagtgaggaacaagaaggttaaactgcctattgtaatataactaataaaataaaataccctcattttatatatgaggataataattttatatttatatatgaggatattattattattatatctaagaaaagtgaggaacaggaaggttaaactgcctattgtaatataactaataaaatataaacctgaaatatatttattttaaaaattagtagtgtttcataacataaaagtgtatgaaaatctacagtcctctgtgatttctcaatattattagaaatttcaaccagtactttagaattatggcttgcagcttatcaaatattttatagtacttttttcaaagagtttcacgagttaataattggggccccaactactaataataaatttgcagaaggttatgaacttgccagtggccagctgaaacttgaaacaaatcattacaccatcagtcttccttgcatcccctgaatcacttactattattgtgtacattttaaaacatagagacatgtgacacagattaggtgaaatttcaacagccaccaactgaataaatggcatagcaaatatatgaattcagatttctcagtatcaattattacagctgaactccacatcacatgactcttctaaaggttgaatgtggtaatatatgaagactgttgagaatgtagtaaccagggtcatgttggtaaatgttgattcctagaagactaaaagactagctactcatgttcacaaaaatatgcattacagaggtcctccttgcattgtagaagcatagaactgagacaagatttggatataaaggcttttggctctacttagaataaaaacctgagacaaatctgatactgtcctttcatctagtgaacttgaaggaaaaaagaaggcactagaaacccccaaattacccccattaatcctacagatatcaaaacattctacctcctcccactatgtgtactaacaagacaatggagcacactggtcaagcgtcacagagtaaatattttttattcttccacattctcaagaaaccaacccataggacttgttctaaagtataagacacacttcccttaaaagctgcatggaagattcctgcatacattgggaactgaaaacaggcacatgttcattcacgaactcaaagccttttaagatttttttaatggaaaggaacatgcacacctgctgtctctttacagcttttggcatcttaacgtctacacttgaagagcattaaaacaaagggatctagaactagaaataccattttgacccagccattctattactgggtatatacccaaaggattataaaacatgctgctataaaaacacatgtacacgtatgtttattgcggcactattcacagtagcaaagacttggaaccaacccaaatgtccaacaatgatagactggattaagaaaatatggcacatatacaccatggaatactatgcagccataaaaaatgatgagttcgtgtcctttgtaggaacatgaatgaagctggaaaccatcattctcagcaaactattgcaaggacaaaaaaacaaacaccgcatgttctcactcataggtaggaattgaacaatgagaacacatagacacaggaaggggaacatcacacccccaggcctgttgcgggtgaggggaggggggagggatagcattaggagatatacctaatgttaaatgacgagttaatgggtgcagcacaccaacatggcacatgtatacatatgtaactaacctgcaggttgtgcacaggtaccctaaaacttaaagtataattttaaaaaaaagagagaataaactctaaaaaaaaaaaaaaaaaaaaaaaagtgagggatcatttgtgtagccctctgcattttctttcactatattgaccaggctggtcttgaaatcctgggctcaagcaatcttcccacctctgcctcccaaagctctgggattaaaggcatgagcccccatgcctggcctcaccttttgcattttaagaaatgcttttccggccaggcaggatggctcacgcctgtaatcccagcactttgggaggccgaggcaggcagatcatgaggtcagaagatcgagaccatcctggccaacatgggaaaccccatctatactaaaatttcaaaaatcagttgggtgtagtggcgcgtgcctgtaatcccagttactcgggaggctgaggcaggagaacagcttgaaccagggaggcagaggttgcagtgagccaagatctcgctactgcactctaggccggtgacagagtgagactctatctcaaaaaaaaaaaaaaaaaaaaaaaaaaaaaaaaaaaaaaagcattccacatcttcaaatgcaatttgccagaaattctaagtgaagaagtcggactaagatgaaccaatggatcctaatgtcagatttagatggattattatatgtatagcattgtgatattccaaactcttcctctattatttcttgaaaagatgtgcttttgaaaatcttatatcagtgaattaaatatatactctagcatttgaacatgtaaatgaaatgtatcattttgttctttaaagaaaaaccatgtgttcagaattcatgctgaatatcgatatctactgagtgactcttgcaaatgtgtgaggctgctgaaattagaacatggcataacgctattaaaattcacagtaatacatgattctactacattaatcttatcttcctattttcagatgagccttcatggcactccatttccaagccatgtccactgactatgatttaacagcagacaacaaataactcccttttgtttttcaaacttttatacaggttgtttctgagctagatcaaccacaatctctaactatctgctccatgtgcataaaatcattctagaaataccattgagataattttaagtactaagaattctaaaatactttccaaaatacaaaggtaattcaaagtaaccatttataatttttaacttctctatttactccatcaattcaagtattgatataatactattttcaacaccattttcaaataatttgatgaaatattagtatgagcttttccttttgttattaactctgtaatttatgatgaatatttgtttaaaaagtcataattcagatatctaagatgtaagctaagtttacactttaactcaattctaatgctactattgccaatttttttattaatctacatttactcctcctggctctgtaatttctgaaagagcttttgactgaaaacaacagcattctcatatgaaatgttcatctaaccttttatatttccttaaaagattttgtaaaataagaaatatttaagatattttccaaagtaaatctagtgttaaaaaacttagagatgtaattaaaagattgtcactaaatgaatattaaatgttagaaacaaaaattctatgtgatatattaatagtacttaatatgttgattatggaatcagttttattcacatggcttttgtcagctgttactaagttcactatttttagatgttgacaaaagtaggaaaaaatcaaactttaaaattgtttatagatagaacacttattttcaaacaggtattttattttatgctacatcccagaatttaataattcaccatttttcaaatgaatgtttagtcgatcttatttaacaccaagaaaaatctagtatctggatacaactgaatacatgcaaaagaaattgcagactgacaggtcagagtgggtagggagcatctcccccaccccaccgccccaccgccttcagttttctggctctcattcaagggagaaaacattagtcctgaggtccagtagtctgagatgctcgccacatgaaacactatatttgtttcctgtcctggtgatggctccaactcactccaacatatgacctttacaaattactgaacacatgctagggccagccaaaaccatgaaccatcctccttttgcagttttcccttgcatttgtactctgtgaatgcagcccagtcagacgtgtcaatgtctttaaaaatagggctgcttctgaatggtgcaattctgaatcagattctaattgcaaataattagaattactgcttccttttcataagcaaagcatcatgtggctaagcagctctctactagagccaaagattcaaattgacttcactaagcatttacaattaagtggttggtagaccaaaggaaaactataaaaggagctacagggctgattagtgatctactattttagatagaaaaagttgtatatcttgctctctacaaatctatttgttttcacttatcttctttacctggtgagtaaatctaaatgagtatcaactgtataaaacaaaaatgatgtccttacagagcttatatcgtatggtccattattttaatcattcccttcaataggccctcatcatccttgctcttcttctatccaacacaagaaaattacaaactatgcacgttgtgcacatgtaccctaaaatttaaagtataattaaaaaaaagaaaattacaaactaaattttttactcttgaacatagatgcaaaaattctaaagataacattatcaaaccaagactggcaaaaatataaggtagacatgacatttgagaatcaatcacattcatcacattaacttaataaaaggaaatatgtatatttatatatctatataatcatcttggtacatgcagggaaaaagctggataaaattcaacatccattcataataaagattcttagtaaactagaaatttaggagaatttccttaatcagataaagggtacctaagaaaaaccgacaacaaacattatatgtattagaaaaggttgaaagctttcattctaaaacttgaaatgaggcaaggatttttgttattgctatttctaaggacagttctagaaaaactagccaacgtaacaaaacaagaaaaataaataaaatattgaaagattggaaaggaagaaataaactgtctacatgattaccaaggtaccgaatccaaaagaatcaacaaataaaccactagaggacataaatttagcaaggttgctgaatatagggccaatattttaaaatgcttgcatttttatatagaataaacaaaacagttagaaaataaaatttttaaatgatatcatttacaatactgtcaaaagaaaacccaccaaatgcccaagaagaaaactaacgaaagatgtgaagacctccacaaagaaatctattaaatattatttggtaaattaaagaataaattgacgatataacgtattcatgggttagaaaacacaatattataaagatgtgatttcaccaccacactgatctgttgactcaatgaagtacaatagatatctctttttttcttttgggaaacaagatgattctaaactctgtatgtaaaatttaaagggtcaagaatggctaagaaaatcttgaagaagaatgaagtcaaaggcttcctccaacatatcaagacttataacagagctataatatctctaaaacagtatgacattggcacaaatagaccaatggaagagaaatcaatgtccaaaacagatctacaatatagatacttcttgaataaatgttatatatgctaagtttttaaaattcctttgaaatatctcaattatcttttacaagataaggttttactaacattgctattgataattttatttttcactgtttttgggttttcataaaggaataagtcaaagtttcaaattattgataaatcaagttcttattttcaaaaaggcatttaatttcgttttacttaatgctatatcccaaagttcaatatatcaccttttttcttaatgaagattttcaccacaataggattagtctccaacaaggaagaactaaagacaattcatctaactcttaactctcctttatgatacctaagttttataagttttacttatgcaaatattctcaagcacattccaattagcttgttaaggtcaccaatcacctactttgcaaaatccagtaatcaattctaaatcttcaagtgctttgaattcttgataccatttagccaactaatcagtcctaccttcttgtaaatctttcctcaagtggtttttgggcaaacattcctcagtcttcttagaatgtccttgacctctacctttcaatcttcctagttgatttctcctcatctccccaactgccaagtattggcatgccccatagttcagtctttggatttttattttttctgtctctctatctagtctattccccagacaatctcattcagccttatatctttaaaaatcattggtattctgattcctaaattcttatctcaagcctaaacccctctactgatgttccagttcacttactctattgcctacttctctccctttggatttctaacaggcacctcaaactcaaaatgcctaaaacctagttgttaatattccctcctgaacttgtatttcccacagacttcctcatcttagtaaacgagaactccatccttccactggctcaggaaaaaaaaaaaaaaaaaaagaataatctgacaactctcttactctcagccctcacctacaacttacctgtcagcttgaccatcaaaataaacgcaatacctggacacctctcgctttcttcatagttaccaccctgattcagcacctcaccacttcttaacacaattattgcagtatactgcagtacctcctaattgattttcttgcttttgcttgttcccctagtttttttcccacataatctgagtgatctctttaaaatgtggactgattatgtcattactatgctccatatctgacagtagcttccactgttagagtttagccagattcagtactgtgacttaaaatgtcctaaatgtagaggtggattcaccatgaacctaaaaaaagcttaaacttttggtctctaaaaattatgtattcataattttctattaaagagcactgcaactgtttaatcttcaggattccacaacctggagccacccataactacatgatctggcctcccactaccattatttctactaatttcttgctgatttcctacaaccctctttcctccctcactgcacttgtacaggatagtcctgcaacagtgaggaaggtattcagtaaatattttatgaataaatgaacaaataaaaaaaaacccatgctggggcaaggttgacacctcatcttgcagagttcttatgtggaacaagaacaggagtctcctcttagcaatcaacttttttcttcacttattcaatgtccaactccactctcatattctaacgtggagcatgaaaaacttgtatgcatcttaccactgcactcttctggctttccttctcatttcttctcccggcacacctaccccatggtaagaaacttttcatttattcactctatgctatattttctcttttcagctgaatgctacacattgattccttcagagttagtactcaatatacaaaagagagagataacgaattcagaaatttatcttatttgctgttgtacaatcagattttgaaagttacaaccttaatatcaccttggtctttctacctgcagcctctccacctcccaaataaaaaatctgaagagtggtcatcaaataatcccaatttgctagaatatacacaaaattattaaatgccatggcaaaaaagaaatgatttaacaaaaaactgggcagttttgcactatttctagttcttgttcttttaccacagcctgtattatatttgctaatacctcagttaaaatttttttaaatgtgaaaaaataaattaggcacaaaaaaggcttcttttggaggatgtaggtgaagagagaggtaaaagagagagaatggcttcaggcttaactgtactgaatctaagatatcactggtacatccaagaaaacatgcacatcaggcagtttatagacctgagttttaatctaaaaacaagcgcttaagttaaagttttaacatcatgtatcatttaaatttgtagttaaaattaagaaagtagaaaaaaatacataatctaaattaaaacatagtctaaaatggtggtccaggaagagcactttaaaaaatgcttaacttaggagatgggaaaccagtaacaaccaagaagggaagtgggaggaaagaaagaaagaaaagaagcaaagttaaaagcaaagtgtgccagttaagccaaagacataagaaaattcagttaggataagctgatggatagtgtgacatgttcctcaaaactgtaacagtaagaccaagaaagattaatgcttttagcaagtagaaggtcataagtgatctttgaaagagtagttccagtaaacatgttggaaaggagaatatctctatagtcatctctacatagatttagaagcttaagctgactctttaaaacaccattaacaagttatagtacacaataatgggcatggtcgtggccatatttataatcctctgtccctacattaattaatggcaccttcttctctgctcacacatttataaaatgttataaatagtaggggcttcagaaatcaagtaagagattgcaaatgaaattcagctctcatgtttctttttgtttttttccactttaaaaaaagaatctagattttcatcttcttcgtaaagtacaaaagatctggtaatactggtctcacattcccaaagcatcttttgcaagaagcatgtatattccagtggccaatggacagctcagttccttcatgatacctcaccttactcctttctggtaaatgcctgatccctttagctgtaaggttaaaaagttaataagttaaaaactcgtaagcttgccaattagttgaataggaaactgattaaattcattagctattcattatctacttttggtaagacctagagaagtttaggtctcaaagccagttagcagcgcagccagaactcgcttactgagcaaactctggcctctgctgaaactaaaaaccctggacttcctccagaccaatgctgattaaattattacatttaaaggaatgggaaataatctgtacataattttatttaaaaggcagttctcatgtattcgcaaaaatattttccaaatagattactcacaaaaaaaatataaacgtctcttcaaagttgagaaaaatgttttcaggaaattctcttcaatttacttctttatgtgcacttttccttgtttgacacttaaatcctttgttgataagatggcttttttctttaattcagtctccccaccttcggcctcttatcattcaaagccaaaattacatatttttttagaagctgccacagcaactaatacaaatattttttaaagcaaattatataatatctgttttaaaacatttttgataatatctctgctttaaatttttttttgtttccccaatgcctatggggtaagcaacaaaatccttaaagttctttcataactggtctctgtgcgccttgcctgcctccccagactacacacacacccgcaccttactctcctgatatagtaaatgggttactcttttccacacacatcaggacttagaagatacaaatgtcacattccctcttggctggagagccctgttctaaccaatctttatacgttctgtaacattaggtactcaaagactataagaataaataaatttagaaaatttctaggaaaaacagagaaatttaaagctggctgacatcatcttaatacccagctgtattagttcgttctcacgctgctatgaagaaatacctgaggctgggtaatttataaaggaaagaggtttaattgactcagtgcaccatggctggggaggcctcaggaaacttacaatcatggcagaaggtgaagtgaggaagcaaggcacgttaatcacaaggcggcaggaaggagaagtgcaaacaggaaatgccagacacttagaaaaccatcagttctcatgagacccactcattatcatgagaacagcataagggaagccacttccatgatccaattacccccacctggtcccacccttgacacatagggattatggggattacagtccaaggtgagatttgggtggggacacagagccaaagcatgtcaccatctaaagacatttcattttcacttccatccagtcatctgtttattgctctacaaatcctttgcatcctaacccatgacactgagatgagagggacagagtgggtgacagaggaagtggagcgaaactaatgaggtctcctgaggaacacagactggttgtgatctgcccttagagacaagccatagcagaactacacttcacagaattcagaggctttgtttcattcctgtgaatctttttagggtccttcctcacttgggtttctttattttgtatagttttgtttgatggtggtgtttgtgggggtttttgttggtgtttgttcatctcatgggtttttaattgcttgctttaccatttccacaggattttatttagaatatatctgatatctatttgagagcctgacatccacagtggctaggtttaccaaacgtaagttggatgaccttgaggcacacagtgaactttgaccttggaaacaatttaattcaaggctgaaaccaccatgaattgtaatattttagggtcataatgaattaaaactatcaacagaaatactgtatcagaaaaagatatcacttttccttttccatttaatcacttcatcttatgtgctaaatctgtaggcccacctatttaaaggattctctggggaacctcctgaaggttcatccattagaatatataagacctttggtccccaaaatgtgcaagggggagagactgcctccaggaaatacacccccaccaggaaacctgggaatccaggtcacagggcaaggccttaaccatatccagagctggaactgatttaaggaaaggaatataaaagtaggagagggagtggtaagagtcttgcatgcattcccagtctccgtgcagaacggcggaagccattccttattttgtctcacaggggacctcatggaagttctgccaattaactcaggtagtggtcataagttgaaaaaagctcccaaatgaattttgtgatataacctcaagtggggaagaactcccttggccagaaccaggtgggggtggggggcaagtggaaagagtgcaggagttgggtaccccagctgtgcaggcaacctgggagggatgtggcttgaaagctgctgttgggttctgagcttagatggcctaaaatttagcttgctgctgctagcagaaaaattgtgactttgagatctaccttgccaagtgcacaggagctgggtggggcttactgctgcctgttactccctactccctgggtgaatacttctgtgcagtagaggaagctatgctctcctctagaacatgagaccatctccccagtgaccagagacctaccccttgacccccagaggggttgttccttgccgcacactcagagagtcagagcaaggacttgcctgacccagcccccagctggctttgtccatgccccagcacccccctcccccaaccaccctggtagcttaacacaaaggacagacactttgggggagctttatggccccatacatcacccaagaaaccagagtacctcccctgggtaacataaggcaagcacaaatcccaccactgctactgtagctggtgctcttcttcaagcaccacctcctggctagaggccaattgacacagtccattacggcatctccaagtaaacattgtgcccaggaaggagttaacttacacatgactgcagcaatcacaatattctgcattaccttggctaatcaggaggtcctgagcctgtccaaacttgttcaaacactgagcacattgctacaaccagcatctgagaaagctatcgctctctataatcaaggaactcatacagtcttcacccctgaaagcaacgagagcctaattacactacagtaaactgtaaacattaaagtcacacccttaagatggaaaaaaagaaattaaaaaacacaaatcaaaaataaattcaagaataattagaagaaatattctacccaaatgagaaggaaccagaaaaataattctggtaatatgacaaaacaaggctctataaaacatgcaaaagaacacactaacggtccagcaatggatccagatcaagatgaaatctttgaaatgccagataaagaattcaaaatgttaactatttagttactcaagaagaagaaaggtgaaaagtaaaaactaacataaagaaatttaaaaaacaattcagagcatgaatggaaaaaattttaaagagatagatatcaaagaaaaatcaatcagaacttctagaaatgaaagatatacttagggaaatacaaaatgcagtggaaactttcaacagcagactagaacaattacaatgaagcatttcagagctcagagacaaggctttcaaattaatctaatcagacaaaaatgaagcaaaaaataattaagagaaatgaacacagcttctaagattatgtaaaacaatccaagtctgggattaggtaaaatagccaaacctaagaataaatggtgtttatgagtgggaagagaaagcaaaaacttttgaaattttgtttaagaaaataattgaggaaaacttcccaggccttactagagatttagatgtcaaaatacaagaagctcaaagcactcctgggagacttattgcaaaaaggtcatcatcagtgcatatagtcatcaggctgtctaaagtaaacataaaagaaagaattctaagagctatgagacaaaagcatctgggaacctataaaggaaatcctatcagactaacagtagacttctcagcagaaaccttgcaagcaagaagggattttgggttttagctttagcctccttagacaggacaactgtcagttaacaattttgtatccaacaataaatttcataaatgaagaggaaataaaatcattttcagacaaacaaatgctgaaggaatttgttactaccagaccatccctataagaaatgctgaaaggagttctaaatcttgaaacaaaagcttaatatgcaccaaaatagaatctcttgaaagcataatacagggcctatgaaacaattacacaacgaaaaaagtatctaggtaacaattaacatgatgaatggaacagtatctcacatctcaatattatgactgaaagtaaatggcctacattctccacttaaaagatacagatgggcagaatggatttttaaaaatcacaaaccaaatatctactgtcttcaagagactcacctaacacaaggattcatataaactcaaggtaaagaggtggaaaaatacattgaatgcaaatggaaaccaaaagtgagcagtagtcagtcttatatcagataaaacagactttaaagcagcaacagtataaaaagaaaaaaagtcaaagaaggtaattatataatgataaaaggatcaatctaacaagaagaaattacaaccgtaaattaaatgcacctaacactggagctcccagactcataaaacaattactactagacctgagaaatgagatagacagcaacgtaataataatgggggaattcaatactccactgacagcactagacaaatcatcaagacagcaaggcaacatagaaacactaggcttaacgtacactctagaacaaaggaacgtaagatatatgtacagaatattctaccccaaaactgcagaatacacattcttctcatcagcacatggaacattttctaagatagaccatatggtaggccacaaaacaaatctcaatacatttttaaaaataggaatgatatcggccaggcgcgcagtggctcacgcctgtaatccagcactacgggaggccgaggtgggtggatcacgaggtcaggagatggagaccatcctggctaacacagtgaaaccccgtctgtactaaaaatacaaaaagaaattagccaggcgtggtggcgggcacctgtaatcccagctactcgggaggctgaggcaggagaatggtgtgaacccggaaggcggagcttgtggtgagccgagatcgtgccactgcactccagcctgagtgacagagcaatactccgtctcaaaaaaaaaataggaatcatatcaaatatcttctcagaccacagtgaagtaaaacaagaaatcaactccaaaaggaacccctaaactacacaaatacatggaaattaaacaatctgctcctgaatgatttttaggttaacaatgaaatcaagatggaaattcataaactatttaaaatgaatgataatagtgacacaagttatcaaaatctttgggacagggcaaaagtagtgctaagaggaatgtttattgcactaaatttgtacatcaaaaagtctgagagatcacaagttaacaatctaatatacacctcaaggaactagagaaataagaacaaactaaatccaaagctagtagaagaaaataaataacaaagttcagagcaaaaccgaatgaaattgaaaccacaaaaacaatacaaaaaaaaatcaatgaaacaaaaacctggttctttgaaaagataaacaaaattaatagaccattagtgagattatccaagaaaagaagagagaagaatcaaataagctcaattagaaatgaaactaaggacattacaactgatgccacagaaatacaaagatcattcaatattactatgaatacctgtatgcacacaaactagaaagcccagagaaaacagataaattcctggaaccatacaaccatcgtagagtaaatcaggaagaaatagaaaccctacacagaccaataacatgcagtaaaactgaatcagtaattttaacaattgcaaacaacgacaagcccagggccagatagattcacagttgaattctaccacacgtctattcacagaagaattggtaccaatcctaataaaacaatttcaaaaattgagaaacagggaatcctccataaatatcctatgaagtcagcatcactctgataccaaaaccaggaaatgacataacaaaaaaagaaaacacagaccaatatccctgataaaaatgaaacaaaaatcctcaacaaagtactggctaaccaaatccaaaaagacatcaaaaagataatacaccataatcaagagtgtttcatccaaggatccagggatggtttaacatacacaagtcaataaaggtaatatatcacataaacagaattagaaacaaaaaccatatgatctcaacagatgtagaaaaagcacttgaaaaaaatccagcatctctttatgctaaaatccctcaacaaactaggcatagaaggaacatacctcaaaataataaaagccatatttaacacacttacagcaaacatcacactgaatggggaaaagttgaaagcattccccctgagaactggaacaaggcaaggaggcccacttttaccacttctactcaatataatactggaaatcctaggcagaacaatcaggcaagagaaagaaataaagggcatccaaattggaaaagaggaagtccaactatctctgtttaccaatgatatgattgtatacctagaaaagactaaacagtactccaaaagactcctagatttaataaacaaattcagtaaagtctcaggttataaaatcaacataaacaaaccagtagcactgctatacaccaaaaacaatcaagctgagagccaaatcaagaactcaatcccttttacaatagctgcaaaaaataaaataaaatacttagaaatacacttaaccaaggaggtgaaagatctcaacaagaactacaaaacactgctgaaagaaagcataaatgaataacaaacaaacagaaatacatcccatgctcatggattggaaaatatcctgaaaaatgaccacattgccaaaaattcattttcaaagaattaggaaaaaaatcctaaaattcatatggaactaaaaaggagaccaacagccaaggcaatcctaagcaaaaaaaaaaaaaaaaaaaaaaaaaacacaaatccggaagcaatatatacccaacttccaattatactacaaggctatagtaaccaaaacagtatggtactggcataaaagtaggcacatagaccaatggaacagaatagagaacctacaaataaagccaaatacttacaactaactgatctttgacaaagcatactacataaattggaaaacgggtgccctgtttaataaatagtgggagagttagatagtcacctgtagaagaatgaaaatggatccctatctctccccttgtacaaaaatcaactcaagatggattaaagtcttaaatctaagacctgaaaccataaaaatcctagaagaaaccctagggaaaactcttctggacattggcctaggcaaagaatttatgactaagacccaaaaagcaaacacgacaaaaacaaaaataaatggaacttgaataatccaaaagcttctgcacagcaaaagaaataatcatcagagtaaacagacagcccagagaattggagaatatatttgcaaactatgcatctgacaaaagactggtatccaaaatctacaagaaactaaaataaatcagcaagaaaaaaagcaaataattccattaaaaagtgggcaaagtccatgaatagacagttctcaaaagaagatatacaaatggccaaacatatgaaaaagtgctcaacatcactaatcatcaggaaaatgcaaattaaaaccacattgggatactaccttgctcctgtaagaatggccattattaaaaagtcaaaaaacaatagatattggcatggatgtagtgaaaggggaatgctgatacacttctgatgggaatataaattagtacaacctccatggaaacctgtatggagattccttaaagaactaaaagtagatccaccgattgatccagctaatatgatgactgggcatctacccaatggaaaagaaatcattatatgaaagagacacatgcacacatatgtttattgcagtcaaattcacagttgcaaagatatgaaaccaacctacgtgcctgctaaccaacaagtggataaagaaaatgtggtacatatacaccatggaatactactcagccacaaaaaggcatgaaataatgtcctttgcagcaagttggatggagctgggggccatcattctaagggaagtaatttcaggaatgaaaaaccaaataccatacgttctcacttataagtgggagctacgctatgagtatgcaaaggcataccgagtgatataatggactttggagactcagaagcgggagggtaggaggggggtgcggaataaaaatctacatatgaggtgcaaggtacactacttgggtgacaagtgcactaaaatatcagaattcaccactatataattcatctatgtaaccaaaaaccactagtactccaaaagctattaaaacttttaagaagaatatataaaaccttcaagtatttctaaacaacatgtgaactgagggaggaaaaaaataccttagataattttaattgcatttgcaatgctccacttttactaaaatatgagtatttgttagctaatttttaggtcattaattaattgcctttattagtgattaaaaatgtgtatgctgattgtacctaaaattggaggcaatttaagacttgaaaaggatactaccttttacattttgttagataaatattgtagaaaaaatgtattttatgattaaaagaaaatgaaattacgtagctttctatttgctttttatttgtagctttctagtaaatctttagtataaaactgtttaacaaaaaaaaagcctagctttccttgaattatattcttgcttgtgaatgcaaaaccttccaaattatttgaaacatttatgtattcagaatattactttgtggttttcttcttaagaagctaaacaattcattaaacaagctgctcttgaatagtagatcagaacaagcataagctgccttctgtagaattctattgtggaactgtacccatttgtgttttctttgaagccataaaaatgaaacccttatgctcatattaaaagcataagaaaggcatctattatgtcaatagatttaaaacacggccttagacacagtgagaaccactctaaaggttaagaagttcattcccaaggaaaaccatcaaaggcctacatatcattatatctcaaaacagatggcatcacagtgtttggaactatagtttacggacacctacgatctcaaataaatccttgctaatcccacccttttgtctagattttgtactttgatggtaactgcaggtgccttttctccatcatatcgttgcatgtcattctatgaatcatgaagatacatgtaccttatatggacacaactcttaataaatacaacttttatacaatatgtaagtattttaccagccacagatatactctttgtagaaatctatgcttcttagattctaatctattataaatcttcagtagtctaaattttatagaaaaaaatgatgaaaatatacctctctcatagattggtgaaactataatattgatttaaaaatcactttgtaaaacaatgtggaattatctagtatctaggtatatatcctggagaaactctcaaaaacaggagatggggacaagaatatttacagcagcattgcctctaacaccaaaaaactgcaaacagcccaaaagatcaacaggaaaattgatatatgaactgtgttaccctcaaacaatgaaatgttgtacaacaatgaaaataaatgaactgttcctacatgcaccaaaatagatgaaccccagaaacaatactaagcaaaaaagataaatcacagaaaactatataaaatatgtttccaatttatataaagttaaaaccatgcaaaattgagcaatgtgtttttactgttacttaggttcaggaatttttttttcatctaaaatcctgctgaaaaaaattaaataatactaatgtgactaacagattaaagtaaaatttttctatgattatttgctaccaatctcatatactgaaaaacttttgggattcaaatttagcttattacaaaaaaagttatctacagacagaaaaatctctcatgcatccatacaggtgaaaagattgtttaaaagatcatgtccttcaatatttaagaaatatcatatgaccttatttatatgtggaatctaaaagagttgaactcatagatgtaaagagtggaatggtggttaccagaggctacagttgcaggcgggaaggaaagatgttgttcaaagggcataaaatttcagttacatacaaggaataggctactgtactgtacatggtgactatagttaataacaatgcagtgtattcttgaaaactgctaagagtagattttaagtgttctcaccacaaaaaaaagaaaaataagtacatgagctaatgcatttgttaattagtttgattaagccattccacaatgtatgcatacttcaaagcaacatgtcatacatgctaaacatacacaatttttatttctgaatttaaaaaattaattaaaaataaataaaatattgaagggaaatatataaattataacctataaaaaaagatttaaatagtatcactatttagctgaaaagagttctatttcacagtttacctgacacactgcaatacttcagagtctgcagaaaagagttatttaagtcttgtctgtatataagatgtggcttgttgtgaccatcttcatattcattcccatctgccttcattataggttctaagaaatattcaccgttctgtcctttaaatgttcccgtctgaaaataaaggaaacaaaaatgaatttttcctaacagtcgccaagaagaaaaaacacatagtaccacaggttaaatgagcagacagaagcaaaacagcaaggagtctgttcactaagagccatcaactgagcataaaaagtttcccttccctgggtcacttttctctctccactcctatacataaagtcatgaagactggatagtgttccaacaggccaagctaagtgacgggcattccaggtgcaaagaacagcatagataaaagcatcaaaatggaaaaagtgtttagaatagtctataaataataaagcctgtgcttttgatctgtgggaaaatagatactttttttttttaatgtttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggtgtatatgtgccacattttcttaatccagtctatcattgttggacatttgggttggctccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggacacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaactcaagatgggttaaaggtttaaacgttagacctaaaaccatagaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgagcagacacttctcaaaagaaaatagatactttaatacattagtgttgaaaatatgtcagtacaatcagtatgcaaagcaatttggcaatatttaacacattaacaatgtatttgccctttaacacagcaattccccttctgagaatttatcctatatataccatacatttgcatgtgtgaaataatatacttacaaggttattaaccataacattgtttttaatagcaaaatattggaactacttcaaaagtccattgatagagtctgtttacataaactttagcacaactatgtgatggcatcccttgaggttataaacaaacaaacaaaaagagaaaacattctgtgtagtgatatagaaagaactccaatgcatatcattacaccaaaacaaaaaaaactactaaacagaatgtatacttcactactattgcataataaaggaagaaaccctaaaactaaatatttctatttgcctggttactactgaaaaaactctagaaggattattaggaacagtgccgatagaagtgggtgaaactgggtgcatgtaggatggactaggtatggcatcgtgcttccaacatgctgtccctctacctaaaatgtttccctgcttcccacccttcacctctacctctgcatcatcacactcagtctggctggcttcatctcatccttcaagtctcagctcaaataacaaccacccagaaagtttttccttgaccagttttctaggtaactacatacccatccctactcctaaaaacacattacatctgcttgatttctttagcacatttatcatatgttgcatttatatgtttgtttgctatttaaaactattcttccccactagacagaagtcttcaaataagcagtgacctatccctgaatttctactgctgaagagactatctgagatctaggcacatgtggtaagcagtaggtatttgttaaaccgtgaaagctattatttcctacctttgcaagctcagtttatgttaagcaaaagtagggcataaatttgaaaacttaggctagacctagaatataaagactcttgcttgcagggatttttgtcagaggagtccataaacttgggtgagaaaaaaaattacatccttattatcattaacctaattataattaacctataaactccttcatgaaagaaatgctaaatttgaaagtaggctacaaattccagtaaggttgtcaacagaaagcacagatatgttcatcacatgatgatgtttgaaatatctaaaaatattgtttatgcttatcaacacttcaaaattaaggtagctattagtctgccattagatcatattatttaaggtgctaataaaagatacataactttttttaatatcttgataactatatttcaatataaatgctttattttgtatttttattaatattttaggtgcattgagattctaagaagggttcatttaatcattaaagaattcaaataaaagtgggagtggagagcagagtcaaagcaataactttgaaagactgaacaattgtacaactaaagaaagactagtgaagggaaatgtttagccatcaaggtatgaaacaacaaggacttgcactctgttggaaagaagcccttaaatggtcaatttatgtagatagatccctctctcgagtcaggtgaggctaagtcatccaagggaggcatttataatattaatagctaataccaatatagagatcagacattattcatttatatatattcattcctatacatattttatataaatatataattcttttccacctaataataattatttaaagtaaattatatcattatccccactttacaggtgagacaaatgaggaaaagagaggttaagtcacttgtccaaggctcatacctagtaagtggcggtatcaagatatgaacccaaatactttggcttcacaattcatgccttaattcattacactgtgttcattatcacataccaattttgataaactctatgaactagtcaataaatatttaatgggcacctactatgtgccaagaaccgttctaggggctaacgatacagagataaatgtgacaaaatccctgccttcaaagaatttatactcctatggaaaaaggcaaccaataaataaaaatataatagaatatgcaataagtgcaataaaaaataaaataaggagagagagaataaaagagggtgagagtggggaggcactctggaggggacagcaaagctgaggctagagtaatcaggaggtagccgtggaaaattctgggaggacattccacatagaagggaatattccaaacggtgactgaaaggcctagagatgaaaaagtcttggcaggtaaagtgacagagagaacagtgaggctgcagctgtgccagctaggagatacagagtagcagatgacatcagacaggcagaagcctggttgcactaattacgcttcacagaaaaaagcactcctcacacctcagaatcacacaaatatatttacctacatttaaaactttgcacttttccacatggaaaggcatgtttctgtgaagacccaattcagaaacaaattactgaattgcaggtagtatgataaacatagttttagtgaatgagacttcatttccatttcttaatcacaaatatcttaatatagagatactttgaaatcattgttttaaattccactgcaaataaaaagcatattttattttatttttcattcatttatttattatttatgtatgtatttatttattgttaccaaggccggagtgcagtggcatgatctcagctcactgcaacctccacctcccaggctcaagcaatccccccacctcagcctcccataactggcggaattttgaaggttttttttttgtatttttggtagagatggggtttcactatgttgcccaggctggtcccgaactcctgagttcaagtggtccacccacctcagcctcccaaagtgctgggattacaggcatgagccaccacacccggcccttacttttatttttaatgtttgtgggtacatagtaggtgtatatatttatggagtacatgagatatggtgatacaggcatacaatgtgaaataagcacatcatggggaatgggatatccacctcctgaagcatttatcttttgataaatgctttttgagttacaaaaaatccaattacattctttaagttattttaaaatatacaattaaattattattgactatagtcacctgttgtactagcaaataggtcttactcattctaattttttatactcattaaccatccccacctctccccaccccacacaccctctctctatccttcccagcctctgaaccatcccttctactctctatgtccatgagttcaactgttttgggttttagatcctacaaataacatgcagtgtacatctttatgtgcctggcttatttcatttaacataatgatctctaattccatccccattgttagaaatgactagatctcattcttttttatggctgaatagtactccattgagtatatgtaccacattctctttatctattcatctgttgatggacacttaggttgcttccaaatcttggctattgtgaacactgctgcaacaaacagtgggagtacagatatctcttcaatatcctgatttcctttcatttgggtgtatacccagcagtgggattgctggatcatatggtagctctacttttagttttctgaggaccctccaaactcttctccataatggttgcactaatttacattcccaccacaatgtacaagtgttccctttttgacacattctgaccagcatttgttattgcctgttttttggatataagccattttcactggggtgagatgatatctcactgtagttttgacttgcatttctctgatgatcaatgatgttgagcatcttttcacatgcctgtttgccatttgtgtgtcttcttttaagaaagtctattcaaatcttttgcccattttttgatcaaattattcaatgtttttcctataaagttgtttgaactccttatatattctggttattaatcctttcccaaatgggtagttgcaaatattttctcccactctgtgggttgtctcttcactttgttgattgtatcctttgctgtgcagaagctttttaacttgatgtgatctcatttgtccatttttgctttggttgcctgtgcttgtggggtattgctcaaaaaatttttgcccagcccaatgtcctgaacattttccctagtgttttcttgtagtagtttaatagtttgaagtaacatatattttaaatcactattttaaccgaacatttaaagccatttaaatgatcatggcaattgtagccataaagttctctttccactgatatttattattacattgaaatctccttaaaggtaagaacatatttactattttcagagttccaacatctaaaacattgcctgaaacacagcaggcactctgtagacagctgcagaaatgaacatttttgtaacaaacctggtgaagtacctggttttttctcatcctatatccttgggtaaataattctttaatttttttatgaacattctttttttttttttttttgagatggagtctcactctatcacacagactggagtgcagtggcgtgatcttagctcactgcaacctccaccacccgggttcaagcaattctcctgcctcagcctcccaagtagctgggattacaggcacctgccaccgcgcccaggtaatttttgtatttttagtagagatggggtttcaccatcttggccaggctggtcttgaactcctgacctcgtgatccacccgccttggcctcccaaagtgctgggattacaggtgtgagccaccacgcccaggctttaatgaacattcttaagttatggtactcttgagacatgtctaggatatagttatatgacggttttctttcaatgctgaaaagtaaaatgtttagacacccttatatagtgtgctaatgtgttaggattacacgtttttaaatagttcaaaaattaatgaaattccatcagactactgactataaagcactgaaattatagtctataaaataaaaggcaaagctataaatataagaattcttatctatttcttggatacttttctagggctgataccctaccatatttcactaattctaccagtgtctattttctaaagataactacaaatcacttactttcaacaaacaccaatactctagcattctctgccttcctagaaaactaattttacccatacttataagaagtaaaaaagacattgttttgcaacctgagtacatggatccatggaaaatccttttctgccttttttaaaaagcatgctgaagaggggaaatgtgatactatcttgacaaaatatactaatagacataaggcagcttgtttactcaactaactgtacctacaaagctactttaaatagcatcacactatcttcaagcaaaattaaaagtacttatattaaccatagatttttttttttttttgagacagagtctcactctatcgccaggctggagtgcagtggcacgatctcagctcactgcaacctccacctcccgggttcaagtgattctcctgccttagcctcccaagtagctgggactacaggcgcttgccaccatgcccagctaattttttgtatttttagtagagacggggtttcaccatgttggccaggctagtctcgatctcctgatccgcctcagcctcccaaagtgctgggattacaggcgttagccaccatgcccggccaaccacagaattcttttaagctccttttggctcaaactctgactaggaggtactattttaatatgccaataaaactgcacatgggtccaatctgtgttcccatgtaagaagaaaatacagttctatccagaaaccatcggtacctccttttaagttgtgctagaacactccagcctttaaaaaatgttgtctttataacttaaatgaaagcttgtatgtttggaaacactaagttaaaaaataatggcaaatatttgtcctcaaactgaggataaatacttgtcctttttatttattaatggaagacttagaagtattttgcccccactgatttttctataacctatcccattgcagtggactttttgttcaaataattaaaatattagagctttgcctaaaggctcctaaggaagcactttaaatttttttttaacttggaaagaacccagcaaggaattagcagacttaaaaaaaaaacaggtggttcatagaattgtacttagatcatgccatatttttagcaacatgactatctgcagatgggccctgcaatttgattcatgataaatgccaatcaaattcctaacactttctttcaatgactattaaaaacagcaaaactagttttcacttgggtaggagtttcttgattacttgatgatcttctatttgccaagctgttttgaaaggcagttaagtgactataaaactggctccaatttattatcataggccaaaatttttatatgtttagaagattctataaaattgtttttccaaaatgttcttatttcagtatcatggcattcatccatatatttttttcaaaatacatagcaaatacatgtacttttgctacaaccaataaggtactctcagatttcattaaagggtgataacaagtacaaaatacaaaccctttgaactcttttcccaaatcatttatagttatcacattaaacactgtcaactggagaacattcggaaataaggtactgctgaagtgttgactaaaatacttagtttttccatcttcaatcataaatcatatcataagaatcagtatgatgatatataagaagaaagcctaggtatgagttctgggtttgtactcatagactcttatgtaaattactttatatctttgaccttcagttccattgtctgtaaaacaaaattgaaataattgtatctacccaatttcctaggaaggttaatgtgtgtttaagtgatattaataataggagcttcaataattgttttgaaattgaatgtattttgaagcaagatgaaaaattctccactaacaacacaaatgtgacagccactctttttaccactggcagagtataaatgttatataatcgaagaccacaaatatgaactctgagattaatttttatttggggataagtaaaaatgtaaaaagttttctctctctgacagtttctccttataacaccattaatcatgcctaggaaatagtgtattatacagaaacacacattgaataaatgaatgaatcaatgatataaagaaaacacaagaattaactccagatgcataaaacagaaaattcatagtaagggttttgttttgttttgttttttaaggttagttgttcttctcttctcttctctagcagcattatttaccttccccattctgagacaattccagatctctagtataaaaatgaaacaataaaagggaaataaatacgttgctggtaccttacctttttaaaagggactgctctcctgccaagtcctggcctattcaaatcaagaaaataaaacaaagactggactcatctacccaagattatgtatccaaaagacacaagttcaaatagtgtgccccagcagccttcataacatggagcaaattctgtaatatttctcattcttgtgggcactgaggtgttataaagtcatatgaactaattaaaaagaggaaagaattgtcaaagaaatggccacgttcttgtggggtctgcgtagtggtcctcagatggcctctcccaaactgtctccaaaatatccgtgaaaatatgaaatcaaaaatcataacaatgagaaatttaaaataataagaaatcattaaaaactattttgtaggtctataatggaaacatactcatgatatattgtcaaaatattctgaagcaatattactttaaaacaaacacaaaaatacatataatatctagagggacatatgccatacatatgccagaccacctgtaatatttgtagcatatattttcctagtttatttttaaaattttttacaattattttgacatggaactcttcaattatcatttgggccaatctattgtttttttttcatgtgttatttcttgtatttttccctatctaaaaattacaatatactgtcattttcttttactttagtacagttggaattttatttggtttaccagtaaagtgagaattcaaaatttagtttttccctataataagttcttggcattaaaagatttaaaataaatgccttttaggctttggcaactgtcacagaaaactaacttgaagcaattatcaaaacttgatctgttgtcagaagccaactaagttttagagggattatactgtcaaagaaaacactagcctggactgaaaaagcctttgatggagttcattgtaaaataacctacaggctttcagaattaccccagcattcttgaagctcccccaagacaacatcctcctgagaccccattttagatgtggccatggaggaagatggacaagaaagttccagaaggtagaaccaaggatctgggcaattgaagtccaaggatcccagccaaaaccaagggctgggcacttggctcatgcccgtaatcccaacactttgggaggctgaggcaggaatgctgcttgaggccaggagttcaagaccagtctggtcaacataggggaacaccatctctactgaaaattttaaaaaagaaaaaaaaactggtcaggtgtgggggggtgtgcctgtagttcccagccacttggaaggctgaatcagaagtatttgagcccaagagttcaaggctacagtgaattattatcatgccattgcactccatcctgggcaacagagcaaggtcttgtctcaaagaaaaaaaagaaagaaaagtaatcaaggagctcccctccttccacagtagtgagtctccacaattcctcttcaggagccaaaaactgctaaatatcagtgactactaggtgtctcctattcttctttctgtagcaagttggggttagggttgcagtcatgctggtcatgctgtatacttggctggtagctgaagataatttatctttttaattcatatttttccaagctacaaagagccacatcttgactttatggagaagactgcgttatccagagatcctggacattgagccagagtcagtgcccctgtgggaactttgagttttctccttatagacaagatgagtatgtttgatgcgtgatctgtttggtgaacagaagagcagcctgtaataaagactattggtgatcaccaatatgggtgttctttctttttcctaggaaaaatcaacgcccctcattttccagtcttttttacatctaggtagaaccaggcaactagttctcctcaatagaatatacataaaattggtttgcgtcacctttgggctgagaaagtcaagatccagtataccttctccatgctcttactatagttataaattatatagctcataaacatatttgtaattaataaacaatatttttccaatagaaaacacataactgtaccaccaaaacctaatagtggctgttaggtaataaatgactgataaatatttgctgaaaaaaaatgaacaatgtgtttcttcctttgcatattagtaagagttggacagcttaaatatatttcatagaaaacagtaattacaataattgcaacagaaataaagccacaaaaaacaaggatgtgatgtaagctcaaatgaatgaactaataaatagaacacaattaacttaggtatcatcggaagagatttagtaaatacagaatttcttaaatgtgcccaagcactttaactaaaattggtaaagtaattttcctgcatcgaatgactgaggtaaagatgagctagctaaatatttggcatatataaataaaagttagctgcttatcttactcataatgtgttgctcaacatgtgttgagcaattctatatattaggtgctaaaagaaatatgactatcatttctaccttctaattctataaatgaaatagaaatgcagacacctagctttaatttaatatgtaatgagagtacacgtgcataaaacgtcaactggtacaacaaggacgccctggtcaattttgccaagagaagatcaggggaaaaggaaggcagctcaaaatggatcaggaaggatagttaggaggttgagggaaaggacattctatacagagagaagagcaaatataaattcaagcaattatgaagattagagtaaatctgtgatagaatcaaacaagtgtctccagaataattacctttcttgccacttctgtcattgccttttttggttaacagccacaagatcattcagtcatttaaaccagagtcattaaaactttttggtctccttcaccaatgctccagaattctaaggggtctcctgcaaggctgctccacttcagcactacggacagcttgataattctttgtgtagggggctgtgctgtgcattgtgggatattgctggcctgtacccatgctctgccagtagcatgctcgcctcaatgcacctacagttgcaacaacaaaaattgtctccagacattgccaaatgtcttctgggggacaaaactgctcccagtaaggaagcactgatctgcagtagcatacggtccataggtacccactcttctccttccccactgcaacattactttaaatagcctctcttccttacccgcagtagggtaatagactacaacactggtcttctcagtgactcactgcctcccctgtaccctgcacaatggtgcataagaggagatgtgcctcctaatacattgaacaaacctaccacatactgttcaaattctcactcctttacaatgcatttcaggaccttaacaatctgattccttggtcttaaactctcactaccaaatctaccctgtttttcagctgcacagtccacgagaagtccttgaattttcatatccatttttattcattcctcaaagtccagttgagaagtcttgcccagcagaggtctcacaactctcttaatcactccttccttaattatgtcattcctcaaagtttacacagcactttttatgttgtctactttagcaagggcactttgaaatccatcacagtgtttgcaccctggccatagctcccaaggacttctccttgtcagtaactgagtatggtagggatatcatggcagacctgttctcgagagccatagactcttgttctggccaagtctggctcaaggacagctttgctcaaccttgcttggactgcccagcagcctaggatgctactacccaacattctcatcctttttttttcctatgtaagcctttttttcttacataagctcttacacagctctccaagctctctccttagtttctctaacacagacacttcccctaactaaaatcttatctttgcatctgtctcttgaaagacctggactaacacacactagaatgttaaaagaacagcataagaaattttccatactgctgtttgactagtattgcagcaagtacatgaatagccaaaagaggttcttattagttttctcaataagaaaaaatatgaatacagaatggcatgtgtaataatccaaggctatattagtcctgggaaaatagaaagtttggaaaataataaaactaaaattttgccagaatacacaaaaaacagtaaaaacactattgatagtttctatattcttatttcctgtctgaacaagaagttactagagcaactcaataatcagtcatcagagaggtaatgcttgacatgttgcagaatggttcatgtgagaaacttcaaaagtacacacagccatgacaagctctactccatgtataagtcagatgcaatgtctggtttcatgacatctggaaactgtttccttcaaccagaaagactgcattgcctcaaatcccaccaagaaatagagaagttaactgtctaggcagttgagttaatccccgaggaccttgggaagacttgaacaccctaggtaatatgagaaaagggctaccagaagcatgaggaattgtcagaaacagcctgtgtaaagtttgtcaattccatcctgacaagtatatgccaacttattaaatactgatctctaaatacgttggcaagagtatttaacaacattatgagatgataaataatatgaccataaaaaagaagtttagagttggatatagggatattaagtcctggtaactatacatgttatgagatagcctatcaatggattaaaaacatagagtttgattagccattacattacttatagataattttatgattcagttccatttttatactttttatagatcttggaaatgtataaataaatctctattcagaaatgtttgaattatgggatgaataaatacttacacttatggaaaataaaaattatagagaagaaaagattagaaaagcaagaattatatacatgttaaacaaagaaaatttctgccagactcttagactcttctggttcttgggctcaaaatacttaggaaaaaaactaaacaatactagttatggttcagagaaaaacataaataccaaaacttctaaaagtgggggaaatttaaccatatagaaattaaaagaaagtattagttcacatgtttggggttaattcaaaactaacaactaaacggaatcaataaatacattggggtgtcaactttaacaaatggttatacagagatattttgaaaatattaatttgatttgtttttcattctttttctctaaaagccacattcgctgccaccagcgaagggaatgagagagtctacctcagttgggaagatggaaaggcaaaaggtcaattaaatgagatgtgaaaatggaactcagtagatactggagggggagggggaaaggcaatggaggcaaagaaaacagatgctaagatgtatgtacattaacttctccactggggggttaaaatcccagaaacagaaggcatattgcattgttcaaagggactgcccaaagaggtgttccagggtgctgactatgtgggactcaaggaaggaaccctctgaaagggttccctacacacatcaaatttagaggtgtagaagagttcgacaaagagaggaactgaatccctcttgactctcaaatgccatagagggcttgaggcctttagaggggtctgcaagaagagcaatagcatcaccaaaccagtttacctggagaaggtgatgcagcaggactttgtatttgaaggctgcacaatgaatcactgagacaagaaatcaaatggatattatagccagaattcagagggatatacagcactagtgagagcccagaggaggatgagtcaagaccagtgagctctcattgaactaggagaaaaaaggccataagttctcaggcccagaaatcagctgctgttaacagaaaagtacaatgaaactatggcacaaagaacatcaccagaaacttgaggaactgaaggacggtacaatttcctcacccctctcccaaacaatacaaagacctcataacacgttataaccctgtatatagtcagtttctatcaatggtcaatgaattcttgaatccaccaatatatgaaacaacactcattagcagaaaaagaaatgaaattggatgctcatttcaatatactcaggaaaaacatttaataaactacaacatccattcatgattaaaagcaaaactaaagtaaagcaaaaagcgactagaaaaagaagagaacatctctaaattaataagactagctctgagaatccttcagcaaactgcaaccttaatgtttaatggactgagaggccaaagtcagatatcaagtacacaaggtgacaaagataaactaggaagcaagtaggagcagggccatcaggttagcattattgaattcccaagctttgtatcaacattgatctgcaaacaattcatctggtccaggtttcggatactacagtttacctagatacaaagactaaaggctgatctgagactaaaaaggggaatctggtataattacaaatggattctaaaatctaccaggttctattatttgatgaaactattaatccaaagaaatttaatcgtagagtcagtgtagaaataaatatatataatcataaataggtagctaatatccgttttagtgctaatataaaaaaagcaaaatttttaaaaagtcactaatctcatcagtaatttagacttacaattgattatgatcacactactgaaaaaaatgtagatcttgatacctctagttatttccaatgttactggaaaatttctgtctctacaatgattgaagtatgcaactaagccttatgcaaatacagagaaattatgtaaaataaagctaagttatggaggtatgaaaagaaacgtttaaatgttttatcaactacttctgataatatcaataaattatcaaaagcaaagtacataaatgggattatttacttgccattcaaagtatgactcctataggtgatttttcctcttcaaaaatttagtaaaagaacattcagaacaaatcattttatttgtttgtaatttctagtaatccctcaattaaattaaataattttgttctgaatgttttattataaaatttatataacataaatgattgatttcattttttattaatgagtacattgctaaagaagataaacattgctgattaacttacacataatatattgtataatacattatccacataaatgaggaaataataaatcttcacacgtaacattataaaaatattaatattaatttttagatatgttaataaaatgaactaggttataaaacaaaaaaagtatgatgatgacttgggcaactgtatccaaaatgacacagtgactagagagttatgactcaaaaatctttaactgctttctgaattcaaaaagaggatattgatcataaatatatatacctactatgtacccacaaaaattaaaaattttaaaaaaggatactgaataataatttaactacatcaacattatgaatcaaaatgagcagaaacagcattccctataatgccttcccatctggaatgcttttccatgagaaaacataatgaccatgacaaatttgtggtagcaagtctaggattttccagacaaactaaacattattttagaaaggttttagaaggagaattttttatcctttgaagtataggtggctatgtaaatattagagtgtgattctgccattgtgatgttgcaaatattttacatggaagaaagaaaggaaatggttctagccatttcatgtaaaaaacaactcaagataatcacttgaaaaagagctcacatccaggaagacatcttaaatcagttaagctaaaggagtattacatttgaactgcagagaaatgttatcaattttttatttaatcaaagaataaacagtgttgatgttctaaaaatatctttgaacaccttccagaagtatcttttgtaaaagtatgtatctgctaaacaaaagctagatacttaggaactgtagaatcctgtaaccaaattcctagttcttgttttttcttgaatatgtatttgtcagaggagttactgatggagtgagcctatatatgttttaaaacaactgtccttaccctggggttccatgaacttggatggaaaaaaggtacatctttattttcactaacctctgatactgagcatttccttcaagtatgaaggtaggtgaaaccacagacactgtggctttatcaccaataaaatgatacttttatatcacattatggttggtgtagctatgtgtcaactgattaccaccacaaaaatataacagacataaccaatagatctctgtaggtagactgttttcaagtatgatgcattttaaacagattcaacctcttccctactctacttcacaggccatccccataccatcaacaaaatgaacttttcctattctgaccttgccagtgggagccatttcattttatgtatattcattctcctttccttctatcaaattccagaaacaaacttatctaagtaaatccgggggattctgcctcaataggaccacgaaagggtacatctgagtcaaacagcctgccctccattcggaaaacacactccattgtaacagtggtcccacaggccactccctgatcaccactccagggatgatgaaagagcatctttcatcagcgttgcacagagggtcggttttgcccagcaggcagagacctgctcatcctgccaccagagccttccgaaggagttgcctctggcttggtgttaatccttcttgtagcccaacctgaactccagggtcatcagccaccaactcgaaaacccaaggccccgttcgctgaatgtagcccttgcctggatcccaagaaaatgccaagggacccgaggacactcaccaggcctccgcataagctgacgacggccttgtaatcctcctgtgagttgacctggccgcggtagaagcagtggcgcaggtccgagggccctgcgtcgctctcccaggccccgcgctccggggttcccaagtgcacctcggtgtagccggcggccagaaaggatgcatcggcggtcaggttcagctggaagagctgcccgtaggcagtgaagcgatagtgggttcggaacggcatgggttccagcgcctcggagctgcgtttctgccggctgaagtggtggctctgagggaacacttctccaaactcattgacccgctcggggatcactacttcgtaggaggtcagtgtcctcaccagggcttctgcaacaacagcgacaggaccagtgagctcccacgcgttcctcattgtccaactctaaacttcttccaccaaacgtccccgctaaaggtcccaggtcccagtacagccaggggcaagacaaatgcacacatgctgatgcgcacgcacacacacacacgtgcactgggacggttagtgctctgctttcccacacccccaacttgccctaccctccccaagcaaagaccctaccactaatggccctaagcaacccacttccttccccagtacctcctaacctccccgcagcccccaactcgttccctccgggtgcaagcgaccccctgccccttgcgcccccgccgtgtggtcctgggagtgcgatgcgtcttaggcgcgcgcgattcctcgaaacccggcgcagtcgcgacctctccggctgactggtccgggagtcccgggagctccagcagggccagcgttccccaacgggctgagccgctcgtccccgcgacctgcatgtcccactcgggccccgcgcccccacttagccgctgaaggcgtctcgcggtgactttaccttgcctggggtggaagtcaacttcccaagacctggtgatgaagagcgagagatggtagagcagcccagtcagccacttggccacccacat

SEQ ID NO: 761 - DNA, 984384 bp, Homo sapiens
ggacgctcctcccggagagtagtgagacccctggtgcggggcgattggcggcgggagcgatgagtggcagccgcacggcccaacgggagctgtgcgtgggccgcggggcggggccagggcgggtgcgcggcggcggcggggtggctgggccggcggcggcggcggtacgaggcgcgcgctcggggtcccggtcgcgaggaggaggaggatgtggcgcgcggaggggaaatggctgccgaaaacaagccggaaggtaagagccggagcgcgaggggctggggggcggcgcggcgggcggcgggacccggccccgccggacatcccgggcatcggcggcgccgggcgggagcgcgggggcgcggcgggcgggcgggcgggcgacccggccggggagggggccggcggggtgggggggcggagcgcggccgagtcctgaggtgactcgcggggccggcggagcgcggcgccccacaccccacccccgggggcgggctggggccggagggggcggggggctcgcggggcggggaccgggcccagcgaggaggaggagccggcggagggccggcgcctcccccacccggaccgggcatccccgccgctcccgagcccgctgcgcggcccccgcacccccggcgctgggtccacggtgggggccgcggggcggaaagtttatccgcctcgggtcctcctggccccgcgccccactgctccgggccggtccccgtcgggcggcagcggccggcgctcagccctcgccggccccctgctctccggcgggcagggccagatgtactctctccggcaccctcttcagccccgtggacacctccctgagcgggcggggggtccccgagcttctccccgccagggggaccccgtcctgccgagcgtccctcggccgaagggcctcgtgtgacccctcccccttcgcttcccgggaagggaagggggcctgcgcagcatccccgcccctcgcagtcgttcacatcctactcttgcccttgcaccctcacagccaggagggtggggtctccgtttctatggcaagtgaggatctccacactcccttgccctttaccttccgtgaccccgatccttccttggcacaggggtccgtctgatctgctcatcttctttggattcttttggggcctctgcacactctccgttgaccctttttgccaggacaaggggactcaggctgcccatgttcttctttcctcacccagtggatagtgggggcttgtgcagctctgaagtcatttctaaataggaaagcagacacttcttccagatcatgcatactcttacactttgctgggttagggcgagctcatttcctaaataccctttgagttgccctccttttcttatggagacaactggacgttcaccgtgctcctttcgccatttgtgtgtctacactgacttgttctctcttctcggagttccttgtctgggtgagagtgggcgccccaataagatgtagggcagggcttccattgtgcctagtgcttgagtgaaaaggggccacactagttgctcctgtgtctgaggaagaccggggtatatttttgcctccacttgactcttgtgtctcaggagggggcaaccttcatcagttgacactacctcactgggaaaagggtcatgtggccttgttttttgatgttttgattactgtcttctgtgcagtgagaaccagactttgtccgtcccacactcaagagtccttgaacctttcctggatataaacttcccgattgttttttgagagaactcatatcctcctctgtggcttctgcttcgcagtcagccatatttagtgagcctgttactttgactttttctaattttctcaaattgtattcatgttggctgggtaaggagaagccatatgcctttccattcagaaaagggagtgtagacacccgtgtcgcccacatgccatcctggaagaggttgcttgtgtgctccttgttgtactagaaccttcctttggctctggtgttgtctcttgtgggatccagacatttctttagatcttgtagctttcagaagggggaatttgaatgctttctgttttttgctgttccggttctgctttggagaaccagatcatgatgctatattcatttgtttacatatacatacatgtaggtatacacagatgaaatcacattcattacatatacagtgcacaggaagttggaagggtcagatgactagctctacattttgggtgcatatggggacctttatgtgtaatgatacagatagatattaacgttgttggtaactcttcaggcttagaagcagcagcagaagaatcacggataaatggccaattctgactattctttggtttgtaatgtgtactgtactgaataagcagaacgacatcctgcgtgttcaccaagtccctgaatgtgcgaagcgtacagtgcctgcccatacgcatcgcaactttggcggtctgaatttaggggtggtattcgttgcttgattctgcatagagtgaaaagttcttgatttctttactgcagtgtaggggaaagagatttcgtgtgtttggacaaacgacaggagatgggtgagaagaatatgttttcctgtgacagaactaggaacgaatgaccgtaaatatgtcccttttgtattttggccatttaaataattgagagaggttgtgaaattagcaaaatgtacctgtggaaaggccctcgacgcttcatgagaggatggggaacgttattcttcaagttcttttctcttggacaggggaatgatttgagccctgtcggctctagtcaggtgctttgcctcctcaggtctccctccctccctccctccctccctttctccctctttcacgaaattcagaatggctgctagccgctgtcactcagcagggaagtcttactctttgacaggcttagtgtggagactcatcctccccaacaagttccgttgggctctggggctttggcctttaaaactgttctagctcagaggctcgctttgcctcagtttactgtgtaaggagaagtggctcatcggagattgggtcagcgctagttctgtgacttctggactttgcctttcagttagcattgagtcgtccagtgggcctgattcccaatgtcagaaagtagagcttttgagctcattttcttgtttttggttttaaatgtttttatgctgttcgtattctgtgtctgtagtcagcttgatgggattgtgtatttttagggggtgttattagggaacttcggaaaaacgaagagtcgaatacctgctgtagatggtgtagactcagcggagtcatcccgtttccagtggtggttcttcctaccgtttcctccatggccccatggagactttgggagttttccctggtaagcagggggctccgtgcaaggcgcagtggaaggaaaagtggtaaagattggttggaagaagacacttgaggttattgtctgaagctgggccctttttcttgagtttgatgtggttgtgtttctgtgtcactggtcgccacagatgattggaaattagctttttccttttaccttgtagtgcagaatgctctgttgcagttgggcagactagacgggttctctgaaccacatagtttaatctttctgttcgactttctgttaggacatgactctttcctctccttcaccccttacctccagtttttgggactaggttgggtgacctcttcctcctttgtcttcttggaaaccttacttatcctgcttctgcaaatgttgggtttctccatctcatcattgagtggattcaaagtgttgacatacacagagcaacctctactcaaggtcagattgggtcagcttttccttttcaaaagagtagtgttgctcttacttgctctttgagacatatttatgcatcctgctcagctgtgttttctgtttccttagtttttaggctctggcgattttaggctttcccccagaaatagcctattctttagagagtagtgtttagtttagtctcctgtttatgctggatgtccgcccatgtgtcctgctcggtttttaattctttgtgactgattttgaggtagcccatctcaaaatcttaacgtttttttccccactgtttcattactttgagccattcttcctttcctgtttgggggaaatacccctttgtgtgcagttgtacttctttctcctttccttatggaaaaagcagtagaaggtgattctcttattttcttctgttcccctcatagttgtgtcagttgactcttttgtggaacctttgaatttgcccttctggggagaagtcgtttttgtatttatactcccatgactggagtcattcattcaggagacctttaccgagcttctgttatgtacaaggagctgtagggggtgatgtgactttgcttgagaccatattggatcttgttagccttttatattaatgacattttagtgtatcttttttttttttttttttttttttgagacagagtctcactctattgcccaggctggagtgcagtggcacgatctcggttcgtgcaacctctgccttccaggttcaagcaattctcttgcctcagcctcccaagtagctgggattacaggcgtgcaccaccatgtccggctaatttttttttgcatttttaatagagacggggtttcaccatgttggtcaggttggtcttgaattcctggcctaaagtgatccgcctacctcagcctcccttgcctcagcctcccaaagtgctgggattacaggcgcaagctgccacgcctggccttcggtgtggtgcttgtcttaatgcttgtcttttatatagtcttgcaaggaattttttttttctgatttttaagtttttggattgttaacttacaaagatatagtgtaatagtgtgctatcttgttgaaccttttttcctcctcagcaggagtgggggtggtgaagagggtgggagggtggactgggagaggcatttagcagctttcccccagactgtgtgcagagtgtgagagagagagagagagagtgtgtgtgtgtgtgtgtgtgtgtgtgtgtgtgtagacaaaagtaaagtcagccttcttaatctgattgtgtaggcataacttttaggttgtttagatacatgattggttggaatgcttatttaatatttgaacggcagcatcgcactaggcattctatagaacatagagtcaaatgtattttttatataaggaagtggtagaaaaatatttttttcttcggattaactggtatggttcatagtagatagtgagaactgtatgagctgctgttacattttcactgccatgaagaattatatccaaatttaatacctaattgatgctcattcttaggctaggcatctgatataattatcacttttattatatgacttttaatttatgctttttaatggtattattatttttgtaaattgcctcaaattctttgtgggtacaggttaggtataaataatgataataataaaaattactaacaatttgaaataccccttttcttttttcctctattaaattagatttaccatctccacaacgtatatagaaaccaattctgctactatttcactcttgtgaaaactcctgtgtgaggtttgtaatatgtggtttggcagtatgagtatgtgactgagtgtattttgtgttgacaagtgatgtgtgtgtttcttttgcatttccattatacagatcttttcctaaggtggtgtgtatcttctagaatcatgtaccctgtcctttttttttttttttttttaaatgttctaggtgacttaaatccgacctccctttcttttcttcggcctttccttttattttttgtcctttcccacatagagaggtttcttcactgacctgtcattattataaaaaagtgtttgttagatgtactgtatttgtagccttttagtaagaaggggatgcccaccatccctttgtcctgtagcacaaggcattgcttcttgtttccctaagaataggtagatggaatgagatttaagccagaaggccgctggtaatagtatttgtaactagatagcatctctagataaaacactgggtcctttctgctctgggcctccccatgtaggattttggaaatttttttttgctgcatttagccagcttctttctgtctctttggcttgatacaataaatttctttaagcacagccaagtatattatttcatttggagccttcatttacaaggaagtatgggggcctctcctaatgttcctttgcctgttatatatagtactgcctttagtttttggtgtgtttgagagtgagagtgagaagcattcttgctctgctactttgtctgtgtaacttgaataagagtgtacggtcattcactctattttccagatagtgtataatctttctttttatttttcttgaatacctaatcaggttcgagctagaggttgatccgactatcatatccttttattttgtgccatccctggatatagtgtcccttagtcctgtgattaagccatgttcctattttgtcattagagagagggacttacaaacatatagatggtctcccatgataattgtcatgcatttataaggaaagtgtttcttttctttttttttttttgaggctgagtcttgctttgttgcccaggcacgatctccgctccctgcaacctccgccttccaggttcaagcgattgtcctgcttcagcctccaaagtagctgggattacaggcgtgcaccaccatgcccggctaattttttttcgtatttttagtagagacggggtttcaccatgttggccaggttggtcttgaattcctggcctcaagtgatccgcccacctaggcctcccaaagtgctgagattacaggcatgagccaatgtgcctggccggaagtgtttccttgtataaattgacaatggagagcagttcacgtgatgggacaaagtaaagggtgagtaaagggtggttttgggtttttttttttttttgccatcagtatgctagctgtatatttctaaggttgtattgcatccttctgctttgaacaccattgcttgtagaaggtcatgggcctcctgtgtaaagattggtactgtttcctgagcatttttttttttacctcattaccctggacttacagagaaatattatgtaccccattgcaaagagaggccaagggtcagccacattatttccccttttgctctttttctggaggattgttcatttacttcgaactgattgacatggcataagatggaatgactagagatttttttttttaaaggttcctccatattcaacctcagtgtttggctctatcctgacatggttgcttgttctcctgtacatgaatccttttgcagttactttcttgtttttgtttttcaaatttagccagggctttcaagtcacgtaacatatcctttcctgagactgtgagccgaaggtaacttcaaggaagatatgcttgtttggggctgtattcatcactctgctctctacggttttgtagttttcatgtgtacaaagtgacatttcttgaaagaaacgtttggggctgtgttcttaatagttttaaacatgttattatgtggagactaagtggcaaaggtctcaccccaacttcatttcttcataccactcatatatatcttatatatatataccccactcttatatatatatataccccactcttatatatatcttatatatatctcccctacctgcaaatcccaaaacaatagtcatagcaacagaaaagcaaaaccttgtgaagcccagctctgattggttctgctgtgcagttcagtcgctagttttggacaggtgcataagcagataatttttggatgtgtaatattctcagtggggctgatgtgtgacttttgggacatagagcattcattcgttcagcagaccatgcagtatctcttccatttttttccccttatcagttaccacaaggtaagattatgtattcagtcacttaaaaacacttgcaaagtggatttttccccatttattcctatctaaccattggaataaatgttgacagtagtaaattaccatgtccctatttttgtgttcaacatgtctaagagaatggggagctaacttccagtaagggcagtacagtcagtcatgactctttctccatgtagcctgtgcattgtgcagtgatgatttatactttcagctaaatttagtgtctatgataagggatacatcagatgtttaagttcacttaatctcttttacagtgtgcattcaacaaggtgtatttgtgtcttatattagaatgaaatgcagatacaaccagaggtattctttcaacgtagagagagagagaaagcctttctttttacaagttttgaaaaaaagttattgtctatttttccttcatggtgcttgatttagattgccaggagtcatttctgaaggtatattaatacaatcaagaattaatgttcttaaaacttaaatttgttttttaatccttttctgaaaagtcatttctgaggatatatgtgccctgttggttttctgggcacttggatatcaaatcatttgggagtgataataagaaattggtacaaagtgtgaaattatcagatagaaagaaaaaagatgttatagtggaaaaaattactcatttatgattaaaaataatctcaaagtgatgactggaagtataaattcagatatttgaagaagaaatggaatgttgatagggttattgtattgaatcaacacatgcacacgtataaagaatgctccccaaaatggggacgcttagaggacaaataagttgattggattggttttaagaaaaatattgtttgtctttttaaaaagtaattgaaataacccttcttagtgaagaaaatgaaaactttgatggaagttcagcagaatggaatatttaaaaagattcaagagaaggatttttttattgcgaatccacaagggggtagtgatgttctttcaaagatatttgtggtggcaacaatgtgagatgatctcttcacattttagatttacagataaaactggcatgtttgcattttaacttaataagatcttctttttaaaatgtttattggcaaaattgtttattgcttaaattaaaaaaaatccattttgggtgaatggctactttaagccatatgaatggtaaagaagagagaatgtccttacagttttgtgctttggagaggtcaccaaggatgtgagggtcactgttattttctaagaatgtaataatcttaaattccctgggaaacattagacatctaggaatcagttacttaagtgtcctgaataaaaggattttagtaaattgtgtctaaactttacagaagtttgtattactagttgtattttcagtgctgccgagagatgaaaaatatgaacaatccatgccactagccacttttaatagttctaagtaaatcaaatttttataatcttttttattagtttatattacatcattagataaaggctttttttttgttttttttgtttttttgtttttttgttttttcttccctcacataaaaattcaggagctttcttctggtcactgagttccaccccatattattcagaattacttaaaatcaggtgtggtaggcctgtgctgggtcattttcagtggaggactgcctagctgtattatgcactcatttttgaaagttatgccgtgtggtgggagaaagatttaaagttggggggcggctgtgtcctacttatttagagacacaactagtcatcacctgtaacaaatgtgacttcttttaaaacttattttatcttacttttttttagagacagggtctcgctctgttgcccagactagagtgcagtagtgcaatccatagctcactgaagccttggcctcctgtgctgaaatgatcctcctgcctcagccccctgagtgactgggactacaggtgtgtgtcaccatggctgcttaggttttttttttctctttttcgtagaggtggggtcttgctgtattgcccaggctggtcttgaactcctggtctcaagcagtccgtctgcctcagcctcccgaagtgctgggatttacaagtgtgagctaccatgccctgcctaaaaaatattatttctaacaataacacaaaataattatgtggtttagaagttatgatagtttgtgccatatacattgtatatttttcatttttggtttgtggaaaaggttgttaattgagcttttctctttttttctccattccctcattctgagcaaggaatgactttttcttttatttcctttacgaaatgactttggtgttttaacattccagaagatacactgttttttatatgctactctaaactctgctgggaactgaactatgacgtcagcattttcattcatgaatctgattcttctaaatttttttcctgttttgtattcctgagctgacttctggcacatgcacaaatcagtttaccattagtcagcccataaatcactgataaaaggtaaaacaaaagataagatactggagttattttgatagtgctatagttctcatgctgatttgcatcagtacagtttggataaggtttctggctaaacagattgaaacctaaaaagtcaatttaattatctcatgattttgtgacttgaactgtgttgtgaacatattgacacaatatttttgttcttacaggaagttgagagtgctatgctatggctcctttgttataaaatagcatttcttttttttttttttttttttttttttggagacggtctcactgtgtcactcagtctggagtgcagtggcatgatctctctcggcttactgcagcctcgacttcttgggctcaggtgatccctcagcctcacaagtagctgggactacaggcacgcgccaccatgcctggctaatttttgtattttttgcggagatggagtttcgccgtgttgcccaggctggtctccaacttgtgaatgcaagtgatccacccactttggcctcccagagtgctgggattacaggcgtgagccactgagctggcctaaagtagcatttcttgtataatttgactaagttggaagattatataatgctttatttcagagaggttaggcctagagattaaatgatgttttattcaaattacctttgtaatggatttagatttttttttggagcattttcttgcctttgacatattttaaataacttcattgtttgatacttttattttaagatattattattgtggtggaactagcctagtattccttgtattggacttagggtgcatctaccctggattgtgcactcgtgtagctgttgactccggtttctcctctagggaggtcactgcttgcagttcagtactacgttagaacagttcttgaagaaatcttatttggagttttcttctgcaggccaaatttcaggctaagcctccggcccatagtatctttcaagcctgctgtagctgatgaatggtgagccgtaaaaaagtttattttctctactttcgtgggggatttgctgactttctggatactcaattgccaagaaacatttagaaataaaacgtgttatatttaggaatcatcattttagctaaataataatgcatgattagaattgatgattcaagctgcaaccactttgattgatacccagtcttactcttgagatcacttttttttctgagacagtcttgctttgtcacccagactggagtgtagtggcgtgatcttgtgtcactgcagcctccacttctcgggcctaagcagtcctcctgcctcagtcccccaagtgactgaggctataggtgcgtgccaccatgccaggctaatttttgtagagacggggttttgccctgttgtccaggctggtctcatactacagggctcaagtgatcctcctgcatcggcctcccaaagtgctgggatgacaagcatgaaccaccacgttcggctgagatgactttttattttttatttactgggtttttttttttttgagatggaatctagctctgtcacccaggctggagtgcagtggcatgatcttggctcaccgcaacctctgcctcctgtgttcaagcaattctcccacctcagcctcctgagtagctgggattacatgcatgcaccaccacgcctagctaatttttgttttttttagcagagacggggttttaccatgttggccaggctggtctcaaactcccgacctcagctgatctgcctgcctctgcctcccaaagtgctgggattacagacgtgagccaccgcgcctgtcttgagatgactttttaaatgccataacaactcacagatcctgtgtcctcccattcttaaatgaaactagagctttgtgttcctttaggttaaactaaattatctaataggtaacagaagagtggtctgttagctggctttctcctttcagtagatttgctaagagaaaggaaataaaagcaagtagactgtgaataaacattgaagatgacttaaatgacattgttttccctaataatgaaataatttatatattatttaaatataatttctataaaagaatctatttgcaagtgataatgaagaaaggaatttttttttttttttttgagacaaagtcttgctcttgtcccccaggctgcagtgcgatggcgcgatcttggttcattgcaacctccgccgccttggttcaagcgattctcctgcctcgccccccaagtagctaggattacaggtgctgaacaccacgctgggctaatttttgtatttttagttgagacaccatgttggccaggctggtcttgaactcctgacctcaggtgattcacccacctcggcctcccaaagtgctgggattacaggtgtgagctaccgcacccagcctaaaaaaggaatatttaatggtagagggctctgtaaaaaccccctaattttcaaagccatgtgccactgtagaatttatgaaaagttatgggctattattattaggtttcaaaaagtctggaatactggcggtagcatcagaattatttatttatttatcttttgagacagagtctatctctgtcgcccaggctagagtgcagtgatgcaagctccacttctcgagttcacgccattctcctgcctcagcctcttgggtagctgggaccacaggcgcccaccaccacacctggctaatttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctctatctcctgacctcatgatccgtccgcctctgcctcccaaagtgctcggattacagacgttagcctccacctccacgcctggctaaagcgttatcatttttatctaaccctgaaccaatcagtgattggttagttctctagctgtgaaggctttgcacttcctagacagcttgtagaacaagcccacttggattcccagctcaaactctttcctttttactatttatttattatttatttattcgttacttattattaattaaaaaaattttttagagacaagagtcttgatctgtcacccaggctagagtgccatcacagctcactgcaaccttgaactcttgggttcaagtgatcctcctgcctcagcctcctgagtagtgaggactacgggcgtgtgccaccacacccggctaattcttttttaattttatggagaaagggtcttgctatgttgcgcaggcttgtcttgtactcctggcctcaagcagtcatcctgtctcagcctcccaaagtgccaggcttacaggcatgagccgctgtgcctggcttgtactctttcactagctgggaatgctggtgagcaggactcaaggatcccagcagagctgcatcctgtgctgtctttgctgccacttaggtggaccaggagctagaagcctttctctccatggcctccataccttcttttaccagatggtatttctgcatttatcactcttgattccagcacagcttttcctcatcttgcttttctcagacctcagctcttatgtaatgagatagttggtagtcattttgaggggattcatgtgttgggtaaagggttttcctagcgatgacctcgaaagttccttcccattaataataattactattaataattaatagcaataactaatgataaaacagaacagttgcagcaatatactgtaataaaagttgtgtgaatgtggtctctctctctctctgattatcttattgtaccatactcacctatttttggaccttagttgaccgcttgtaactgaaaccatggataagagggggactattgtgtaaggaaatgaagtcggagatatggaatttcatttcagggcttgctttcctgatattcagctattctgtataactgtatcttttccttttgaggtccttgctccaggacaagaataatatgttgactcaagctgtatggggggatttgaactacagacactcagatatctcctttctgaggtacatagagggcttaattttttaggtctgtctgtttaatatactatatttactttaaaaaacgtaggccgggtgctgtggctcggtgcctataatctaagcactttgggaggccgagacgggaggattgctttagccctggagttcgagaccagcctgggcaacatagtgagaccttgtctctactaaaaatagaaaaaattagccagatgtgttggtgtgcgcctgtgatcccaggtacctgggaggctgaggttggaggattacttgagcccttgaggtcaaggctgcagtgagctacgatcacgccactgcactccagtctggatgacagagtgagatcctgtctcaaaacaaacaaaatgtaaaaaaatttaaatttattaaaaaagatgtacaacaccaaaatgttcatagttattctgtatgacagatctgaggtctttgttcagacatagatgagggttcatagttttggaaaatagacttaaataatatatgattacagatgaaaaatatttgctaacctcagactttttatgtttaaggtagtatttatattcatttagttgtactttctggagttgattaatataactgttattaaaatctatcgattcccagtaattcagtaaatgaagactcttcctatttagaaactcgtgtggattggggagttgctgtgggcccactgtcattgatcatatcacatcttcacttgaacctgctccctgggcctcctataggcctcgcgtttggagaggccgtgaacataatttatttttggaagtttctttcatttttaaagatactgagaggcaagttgaagttcctggtgttcgtgtaaacattccctgccttatcctttccatctcagccattatgaaatgttctggctgaatcatttgctttcacaaagctttgatgaaagtttcttcctcatttggttttcttgatagaggctgttgtgctaaaaagaaagctataacaagttagaagggtggagagtgggcacttaacatttttgaagtacttgtctttcttcctaggggtcctccagaaattgatcatagataacttgaccaaattcaaggcccagagatttcttccaggcattctgggagggaaggaacatcaggctttctgtactgaatctaattattctaaatatttcccactgcagcttgtatgagtgttttctgatgcaaatatggtgatagtggcgacctctctaactgggctaaatatccttgacagctttttatctgtcctctccaagtatttttagtctctttagcttctgtggccatgtctggaggaactgaggatggatttagctgctctggtgctgctccaagttgttgtgggtgctctttgctaccttcgtcactgtcctgccacagtcctgccactgatgaggctcctggcccttgtcatttgatgagggaacataaacacttgtttaataaaaataaaaaagtcatgattttcagaatgctttgaaaataagctatggctaatggtgatacacaataggaatgtccctaatttcactaaattgtatgctcaaaaagggttaaagtggtaaattttatgttatgcatattttgccacaattaaaaaaataaaaacttcaaatggatttgaagcttaatgagaaaactagttataatgtcctaacagtaaatatatggccaatattttcatgaccccaaggtgggaggctgtgccttaaataaactgtcagaatcacacattaaaaaaaaaaaaaagtgatggtaatcaggccctgaggttcatttatacagaaagtgatttttaggtgagattttaatatttgcaatatttatatttgtaaagaggattggctagctcattcagaaaagtctgaggttcttaataaacactaggaaacagatggtttggggttgatgtcagggaaggtaagcaggccgtgctttagattagagcacttttgattgcaagtcccatgagccacacagtttaggccaagtgaaagcagttttagtctaagaagagcagaagcaatcgtagcctctcgggacagaaactgaagtgcagctgggcagtgggaactggatctggagagtctggagtacatgtcttctctggagctgggctttttccattcacatgtagcttccttgcttgagttacatgtagtggccttagtcatggctcctgcatgtcctgactctagttccagtactcatcatcatctgactcccatttctatggctcagtacaaaaatattcaagactgggtattggactgactcctctcagccatttgctttgtttccataggccaggtgatcatctcactctggtcgactatgaaagaaggttggttagatccagcagcctgctgatcatttagagggtcttagagtgagaggagattgtgtgagaagctggttatcatagcagggggtcctggcacctcaaactctgtccccatcaaacagtgtaaaagaaaagatattgactcctaaaggagtgtcttatgttcagatgctatagagttttgcagagaaagtgttcagtgtagctacagatagaaggccaagtgtccttggtcagccagcctgggtgtgtgtggagtaagttagtggtaggtgtagtaactgtctcaaagctttttctttgtctctctctctctcttttttttttttgagacaaggtcttattctgtcgcccaggctggagtgcagtagcacaatttcagctcactgaagcctcgacagcctgggctcaagtgatcctcccacctcagccccccaagctgaggacttagctggaaaacacaggcatatgccacaacgcccggctgatttttatgtttttagtagagacaggggtttcattatgttgcctaggctggtcttgaactcttggccagctcaagcaatccacctgcctcagtctctcaaagggctgggattacaggcgtgagccaccgtgcccggccccagaactttttctttgaatagtggagaagcagaacaccttggaatgctatggtctgtgcggtctttgccctgtgggtgttctcaggtggaatcaggcagtttgggtgatgtcagtatcatttgaggtcttccacagttcagctatttgggtgggcttccccacttttccccttgttttgggtcggtaaacataaaaggatggagatgtgtatccttagtaagaatgggagacgttgccttcagaatgggtagaaagcagaaaacaagcggggaagaaaacagaaaacagcctctctttaagtgtatgtggctgcctgtgtgcacagtccttcaccttttccttagtatatccctcctgcctctgatctcttgttgttcttgatttttcatggtagaaggaggaaacaaaattatagaagacaggtggaatactgtgaaagaatagtagtttggagataactatgtaaagggctactagcctgcgcaccgttgaattctctgaatttacagctgtttagtcattgatgtttcatagtgttgaccttgagtaaattcagaaaagcaatactgagtatgttctgctaaacaaaagaggaaagtgtatgtttttaaagaaacaaccttcacagtggtttcagtagttacagggatttggttcttttttaaattattttatttctttttaaagatggtctcactctgtcatccaggctggagtgcagaggtgtgatcgtagctcactggcaccttgaattcctggactcaagtgatcctcctgcctcagactcccaagtggttaggagtacaggcatgtatcaccatgcctagctgattaaaatttttttttttttggccaggcatggtggctcacgcctgtaatcccagcactttgggaggctgaggcgggtggatctcctgaggtcaggagttccagaccagcttggccaacatgggtgaaaccccttctctactaaaaaaaatacaaaaagctgggcatggtggcgggtgccagtaatcctagctacttgggaggctgaggcaggagaatcagttgaacccgggaggcagaggttgcagtgtgtcgagattgtgccatcgcactccagcctgggaaacgagcgaaactctttttttttttttttttttttggtaaagacagggtctcaatatgttgcccaggctgatcttaaactcctggcctcaagtgatcctccagccttggcctcccgaagtgctgggattgcaggtataagccactgtgcccagcctgatttgttttttaataatagcttaagatgtaattcatatattataaaattaacccttttaaaatatataattgagtgggttttcttttgtatatttacatgtttcgtgcaactgtccccactctctaattccacattttcatcactccaaaaagaaaatctgtacccattagcagccactccctgttgcctcctcctcccggccctagtcaattactaatctgctttatttctttatgcatatttatgcctagtgtgaacatttcatataaatagaatcatgtagtgtttgtccttttgtgacttgactggcttatttcccttagcataatgttttcaaggtttttatctatgttgtatgtagcatgtactgttacttcatcccttttttaaaattaaaaaattttaaatttaatataatagagatgggggtctcgccatgttgccaggctggtcttgaactcctgggctcaagtgatccttctgcctcggactcccaagtgctgggattacaggtgtaaaccactacacctggccacttcactccttttatttttgaataatcctctgttgtgtggatatataccacattttgtttatccattcaccagttaatagacatttgagttattccactttttggctattaagaaaaatgctgctgtgaacatttgtgtacaagcttttatatggacatatgttttcatttctgttggaaagatacctaggagtggaattgtggtgtcgtagttaactctgtttaactttttgaggaactgttttccaaacttttccaaagtggttagatcatattacattcccaccagcaagtatgagagttgtaatttctccacattcttgcaaacacttgttattgtccatctttttgattatagccattgttgtagatgggaagtggtatattattgtggttttgatttgcatttccctagtgactaatgatgttgagcatctgttcatgagcttattagccatttgtatgtctgctttgacaaatgtctattcaaatcctcttccatttttgaattgagtcaattgaatttttgctgttcagttgtaggaattctttatatgtgttctagatatcagtcccttatcagatatgtgatttcaaatgtatgattgacatgtgatatgtgatttttctctgattctgtgtgggttgtcttttcgcttttgttttttgagagagggtctcattctgtcacccaggcaggagtgtagtgatgcagtcatgtctccctgcagtcttgcctgcctgggcttaagcggtcctcccaccttagtctcctgagcagctgggacttcaggggggcaccactggtctggctaatttagaaattttttaatagaaacggagtctctatattatattatgcccaggctggtcttgaactcctgggctcaagtgatcctcctgccttggcctcccaaaatgctgggattacaagtatgagctgctgtgctggcctttactttcttgatagtgtcctttgaagaacagaagttttaaatttgattgtgtcccatttatctgtttttttgtttttttttttggtcacttatgcttttggtatcataataagaaaccattgtcatatccaaggtcgtgaaggtttacacctgtgtttttttgttagagttctgtagttttagctctgacatttagttctctgatagatcttcagttaatttttgtacacagtgtgaggtaggcttccagcttcatttttttgcatgtggatattcagttgtcctagcccatttgttgaaaagaccattctttcctcactgaagtgtcttggcacccttgttgaaaatcaactgactataaatctgtgggtttatttttagagtcttgattctattccattgatctatatgtctatctttgtgccattaccacaatgtcttgattctgtagctttgtagtaagttttgaaatcaggaactgtcagtcctttaactctgttcttctttttcaagattgttttggctgtgctagctcccttgtatttccgtatgaatattaggatcagcttgttagtttccacagaagagacaactgagatataatggggattatattcaatctgaggatctatttggggagtttaaattcattttatggatttgctgtatgcttaggaagtcctggctaactcagacacccaagcatcttgccttaaaaacacaaaattttgttttaatttattgatgtagtaggctgccttggtgaaacactgtaattcactgttagactggaattggacttttcaggttctaagagagcaaacagctcttccacgtagcgtgtaggttgacttcctgtagtaaatgtttttttgatgtgaaagtttgctgataccttgcatgttttaaaaaaaatgtggtattctggttaatatacattctggttaatagagaactagcagattatatatatgaatatttatcaaagagttaggacatgttacaataaaattgtgacattaaaatttatataattgttattattactggaggaatcagaagatattttaggaccttgtagtcccgcaggggccacgtgaacattggttattgttatacttttaagtcacttcatttactcaacaaataacaaagtgcctatctgtgccaggcacaaggaaggacagacccagtctctgtccttatggagctaagggggagacggacattaatcaagatgccatatgaaatttcagctgggactcagtgctgtgaaggtgcgtgcaatatgtcataaagggatttgactaatctgcaaggttgggggaggcttcttgagagctctggaggaaaatgggaattaattgtgggaagaattaaggagaaaagttccaggtaattgggtgagtttgttagtgagttgtgtggagatactctggttatatcctgtttatcacttttgggaaagagtatctgaatacttggctctggcctttactctgtcccttaaatgccttgtggctgagcaggtactctttctgagcttgttcacatactgttttttaaatttctgtagccatttttatttacagatacttacatgaaaacatacagaaatctaggcttttggttgattgttttcatataattaaaaaatcattcactttgggaggccgaggcgggtggatcatgaggtcaggagatcgagaccatcctggctaacatggtgaaaccccgtctctactaaaaatacaaaaaattagctgagcgtggtggcacgtgcctgtagtctcagctacttgggaggctgaggcaggagaatcgcttgaatccaggaggcggaggttgcagtgagctgagatcgtgccactgcacttcagcctggaggacagagcaagacttcatctcaaaaaaaaaaaaaaaaaattatttctttgtgaccttccatggttagctatttagaactgctttagtggtaaattgaatacttttctgaacatttttcctagactttgaaattaggagtcatttctgtttacacatacttcagaagcctgtcagggacagagtctgtagtgacagaagtctgtagggaagcagatatggatgtaagtgattcaagacaagtcataatgctttaataaggctctggaagggaagatggaaagacttccgggaggaggtggaatttgacctgaaatcattgacgggcaaacatggtagttggaggagaaattccaagcagaggaaatggaacagaggcatagagccaagagagtacagggagtgggtggaattcatgtgcatatgggtaggtaagcctcggaaagtaggtaggggtcatgttgttaggggcctgaaagtcagaccgaagaatctggatttaattctctgctcaggagaggcttttagaagttttttttttttagtagaggaatggaattgattggataaagtcgattctcctgaaacaggtgctaataagggccacctagttacttctccagcttcctctctacagtcacgtcacattttttagactctgattgttccaaggtcccacagtgtctggtggttttaggcctcccacattgctgttgccttgatttagaagttgcacctgcctcaggaacacaggcacacacgctcacccatgctcttgctgactttctgtgtcttctgtgtttcagcttaaatgaaacttccaataggagaagccttcttgaccttgcccctcttttcagattggatcggatgcccttcctgtgtgcaccatagcactacgtggttttcctagtcatggcacattttagtttgcattggagttgcttgtttacttctctttctctctcaattagatgtgcatttctggaggtaagaggcttgagtacctagacttagtaaatgcttgttggctgaatgaatgaatgaatgaatgagcaaataggaaggactagagtcgggagaaaatcacttctggcaagagttgtctgtagaattggggtgaggaaagagctcgcatggctgaggagtgtgtgtgtcacacacacatgcaattttgtgactgactgaatgtgggccttgagggaaggtgactcctaggttttgaaccataactggggatttagtgaggccagactgagatagggaagacaaggcaggtatatttggggagaatggctgcaaaggtaccactgtttttcttcttcttctttttcttttttttttttttgagatggagtttcactcttgtcgcccaggctgcagtgcaatggcatggtctcagctcactgcaacatccacctctcaggttcaagcaattctcctgcctcagcctcccgagtagctgggattacaggcacccaccaccatgcctggctaattttcgtatttttagtagagacggggtttcaccatgttggccaggctggtcttgaactcctgacctcaggtgatccgctcaccttgacctcccaaagtgctaggattacagacgtgagccaccgcgcctggccggtatcgctgtttttaaggcgtcattgggtagctttagaatgtgtatatacagcgtgacattggagatgtgggtcaaagatcagggagtccttcatatcaccctgctttttttcttcattgttcttccagagggcaagggagggagccttggtgctggagtccttagaggtcagccccctgggcttggggcagggagagaagggctgtgaggaggtctggaggggcagatgcagtggcagcagcacagcacaaaaggtacagacagtacctttgcaaccaatgaatgaatcagttcaaaacaattagaagtcacagttgtgagtgagattggaaggggagcagagaaggggcctgagggcagaaatgtgatgaatgcttacattttaatgccaccagaggggagagaaccagtagaggctgagaaagaatggtcggagaggtaagggaacaagcagaatatgaattcagggttgctgagtgtggagggttgaaaggaggttgtcagtcgtaatgctgcagagttgagtagactgaagactaaggaagggtattggttttgtcaattcgataatgagagaataaaggagtagagatagggtggatgattatttcagaaccgtggtggcatatacagagtactggtagaaatgatggtgaaatgattgatccagtccaagatgagaaaagaaaccactgtggcctgatgggctgtgagtgtattagttatctatagctgctgtaaccaatcatcacaaacccagtggcttcaaacagcccagggtggaatctcctggttcccatgggtcaggcatttgggcagggcagggctgggtctgctggattgggactgctgaactgtggtcgaggtgctggccaggactgggctcaccttggaaacctctggtaggggaggatccacttccaggctcccttggccatttgaaggactcctttctttgggctgttgggctgagggctcagcttttcgccagctgttggcccgaggctaccctcaattcctgccccaggggcctctgcaacaccatagcttgcttcatcagagccaggagggacagtctctagcaagacagaagtcacagtctgcccattacctttgccatgttctgctggttagaagcaacttgctaggtccagcccacactccgggggagggggttacacaaagctgttaacagtggctgggcgcggtggctcatgcctgtaatcccagcagtttgggaggctgaggcaggcagatcacgaggtcaggagatcgagaccatctggctaacacggtgaaatcccgtctctactaaaaatacaaaaatttagccgggcgtggtggcggacacctgcagtcccagctactccggaggctgaggcaggagaatggcatgaacccggaggcggagcttgcagtgagctgagatcgtgccactgtactccagtctgggtgacagagcgagactccgtttcaaaaaaaaaagctgttaacatcaagaggtggggatcataggaggtccatcataaagtttgtcctccaccgtagaggggtggtgacgggattagaaggcattataacagttcttcaggtgaggccttggaggatgcagatggaaaaacgggagctttcagaggcggaagttttggaagtgcagttccagttgaaagttgggatagtcaggtggtgacgcttctcaggaggccttctgtgccctttgtcttcatgtgccttctatgtgctctctcctgttagacaaatgaacattctgtgttacagttgccaccgataaatccatctgtctggctaaaatggaattatttaccagccaattcctggccagtggaggtatctgccctcttgccttatggttttgttgaggatcaaatgaggtaattcatatgaagtgttttatagactacaaagtaatatgcaaacaaaaggtattaaacggtgctacctttttctctatgttaagtagaacccatggaatttaacttacattttccttaataacttgggttcattatgttgtatgtagcttattaaactgggctttatttaacactgtgatttgggtttttggagtagagagtttacttttatgataaatgaccccaaactgctatacctttcaaatccttgtgtcccatttttattgtttaaaaaaacaatctcaccttgccgttgcctgtcactcttttgcttctgtgtgtcagttttgagctacattttttcccctccgatttgttgcttctgatctctgggcttggcaacctgataatgaagcatattagagctgtgagtagttttatagtaatcaagctacgaatgtgggtcggagaaactcttctcacagtggagtacataagcttttgtgcatggacttcgtaaaattcacttttggccttcagagtgttcttggcttccttcctagttctggctgtgttcggattaagggaggttcccagatagccgacctccattccggggctgtggctgccattttcttggcgtccacctcattgctctgttacgagaaacagtgtcattctcttctttagttttgatgaggttttagttctttgggcagtagcaagtagtgataggtgatggtggtctgtggttcatggaccaaaaaatgtttgagaggcatggaggatctttagacaagatcaccttctaggtgtatgtggtagcattctgttccaccgctctcttctccttcaggatgtctccctcccagctaacctgctcggtgttcctcagtgggagcgtttgccttagctttctctcagagcatcgtacttactttttctgcccgcatttttgcattgctgctttgtggagaagcgttgctgcattattagggagagaaccgtgttttcttgtggaaatcacacagtagtatgggagaactggtctggttctaattctgccccgtcctagcttgtggcctttgcccagtgccttgttacccatgtcttggtgtctccatttctagaataggcttaatgtgtgctttgctaccttttaggatcgaaataagattttatatatgaaaatgcttgttatacgtacataatattgaatagaatgcctagtttgttgggttgattttgttgatattttacaatgctctctctgaggagttaaacaaaattatcattagtatgggtaacaataagtactactgaaacaatatcattttaaatgttatacagttttttttactgaatgtattctagttgaatctatttgtacaaatgtggacatttagtaagtgctctttgattattttcagactttgagtatactggcttccaagccaaattaaatttatgaaaattctaatgatactgtgattcatatctagaaagaataatttaaaaaaaactgtaaaatcactttaaacatgctttacgtgcatctctggtaatagagaatcaattaatctgatttctcaggccataaatctggcttgatatattgtaatattagttcctgtgtcagcctcttagaacttgaactgttttgtagtctgttccagctacttgtttgcttttgaactcaattctaggtgttgaactcaatttgagagcctaaaatggtttgtgccccaattaccttagaggttactgtttcatttttttatttagcctgccccaggagtaggaagtcggctacctaccagactttttccttttaacttgactgtatactttaatttttgtctctatcccatgggggagttgtgagggttattatagtatagtagcacttaatggcatattttaaacttcttgaaaagtggtaatatgtgagcacataatatttttgtactgtagcacataattttttcccacactaaccttttgtggttcagaaaaagaataaagttacttgggcttggggtacatgttgaattgcccatctcataaaatcgttaacctgattttagggagtgtctctgaaacatgtcttttgacagaccttgtgctgtttcttatttattattaataaattgatatttcatttattattcataaattaatactaattaaataattaattgtgctctagcccccagttttagtttggttttcttggtatctctgaaaactgttgagtattccccctactccttttaagtttttttttttttttaagcaggtttaaagtagcttttatcatattccttgatttctcaaatgaatagagggataaggttcctttctttaaaaatatctgcaacattgctggactgagaggtcgtatttacagttttttctttttaaaaattttttttagagatggggtcctgctctgttgtccaggctggagtgcagtggcacagctcacagctcactgcagccttgaactcctgggctcaaacagtcctcccgcctcagcctcccaggtagctgggactacaggttcgagccactgcttgttcagtctcttgcttttgtctcagtggcacagtaccaagacatagcaaatcaaagtgaccaagaggatgagtggcaattcggtggccttataggaagagatgtgcttgaaaacgacagaaggcttttagtaaattccaccaccatcaccaggacgagagacgggaccatttttcctttccataaacttaggggctggttattaatttatgaattctataagtaatttgagcttgtgttatgtaccagacattgtattaagtattaccagagatactgggaagaacaagccagacatcctttcaaggatgcatttgataaaatctcattttgagtatgttaggaaaatatttattggagaaggaaacctcctagattggttttagatcccgaatggccttagggattgaaaatggagttgtaggttagcagaggacatttctgaaaggagtaactattttgtaattaaaaagcagtttacagaagatactgtggcagagactgctagttgatcatgaaacccatctccttctcttcctcctcttcctgggcattttccagtcccccttggaatcgtgaccaaattctagccagtggggtgagagcaacgaagtgtgccacttccagacttggcccctgaaactcttgaggcatgggtatcatgccttttccttatctggcttgatgcagagggcctagtgacctagaaagtcttctgccacaaggtagaaggagcacaggcagcagagccactgctgtgagaacagtctgcccaccaggagcacctgttttggactttacctgagcaagaagtgaacatttttggtatttgagccattatacagttagcctccctaactatctaggcacgatgcctaggatgctaagcaaaactggactgagaggtcgtatctacagttttttctttttaaaaaatagtaaaggtgctaagtagtaaaggtgctaagattcaggcgcggctttaattctgtggagacctaaatattctttgtctttatttcaaagaacggtaaatacacttttcattatgctgtttctctgttccaaagcctgtaatcacttcttactatatagcatcttgtttcattaatccatcttccaaaaactctaatatatgtatatattatccatatacaatgaatgtgcctgtgtgtaacatcctgatctaggttctctgagtggagacaaaatgaataaaacatagtccatggcttcaaagagtttctgcttgatagccaggtagttactgaatttccatactgctatcatctgtcccttgttttaacctttaagtcatatattattttttcattacctttttttaaaagtattgtttcaattagatagtatactttttgaaaacagggaatatatattatagagctctgcatctctcctcttgggtatttcttttttttttttgagacggggtctcactctgttgcctaggctatagtgcagtagtgctgtcatggctcactgcaacctcgatctcccaggctcaagcaatccgcctgcctcagccttccatttagctgggactgcaggcacacagtaccacacctggctaatattttaatatttgtagagacagagtcttgccatgttgcccaggctggtattgaactcctgggcttaagcagtcctctcgccttggccttccaaagtgctgggattacaggtgtgagccaccatgcccagccttcttgggtacttccagcagaaactgggcactatacttgagtaaccatccctagagtttctactaattatcttgtgtggatattctggtatagttttgtattatgtactaacagatgaaagtactttttaaatcttctaggaattagtggaattatgctgttgaggaatgttaggattggaaggatcttttatagatcatttatctaattcctgatcttttagtttgatcatctggtttctgatactcaaggtgtggccattaattgcagcatgggcatcacctgggggcttgttagaggcagaatctcaggttctccctcagacctgtgaatcagaacttgcattgaaagaagatcctaagataacccgcatgcacattacatttggagaagttctgctcaaggtcaactactcatttgactcttgagaaaactggggaagtcagagagttgcccagtcatacaactgtttatttcagtggttctcaaccttggatacatcttgggatcacttggggacctttaaaaaaatactgaggcctgggtcccatccccagacattctgacgtaattggtttgggcatcagagttttggagatttcactagatgactggctaaggctgagaaccattgatttgattaatgatggaatccaggtttcttcatgctctaatcaagtattccttccactccaccatggctgtacattcagaaacaatgaaaaacatcctatcaaatttttacagtaatgcatcactccatttcatttcctttataggaatttacccctattggatagtgtcccatttaccatctgtcttccccccactagaatgtatctccaagaggacaggacccttgtctgtcttgttcagtgctgtgtcccagcttgcgaacagtgtctggtacatgttaggtgctcctttaatagttgtagaacaaatggaaggagctaccataaagaaggatgtgttctgtgagaggaaaacacaggctactctaaaggtaccctgtgggcgagaggcttcctgaagggtgaggggtctgagttgaagtgcagaatcagcgggggaggtgcttgaagacctgcttctgaggaaggacttgaacccagatctgacttgaaagcttgtgcttttccattccactgtgttgtcctgtggacacagtggctcactgatttgcccggacttcttagtagtgagtggtggactggaacacaccaccgcggctctgcaggtgcttaaggccagcccgcctccctctatggcagagccgccccagtattgcagacaggcgcctagagggagatcaaaacacgaagttgtcctgtgaaagttcctggcccagtgtttggcacaggggtatctagtacaaggtagccctttcttatcatggaagtttttttgtgctttggcttgttttgagaacctatggttttcaaagatagaatgacttgatttcagttttaactttggtttctttcctagttaactatggagacttcattatgcagtgctgtggagagagtgtgattggtttttgtctatgatatttctgtgtcatatgttattttagtgccaagttcttcctgttatttcagatattctgtcactgatttacttattgttagactttgaagttgggtataaaaatccttttttatgaagctattcattagtgtgtcccactgaaccaaagtgatttttaaaaacttttcacctaagaccattgttaagatatctcaaatggtaatcttataccgtcagtttttgataataggaagccaggaaatgttaagccttgaatgtaagacattatttttaacatcgtaaaatttcaagttttaattcagaaactaaattaaaatgaggtattacattcatgtgattagtgggctgttactggtgactcttaaagatgttacaagaagtcagcgtgctgctgacttttcccctattggagatcttcccatgaaccacttttcctaaggtatgatgattccatgctcacagtcatgggtagaaagtaatgttggattttccaaaggatacatgaattccgagccttgtctagtctatagggtgaatccttggacatgactgttaccacagatgttatcatagttaactactttttttgtttttgtgtcagggtctcattctgtcacccaagctagagtgcaatagcatggtcatggttcactttaggctcaaattcctggctcaagtgatcctcccacctcagtctcctgagtagctggggttacaggcgtgagccactgtgcctagctcagtatactactattggttaaattggagagggaaacagtcctagaacaagagttttacagaaatagaaaagaaagaattaaggagctcatggttatcctggtagctaggagtcacattatagagaaagactttatttatatggaccctgaaaacaatttgacttctgaagcacttgatcatgggcataagggagaggaaaattaataattcttggaagtcaactttagtcagattgcaacattttttggcataaaaaactcaggcgcggtgggtcatgcctgtaattccagcattttgggaggccgaggctggcagatcatttgaggtcaggagttcgagaccagcctggccaatatggtgaaaccccatctctactaaaaatacacaaattagccaggcatggtggcggacacctgtgatcccagctactcaggaggctgaggcaggagaatcacttgaacctgggaggcagaggttgcactgagctgagatcccaccactacactccagtctgggcaacagagtgagactccgtctcaaaacaaacaaacaaacaaataacaacaaataaataactcaggcaatcctgtttgttcttagaaaatgttaacattgttaaagctcaccctcattaactatggtaacaatagtgttttgtatttgggtggtacctttgaattgaaagcacttgggtatgtattacctaatcctcctcctgcctcagagagaaggagagagaagtatccacccgccctttttggatgaggtagtacagagaggttgaattactttcctaaggacagctagtaaatgttagaactgaactctttatattttattttaattaattaattttttgagacagggtttcactctgtcatccaggcgggagtgcagtggtgtgatcatggctcactgcagcctcaacttcccggattccagcaatcctcctacctcagtccccccaggtatctgggaccataggtgtgttgccaccatgcctggctaatttttgtatctttggtagaggtgaggttttgccatgttatccaggctggtctttaactcctaagctcaaataatccacccgcattggctccgcaaagtgttgggattacaggcatgagccaccacatttatttatttatttattattattatttttaaagatgaggccttgttctgttgcccaggctggagcaggagtgtagtggtgttatcatggttcactgcagccttaaaagtcctgggctcaagcgatcttcctaccacagcctcctgagtagctgagactacaggcacaagccaccatgcctggtagcttttaaatataaaatgttgagggtggttgttgaacttgtaaactatctttggttttctaagtgtataaatatgtggtttataatgtaggatgaataatctaaaattttatttaatactgcagccaaacaaaaaagatatttttaggactgaaaataattggccgtcaatattcaaaaaattttctttttttttaaaaagttaccgttgtgtaggttttaggtgaaatctttaattttatctgagtgaagcagcctgacagccagagaccttgtttctttcctgttaacggaattccccttgatttacttgccatgccataatactagttggcgctctgcacattttttgggtgagtcgggtgttgggtttattgttgggaaatggttaaaaatgttgttggtgttgactgagcttcaaaatgaatatgacattggttcttagcaaaaatttcctctatgtacagcacacatacttcccatttaaacaaattacacaagttatgcatgttcatcagcacagaccttttctcacatatgtatctaaaattttgaagcagccttaagcttgcagtgcaaagaacggtttccccctgagccatttgaggataaattgctgataagttccatcactctcaaatacttgatcatgtacttcctacaaacaagaacattctcctccataaccacaagaacagtaatcacaaccaggaagttaacactgagacattcctactctccagtcctaaagtcctgttgctgtttgccagttgatccagcaatggcctttgtagaaaaatatctaatcagaaccttgggtcataactggttgtctcttcaatctcttaatacagaagagttttcagtccttttagactttcatgaccttgacactcttgaggattgcaggccagtcattttgtggaatgttccttgatttggatttgtctgatgtttcctcatgattagattcaggttttgcatcttggcaggaatatcacagaagagccagattatatctttttgaaagattagttttacattttattttctgtttccttagagcgtttcccaaagtgtattctgcggaactagcacctactgtgttctcaacaccgtgccacctatagaaggtaggatttgaaaaagcttttgacttacaggaaggggtgggcttggcagtggcagtaattatcatctagtacagtggaaacagccttcagcccggactcagaagacctgggttctgcacttaactgctgtgtgatcttagatgagttacttaatccttctggggtagcaaaaagaatgctctcctcataaagtttctgtggagatgaaaaaaggcaaaagatttaatcacacggagaaatcaaagcacttaacaaatgtttgatactaatacaacacttctgtaattctagtgtccaataccaggtgacttagagtaggagcagtgtggtattttgggaaaagccacaggtcatgtttgaatcccagctgagccactcagcagctgtggatcttgggcaaattaatctgagcctcatgttcctcctctgtaaaatgggagtaattaagcccttgtgttttatcgtgaggattaaatgaaagagtgcaatgtaagatcctttctgggtgcctgatacacagtagagtcccacaagtgcttactccctaataaataatggaaaatagatttacttaatcacatgtacctccagttggaattgaatgaagtagaggaggagagaatgtcccaaaacccaaattgaagtgatggcttacagggctgctgtgccctcactttatctgttccctcatacatatttttagattgaaaatgtaaatgtagataaacagtgagaagtttattgaacctgagttatgatttgacctaagcctggacccgagattttgtaatatgatcaacaggaaaaaggtaaatctgggctacctaaaaatagaagcggtaagttgatcatcacacaactctaagaacaagaaggggattgttaaatagcaaaactaattatatttttctacttaaaaagctgttagtttctgtttctttaaccttttaaaaatcttttgtagaattactactgggtttaattcactttggagactttggaaaagaataatgcaaaatcagatcagtgtttggcacatagtgcttaattaatatgtattttggatatatggtgatttgaaggccttaggttagtaatggctgtatttgctgctgtgagcattatgctgacttgaatataacaatatatgtttatgttttcagttcctatcctactaattaaatctaagcacataataattagagctaaacagaaaattgtagagcttccttttgattttactactccatgttgttgatcaaagatattcccaataagatttagcaatttgatacactgttataccaaactgtttgaacagtttggtctagagtttgaaagattaatcgtaatcaacttgaatgaataacagtgttcatcattattcatagaaccaacattattttttattatgaatcaaagtaaaatgaatgtatcatttctagattagttaatatagttataatttaccttggcagaagtcacagaattttcgaaggaaaaggtcaaatacatttctttggatttaagtaaaggatttggcaatgtgaatctcatttttttgaaacaaaacatgaaaacagtaattctgctttttgtctaagtgaatgagcatttttttgcatattggaaagttatattatactacaccttgtaggttgactagaaaggatggttcgttctttagaattagagttgtcagtcaagcaaatcatctgtcattttcaagagcctcactagttatttttttattgtgaagtaggttagaaaattattttgtaaagtctaataccatacacatatattttgttagataatgataatgaagtgttttactgtcatttggttgacactcccacttttcagtgtcaaagttcaactatttgtattgaatactgaataatgcagtggaaaccagtatatgccttaattttactgttcactcaagatactattattaggatttgaaaactggtgcatgtgtttagttattttatcattcttagttatcccaaaacattaaaaagcagattttaatttaaaaacagatttttatgcagtatagccatgtaaagttcttttccagtgtaaaatcaaagtttctctgtatcccacttcacctgtagaaacactgaaatttaaaaatatgagttttaacattttgcctatttgaaattccagtaattcttttctcagtattaaactcgcaatccttataatgtagtaggaaaatttacccattgttatgtttcttaaaaacatccagtttatattcagcgtgaacctaaaattctggaaatggtacactttaaaaactgatcaaggggaacccactggccagtcatattcctgttccttttgactctgtggccacacctccgtgtaaagtgtaatgtttagaaactagattgagagagtgcttacacagccctgccctttggtcacatttaccactgcctgatttggtatcagagtggaagactgaagccttttctatagcagttaattgtgctgttgagaagagtacctttattacataaataccacacacacacacacacacacacacacacacaaacacacacacacgcacactctttatataccgcacagtagctgggttcctcgaagaggctaaaagaacagaaaattaacatcagattgtgatcacaaacatagaagctggggtttaaaactctgctcgtaagtgttcagaattgtacttcaaactgatagctttctcagagatatggctattcatatacaattcagagcaagcccatccattgagcaaccagtatagtgccgttttcataaaaggtacctgtaaatgttgaatatttgaattgagtatagattttagaatttcacctctattttcagaattgtacatatcatgggggattttaaaaaatggaaataaaagtactttaggggaagagagaagggaggtaaaggctcacgtgatctggtattctctgctttaaagttttatggcccgtggaacctccctcgggaggatgaagtgcagggagcataagcacataagattaccgaggttttatagtgtgtaattcatacagaactttctatgaactttcttttagttgaacagtttccttttggtttcacaggaagattttttgaaaggtttaatcttattttcctattaaattaaaatttgaaattcttgaaagcagtcagtttttaggtttttaaagtttttatactgcttatagaaatagaggatgggtattataattcaattggttatgtagttcatggaccaaaaaagatttagtatgccaaaactctcttaagttcatctccataaaatctttctatatgatgtagtaaattttttagactttatttctatgcccaatattttccttttaagatcttttccttgagaagaagtgtgttaatcagatgaaaaatgtttggagaggattttgtgaccttagaaaatattttttgttctttgatgtttttcatctgttcaaaaaaatagactgtactgaacaaagccgtagtaaataactggaaaaagatattgttgtatttcacttttaagattattaaccaatgcctgtatacttatgtaaggttgcttaattgtaaggcctattaagttatttaatgacagtaaattttatagggatttgtgtctggagaagaattagagataatctaatcttgttgatttgggaaaactgaaactattaagtaacttacccaaggtcacacaattagaaagtagcagaactgggccagatcttggactcttgactctgagttcagtgttataaaaccttattatatcatgaaaagttgtttcaactgtgacttactggagcaaattaagtctttgatgttttaatgtgcagctccttagtacctagttatgtgtaccctttgtatattggggatcttatgtagcataaaaagcctgggatgaataatttgtaactttgacctaaatgtgccaaagcttgtgagaaattttgagtcaggcaaagaaactttgttataggagtgaaaaaataaatgatatgtaagcaaacaaatgagtgaaataaatgttatataaaggaaatgatctcttctagaaatcatcaggtagactgattattaggtagtcagacataccatctagtctgaaagtaattattttttctctaactcatttagaagagttacattttgatgaaatacattaattatgtagatatgtatatgtaaatcaagttaattaaaatgatgattttatgttcagacctagaaaggccagcttctgtattacctgagtagctaactgcaggcttaaatcccttatatttataagatttgtgatttgcttttgaaaggataaatctcttttatagtctaggggatgaagtagtatttacgaacaaaatagtcatatattactataattcttcttacctaagaaacttaacattttttcaactgcttaataaaagatttttgggctttgtgaggttaattttataatttttatgtgcttcatcaaaacatggggaaagaaccttttaaaataactttcggttatgggcagctgcggggattttccctgttcactcacatgtcagggagcacaagcccgatcctgttttaaatcctcttgaccagattcctgctgccatcaatctgataaatgggtaaatgagtattattaactaagaggaatagtggggcctctgatgctcttggtctcacattgactaaactgagctgctatttctgactttgtcagtgtactttaaaggagattttatctattattttctctaaatttattgttttcttctttgtagatgatcatgggaacagcaatagtagtcatgtaaaaatctttttaccgaaaaagctgcttgaatgtctgccgaaatgttcaagtttaccaaaagagaggcaccgctggaacactaatgaggtagataagtttctttttttaagggtataattattttaagggcaaattttttaggttgcttcacatagtcctactttatgttagctttaaatttaaaatactgatctaggaaattgtaaatgacattatttaatctggatttgacagaaaccaaccaacatgttttttgatctgtctctgatctgcttggcttgcattgaaagatacacaatgtgcacgttgacttaactaaagtagcatgagtttctgtctgtgttttcttgcattttagtgtcttgcatttagtggttaaccctgcctgcatgccagttaaacgttagttgttatgtcttcatgaattaataaatatacagtcccactgttccacagaatgtgtagtgtcttgacaatgtgaatttttgtagagttggaaagggcaggtttcataggagtgaaacagcttttcgtcctttctaatgaagaaagtttgcttaatgctaagaatttttattaagattgaaggctgtacagtagattatgtatttagcatccaattagaaagtagatttatgaagtagaatgaaaaaagttaatcatcttggatgatgtttccttttttggtaaattttaatccaggagtcttactgttaggagtggattgctttgtcatcttttttattttgaaatctgaatatttcaatttaaggtaatacccgtttagtgtggtgatgagaattgggtatacgtccatcaatttgggagttatattcctttaattcagatggctggggttgctggttttgccaagttccatttgtgtgccttggctcaacattgatgtccaagttaaagcaaatttagcaccctatccttattggacactcagttctgttaaaagacacaagaagaaaatagtgctgcctattgagccttattttttaaagattctttggcgctaactacttcctgattcagaatgcttttgttttgcgtggtgggaggttatgtggataaaagtctctttccttatcacaggttagatttaaatactcactggaaccttacagctttgttaacttgtctcaactgattgtaaaattctttgaaggactctatgttttgatcattttcataaattacattttcccgtcagacagaatgtttttgctttgacaaatgtttgctagtttagaggcctgctgtttaaccagttatttattaactatttcagacatttttagacgtgaaaatgaagtagatatgcttaaaattagtcttaatcatagtttgttactctttcagcaaaatagtattatataatttggaagccatttaataagtcggaacttgattatgaattatttaaaaactcagtgtatttcttagtattccctgaaacgtagatttgataccaaattattatacacgttagttctagtttatttataaatgtaacccaacccataataagtatgtatttttccatattatatttcctgtggaattggcagcttatttattttattttttcccatggacccatgtcttgtggcagtttattttaactatgatttgacattatatttgaaaccagaaattgcttagtgaattaaaatcagtggcctgaagagtcttataaagctggatgtagcagtgctgggaatttagttggtagattatttccatcagtggcttcaaaactttttgaaacttttcagcataacccttcaactttcacatgtttaataaaacctctaaattatttacatgttgcaccttactagtatattagatacgttttaaagcatccgataaagaatttttatagaggatgagattaaaagaaaaaaatgagaagtttttccttattttctttctggacctcagtccacatactcccttggaggccagaggctgccataattcagattacagagaggaaaatgcatcccattctctcactggtgtaatgcaaatttgaggatctagatgggaaaacgtggattgttttgcatcagctatcactcatgctgaaatctaggtagaggagcgtatgttctgaagggtggaggcagcaggaggtggcacagctgatgggtgaagccatgcagcaccctttcccttgggatgggctgttctttcagttaattgtcagctcagctgacaaaagctcctatgagggaactgaatttacaggttgactcatttctctgtagaggaccttgacttttttcttgttttattttttggctttggaaaaatagaggaatattaagtgtgacagcgaagacttaccctacgaattgttaattctgcagaatgttatgtggcgatgataacctgctatttttttttttttaaactggctttggtaatataggtggaataaagcaatcagcggtgttactaaagcacttctttgatctagctgggaattggcattttcttacgttcttcagcctgccattcttcatgttgacatgaaaacctgaaggaaacgtagttcagtggacttgtttctcattggggctttgtggtcctatgtcatgctaaatcatatttagtcaaaattgcccgtgaaatcccttgacttgctcataaagtaaagtttagtcagactgcccttattaagagcccgttttccttccagagttggaatagatttctgtgttttggatgaggaccacatgaagtagttggcttgtatttagaagctgtgttgtacaaaaactctatttcttagatcccactgaaggggctcacactggaagaggcgtgtgggaatgcgcacagttgagagcacagtagatttgtgttttccatctcactccctgtacagcatatgttcacaaagtaagactggtggctcgagctgcctgtatgaaatgtcaactgtcatctttctctgttctccatgttcgtgtgtgctcgctcgctctctctgctggatgtgtacagttgaatttctgggtataatgtgactcctctatactaataaggaattcctttactcagacctgtgtttaaatatttgtgattgtttgaaaaaaccttttatactgtgtgtgttgtgagtgagattgtgctcattccatccttttttttttttttttttttttttgaggtggagtctcactctttcaccaggctggagtgcagtggcatgatcttggctcactgcaacctccgcctcccgggttcaagcggttctcctgcctcagtttcccaagtagctgggactacaggtgcgtgccaccatgcccagctaatttttgtatttttagtagagacagggttttaccatgttggccaggatggtctccatctcttgaccttgtgatccgcccacctcagcctcccaaagtgctgggattacaggcgtgaaccactgcacccggccccatcctaccatttattgagcacctgttctttactactgactgggtattttatataattatttgtaagccttaaaatagtattgcaaggtgggtaacatttccttttagagatgagggagtgtaggtagacagtagttattttttggtcaagagagcatacttgatagagcctgtctctgagcttaattgcatctgtgttgcttgttaattcttaggaactttcattctattgtttactctataggagtttaatcaaaggcctacaaacctaaactacagcaagtctattctgtaacgtagtttttttttttttttttttttttggagacagagtctcactctgttgcccaggctggaatgcagtggtgtcatctcagctccctgcaacctccacccctcaggttcaagtgattcttgtgctttagcctcctgggtggctgggattacaggcatgtgccaccacacctggataatttttgtattttataattttgtagagatggggtttcgccctgttggccaggctggtctcgaactcctgacctcaggtgatctacccgcttcagcctcccaaggtgctgggattacaggtgtgagccaccgttcctggcctgtaatgtagttttgaattaaaaagagttaatatagtcttaatattgtggattcatatgcaaatgtttggtgaagctgaaagtcactaaaaggaagactctaagaaggtaagagagatcgttggacctacttaagctacttttaaccttttctaacccattggaatacctaaaatcctttcccttcttggatgttatttgcaattgcagaataaattaaatgttacatctgaaaccaaatcaattttagattgtgctcccgcagccaccaatactggtcctcaggtggtaaagatgacacaaggagtgaaggtgatgatggctgcactaattatggaagccagtatgtattgaacatcctttgtatgctaggcactagtgagtcctttacatgaatcatcacatttaatctttcagttaatcctatgagatagattatttgactatccttatcttatagatgaggaaactgaagccatggatatgttaactaatgtacccgcagtcagagccgggaagtgggggacgggggagttcagccgctgcagcccgactttgagtcccataatccctcattttgtcccacagagcaatatcaagttgacttttccaagatcttgtagctatttagttctaatcctttcgttttatagaattgtttggcttcttcatctgattttaaaatgttgtaacaaagttaatctaattttgcattatgattttttaaaaagtggcagacactcatttcttaggaaagtagttttgattcctttttttaaaaaaagttttctcctacgtgtattttgatagttttgattctttttttatttatttattttttatttttttttttgagacggagtctcgctctgtcgcccaggctggagtgcagtggcgcgatctccgctcactgcaagctccgcctcccgggttcacgccattctcctgccgtagcctcccgcgtagctaggactacaggcgcccaccaccatgccgggctagttttttatatttttagtagagacggagtttcaccgtgttagccaggatggtcttgatctcctgatctcctgacctcgtgatccgcccgccttggtgtcccaaggtgctaggattacaggggtgagccaccgcacctggccttgtttttttttttttttgagatggagtctcactctgttacccaggctggagtgcaatgacgtgatctcagctcactgcaacctccacctcccgggttcaagcgattctcctgcctcagcctcctgtgtagctgtgattacaggcatgcgccaccatgcctggctaattttgtattcttagtagagacagggtttcaccatgttggttaggctggtctccaactcccgacctcaggtgatccgcctgcctcagcctcccaaagtgcttggattacaggcgtgagccacggcgcccagcttaaaacaatttattgaggtttaatttatgtattacaatataaactgcacccatttgaagtgcataattcaatgagtttttgacaagtgtatgctggtgaaactacctccaaaatcaagacacggcacatttctatcaccccataagtagcttgagagagtatttttttgtttgtttgttttgttttgtttttttgagatggagtctcactctgtcgcccaggctggagtgcagtggcgtgatctcggctcactgcaagctccacctcccaagttcacgctgttctcctgccttagcctcctgagtagctgggactacaggcacccgtcaccacgcccagccaattttttgtatttttagtagagatgggctttcaccgtgttggccaggatggtctcgatctcctgacctcatgatccgcccgcctcagcctcccaaagtgctgggattacggacgtgagccatcgcgcccggcccgatagttttgattcttaatgactattagtatgtggactatggatagtgaaaaaactatattaaaaatagaaattttgtacctgtgtgtaacttgagcattaagcctgacttttatattcagggcaagggagaaagaatgtattaaacacagagcacattcattaaagaacctactcttgtttcataatcagtttggtgttcacatcttcatcaggtgaactgctataaggtttctgcattttaagttagtatttttaaggcctagagccagaaataattatgctaacacaactgtctgaattcacaaatgactatttcataattacgtatattagtactccatatatgttgtccagactgaaaattgttttgtttagtcattaattagctgtttgacttaaaatataactactgcattccctagtctctggatctagatttcacttggcattcttccaaagccaaactaatgcagcaccatgaaccttttataatgaaaatgttctccctaaatatgttcaaatcacttttgtgtgttactatttttgaactaatgttctttttttgtttttcctgtaatacacagtttctctagagtaagcaaacaaaatagaattctagtttgtactgatccttaaagaaagtttcatcagatgtttttagttggtggtagctttagagtgtcatattaaatgcattttttaatggtaaaaatgtctatgtagagagcagtataggttgatacattctaagccacaccaaagcgtctgcaggagaaaaaacaaaacaaaacttgagtaataattataatgctttttataggaggaaacttactctttaaaaatcttgagtactttttccccctaactttttatatttaggtaagaaaaatggcctttaacactgtaagaattattaaataataattaatttcaactgtttttaacatcaagccaccttatttttttttattttttttttttgagacagagtctcattctgtcacccagactggagtgcagtggcacaatcttggctcactgcaacctccacctcctgggctgaagcaatcctcccatgtcagcttctgaagtagctgggattataggtgctcgccaccacggacctggctaattttttgtagagacagggtttcaccatgttgccaaggcccatccaaacaactgagctcaagcaatctgcttgccttggcccctcaaagtgctgggattacaggtgtgagccactgtgcctggttaccttaccttttaaaaaatttatttagtctttttttggtgtcgatacataatcttgagtgtttcttgtgtttttaattttttttcctttgtgtaactttgtgttaggtttagggctgtaatttttcagtgattggtttttctagtgtatttatatgttatctctttgaaatatagacacacattttggggggatcatttaagactcttcagacttcctaaatgtgagctaagctgaaaagcaccagtactctaatcataaaggcaggtgagatatttcagttttgatggcgtggaaagtcagttaacctttaggtagggcttggttttgtttagcttttggcagggctagtggtttgaacggtcccagattattttgttccaggcagggcttttctgattaaattgcaaaaatgaaaatgcatataaacaacacagagagccaagttttaagagtgacattatgtgatttttgaacacagtatatagtacgaagtttcaaattaaaagtgatacttgtgtagcagttaggttaaatatagttcctctgtttgctttgctagtgtgaagtgagatacatgatactgaaatacaggtaggcacaagcctggagatcaggcagcctgtgtcaagtgtgcagtgcctcagcagcagcagcagcagcagcactccacaggatatattgaaaagctggggcggaatgtcctcccacacaggtgaggggagacaggtgaaggcaggtttgacactgaggaatagtaagagaagtaaattgcaccctcagagtacagcaatatttatagcatttgaataagatgttaaagaacattttcttttaaggaagaaattcctgtgggtcttcctcagtttcaatctaaactagttttattatactattacttcagcatgtggcacttaacctggccatagtcagtgttcaataaatatttgttggatgaattaacgtaaaaacacaaaaaactcagtataaaattaattcttggagttcttttgcaaatataaaactcagatatatgcattacataaaaagaaaatacaaaactaataaagttttatattaacagggttagttaaatgcaatagatgatgttttgccaaaactaaattgtctcgcaacatgagtatcatactgactgttctcaagcaggttcttttgaatttggcatgcggtactatcttgtgtcctgcaattattttatactgagaagctgttttttacatatcaagcatttgtataagtctgtcattaagccttggcacaaatacatcatttagttttaaattcacttctggtttttctcattagcccaagaaaaatttaaatgacactactgggtactaggggaaacgtaaccacaaatcacaaacttgagcaatgagtttgtgtgttagaacatactcggttcaggtgttactttttcagattatacattaaattaagatgcaaagttaaaaattttatatggacttacagccccttgataatacttccacagagccgcagttgagaaacactgctctcttggaaagggtgcagagctggtgtcagaagcagattcgagtcttggctctgccgctactcagctgagtgttgggtaaggcacttaacctacttggcctctcttgggtcttaggtgatggcgcttggtgacctttgaagatttgtctttgaagattattgttgcttttgaaggttttctttaggaatgttggactttccagggaggcttgggtccagcttcggagtttatttgattaattttttttttttttttactgttaatcatctttttacttacttttaagttgtacaattcagtagttgtttatttttatttataaatttaaaaatttattttttaatttttattttattttttgtttttttttttaaaaccagaacatttactgcatgactaattgttgaaattcttaagctgatcaaagtgctccaacagctgccctctttggtttaggtgttgtttcctcacggagtccatgcctgaatctgtggtgtacaatttttaggtgcctcgttcggccagtcctggtggcattttgtcttttagccttggcactccagttatacgtcctcctgcacttggcggggtagccacatttgccacaggtcaacttctgaaggtggtaggccttcacgccacagcggtggcacaatgtgtgtgtcctattgcaacactttccaaacggtcatctcacttctgtggctgagaccagagagacctttttaatttttttttttgagacagagtcgtgctctgttgtcctggctggagtgtagtggcgcaatcataacttaccgcagcctcgaccttccgggctcaagctatcctcccacctcagccttctgagtagctgggtctataggcgtgtgccacgcccagctaatttatacattgtttttggagatggaatctcgctcgccatgttgcccaggctggtcttgaactcctgggctcaagcagtcttcctgcctcagcctcccaaagtgctgggattatgggtgggagctcccgcccacactcggccaattcagtagtttttaatacatctacaaagttgtgtagccatcgccactacctaagttcagaacatttttcatcaccccgcagccttctggactgagtggagtcagcatgctcaggggttggcagcatctgttcagggggctcgaggttcttctttggtgtcttttcaagtttctatacctgtccagtactgaagctggaattggagattgaccttttgtccaagtcataacttaatatgctatttcctgaaactgcttttaagaaatgttaaggtgcaaatgaggatccagtttgggcccacatttttctaagttggatgaagagcagttgagtggagtttctagttgcactcgagactctgtactgtgcagacagtttattggtggagttgcctcaggataaaaatacccagctcttctcagtagtgggtgggagactttgggtgatggtgatttccgtaaaggagaagctgagcctggttggaaggaaaaaggaagaatatacggagaggctggcattctttagctgagtggatttaggcttgagctggagtcagaatcacctgggaggcttgttcaaacacagattgctgggccccatccccagagtttctgttccagtaggtcctgggtggggcctgaggatgtgcatttctaacaagtgcccaggtgaaagctcacttagaggaagaatctcagcctcctggaagtgtgttctaattaacttcactggactgtaggctcagctttgccatccccataccactcatgcatgttttggtgtgctttggctacataggttacagttgagctttctagagcttttttctcatgtctttagctagtaggcacctaaaagttgtagaatgcataggttttatttttggcatttatctgaagtatctgttcatgtcttgacatataggaagctcttttaaagtttgggtggcagtggagagggcatatagaagcatattctaatttttcaatgttttttgaaagggtagcatgaacaatagtctccccactccttcttcatatccgtttggctcaagtagctgaaaacagcagaaccttaaagctgagtgtcacagtctgcctgcctacctgcctgtctacctgtctacctgcctatccagctacctgcctacccaccttcaagtcttttcgaatactgcctaccccaggtttctgatgataaattctgttatcttggtaattatgaagttattttgaaggttttaaaagaagctcctaaaaaataacctaagttttacagtattagtgcttttagaaagctggaaaagcaagtgaagaaacaacaaaaagaaatcctttctagatggatgagaaaccacagatgggttggggtgaatgcgatgaaatagaaatgtgtgtttgggagagtgttttctctgtaaggaagaatattctctgtaaggaaggcaggctatgtggctttcatgaggtcttcttagaagcttctgtggtaatgttcactggtctggcgaagggggtagacttgaaaaaattgtaaaatggcgagaacctggaatttacatttggggagaaaagaaactgggaggcccttcagctctggggaattggacaaggtgaagcagagtccacatgtgtgtgtatgtgtgtgtatgtgtgtgtgcatgtgcgcgtatgtgcatgcatgtgcactcatccaggtggggcgtctgcggtagcaccgaggtggattctgaggcaagcttcatttggccctgagttcattttattgtgactccaaaggagttcatgggggaaataaaggctctcatgtgcaagaaacaaggaagcagaaaagtcatttgacctaggctagaaaaggcggccacctctagtctatagtcagaagagaagcagctgttcagaggggctgagacaggtaatgctggtcccaggccaagcctcttgaggaaagagaacaacattccgaaattctgtgagtagctcataccctgaaggagttcttttttttttttttttgagatggagtctctgttgcataggctggagtgcagtggcgcaatctcggctcactgcaatctccgctcactgcaatctccgccacccgggttcatgccattctcctgcctcagcctcccaagcagctgggactacaggcacgcgccaccatacccggctaatttttttgtatttttttagtagagatggggtttcactgtgttagccaggatgggctcgatctcctgacctcgtgatccacccgcctcggcctcccaaagtgctgggattacaggcgtgagccaccgtgcctggcaggagttcccttttaagatcgctgtaggaagagtcagaaggtcaaggacaaggcgccgaggtgcctaccctcttagtactttgtgttggggagtggaggctgtccagagaggctggccaaggggaggctccccctgggaagatggggatcttttttaggtggtgctgcaaagggacactttttcagagagacaaggggaaaacactcgcatatatttacttctttagaagttgagaaagttaaaagaatgggaagatgccatctgcttcccatttctgagaaagggtacattaaaatagcttgaaattaagcagaatgtataaaattaacgtctgagtatagtcatttcccgtttttcctgacacatctttcagctgtgtagcaacagatccgcattcctggtgtcagaagacagttgttaatgtgctagttaaaattttattttatttttgtactgttgagcaaaatttagacttaactctgttttatttaagaagcatttttgttaaatgctttaattattattaatcaaatttttttgtatttaagcagttttcaacaatctattcctcaagcaattcagagaacctgctgtgtggtgattatgtattttttatttcataaatgggggtagtgaggcataagtgttttggaattagcatttgtcatcatctaatatactgtgtaaattacatcttttcactgtgtattgtctggctgccactgctagactcttaagttccaggtggacagggatcttatgccaggtggacatggcatacatgtatgtatggcaggcactgttctaagtatatacaatagtccctggagtgtccagggactgttcattgaatgaatgagtaaagacttctgtcaacaaatatcatttagtctagtgctcaagtgggctgtaatactctgtttctgaattaaacagtctggcttggtgatagtcactgacagcaccaagcagatccatgggagctaccccagaaaagcttgtgatgcagaggagaggagcaaaatgtgcgctccctgtgtgcaaatggattcccacaaccacggaaggaagaactgcggcagacatgcttggttcttaatctcagactcatcagtcagggaattcactcctgtctaaggggcgagtgagggtgaggcaggaagccagcatgtcccctgtgaaggagctctttccaggtagaagcatgaagcccaggaaaggcaatttatacagcacatcaccaatagagagatggccaaaccactctgaactctaccatctgaagtgaacaatttctaattatgtatcttcagatttttttctttcagatttctttctgatatatgtatctacagatatttctctgtgccggtgtgggcattttttctatatttattaacccagaataggtttactgtacatgtagttctataacctggcttttctcttaatatgttatatatctgttaggcattttttgacagtgatccacagcatcatgtttgtttcttgattgactgagacagattctctctctgtcacccaggctggagtgcaatggtgcgattatagctcactgcagcttcaaattcctggacccaagagatcctcctgcctcagcctcctgaatggttaggactacaggcatgggacaccatgcctggcaacgttttttattttttgtggagacaggatcttgctgtcttgcccaggctggtcttgaattcctggcctcaaatgatcctcttgcctcagcctcccaaagtgctgggattacaggtgtgagccatcgtgctcagccaacattatgtttatcgactgtttattaatgttccatttaattttggctgggtatggtggctcacgcctgtaatctcagcactttgggaggctgaggcgggcagatcacaaggtcgggagatcgataccatcctggctaacatggtgaaaccctgttcctactaaaaatacaataaattagctgggcatggtggcatgtgcctgtaatcccagctactcgggaggctgaggcaggagaatcacttgaacccgggaggcagaggttgcagtgagtcgagatcgtgccactgcactccagcctgggcgacagagcgagactctcttaaaaaaacaaaaaacaaaaaacaaaaaacccccccaaaattccatttaatttaatgccatcatttatgcattcagcaatatttttgagggcctactatgtgccaggcactagttggagttgctgagggtataagatgaggttccaattctcatggagcttatcgtttagagggaaaacaatacaaaagtaaacaagtaggtgaggatttctgagtgtgctaagaacaaagtagagcagggtactgaggtgtgagcacatcagtagatttcgtaggaaaggcctttcttaggaagttatatttgagctgagaactgaatgataaaggaaagccagctacttgagtatctgggggaggaatattctaggcaaaggtaatagcctgtgcaaaggccctgaggcaggaatgtgcttgctttgaggaaatgtgaaaaaaaaagttgttgattggaacagtgtggggatctggcagatgagctgggtgaggtaggtaagggctagatcttgttgtgccaagtaggcataaagagttgagattttgggtcgggcacagtggctcacgcctgtaatcccagtactctgggaggccgaggtgggcagatcacctgaggtcaggagttcaagaccagcgtgaccaacatgatgaaaccccatctctactaaaaatacaaaattagccgggcgtggtggcacatgcctgtaatcccagctactcggaggctgaggcaggagaattgcttgaacctgggaggcagaggttgcagtgagtcgagatcgtgccattgcactccagcctgggcaacaagagcggaacaccgtctcaaaaaaaaaagagttgagattttgttttaagggcaacatgaagttattggaggatgagctattaggaagtgagcaacataatatgaagctttatgttcaaaggctttcttggctactgtgtggcagtcaggggaagcagagagaccagttaagagtctgttgcgataactggtgatcttggtaagaaatgacggtgggggtggagggagtgagaagtggatgtatttcagaggtggagctgtcaattcatgggattggatgtagggggtaaaggaaaggagaaattttgtggcctcagctactgcgttggtgctggggctcgtcagtgagacaaggaagtggagattaagagtgttcttctgggatgtcctggttgtgagatgtctgttagacaccagagtgatgatgttgaataggcaacttccataagtctggggagaggtcctgtctggagataaaaattggagagccgtcaatgcgcaggtgacatttaaagccatagactaggtgagatcacctgggatgcagaagatagatggagaaagggagactaagccccgagcagtgcaggaggagccagcacaggaggctgcaggggagccagggaggcagtgctgaggcaggcaggtgtgaagtggaagccaggagaaggacatgttttaaggagggtgcgtcacttttatgtttgctactgtaaccagttatcacaaatttagtggcttaaaacaacacagatttcttaactgttctgtaggtcagtcatctgacatgggtctcactgggttgccatcagggtgccagcagggccatgttctttatggaggccctagagaggaatctgtttccttgtttgttccaccttctagagtctgcttaatgttccttggcttgtggctccctccttcatccttgatgccagcgacgtagagtctttgtgaccctgctctcttctcattcactcaccctgacctcttctgcctctttcttccacttttaaggacccttttaattacgccgagtccacctggataatccaggataattttcctattttaaggtcagctgattaacaacctaaattctatcttcagccttaattcccctttgccttgtgatgttatttatttacaggttctggggattagggtgtgtatatctttggggttcctgttcttcctttcacagagggtatcacaaaggttactgggaagttggataaaatgaggacggagaagtcattgttggatttggtcaactgattagtaacctcaatgggtggttccagtggagtgttggtgcggtggcccaatgggagtgagttgaagagccagcgaggtgaggacgtggaggctacacatcttaatggttcttggtggcagttttgctttgaaggaaagtaaatagtggcaagaattacaaaggaaaagcacagaggacagctctgagaggatgaaatgggagacggaatgtggaacagaggttcagggacgactgctggaaggaaggggcattagtgtagtgtctactggaagagattaactggatgaagaacctggagtgaaaccaagaaatggtttatagggatggggacatatgaaagtgaaattcacagggttatttttaatagaacagcagaaggtactgatgactcctgttgcttgcgcctgggtcagtggacaggatccttgtcagcagccactacagggcccgcaagcccacctcagatgctgtcattccacgggtggtggccaaatctttgaagtcagtgtagaacctctgccctttcttcctggggagcctggatcagccatgatcttgcccagactcagcgccatggtggagggacatctcctttcctctcctgccccccaaccacttcccttacacttctgctcttctctcctcacccgctaaattgtaggcctgcctccatttctttctttactttgttacgttttaataacatttattcactccacaacatgctcacagaggtggaagaccaagttagtgcagacccattcattcctggacccagtggctctcaagtgggagaggtgctggtcttaaagggtgtttaggaacaagtgggcgtcatagtgagtgtaaaaacgccctcgccgtgaggctcagaagagccaggcctcctcctgctcctagtccagtcagtgctcctccttcatatgggtggttcgcagccctgctgcatgttagactcaccaggacagatttgtaaacatatcacgacctgggccctaccacaaactaattcaactggagtctcagggatagggcccaaactgaggattttaaaaagctccctaggagattctgaagtgcagccagggctaagaactacagccttaaatctactgttgactgctttcaaaagaagtcttcactgtgcttaaacaaattgtggttaaaagtaagcaaaagggccaggcgtggcggctcatacctgtaaatcccagcactttgggaggccgaggcaggtggatcacctgaggtcaggagttcgagaccagcctggccaacatggtgaaaccacgtctctattaaaaatacaagaaaattagctgggcatggtggtgcatgcctgtaatcccagctactcgggaggccaaggcaggagaattgcttgaacccgggaggtggaggttgcagtgagctgaggtcgtgccattgcactccagcctgggtgacaagagcaagtctccatctcaaaaaaaaaaaagaaggaagcaaaaggaaatctggaggggaacatttgtaataggcaagtggtcattattaaatgtacagttatattattaaaatgtagatcatttgaatcaactgacacgtctgaatttggattaaaactcctaagcagtatacggtactcaaagcttggtactggtagggcacagtttgttcatttctgtttttcacgttgccttctttacacttttttcctttctgaatagcctaatatgacgaagcagctatttgtaacatgtgggaattattttttcttcttttcctcccatagtctgtctccatctttgagctgctgttctttctacagcttaaggttcttagatgtccattccattccctacccagtcttggaacactgtgagatgagcattcctgataagtggtcatccaatttggaaagacagtattttacaaggtgatcagtttctgaggaatttcagttagaaaactttgtgtttttggtttggtcagggaaagatccagaaaagtgatcaagaggttagctcaaacctgatatagggagttctcagaatagagattggctgttaatggtctcttataattttttccttgaggatagttttattagtatgagagtaacttaaccatcctcattgtgcagttcttccgcctcagtctcccaggtagctgggattacaggcacgcaccaccatgccctgctaattttagtatttttagtagaggcagggtttcaccatgttggccaggctggtctcaaagtcctgatctcaggtgatccacctgcctcagcttcccaaagtgctgggattataggcatgagccactgcgcccggccccaaacttttttataattctctatgacattgacatactcccacaacagcttcagtataatttagatgcccttatacatctgcgtggccaaattaaaaaagacaccatcaggtgtcagcaagaaacagagcagggggagctttcatgtactgctgatgggaatctacattagtttaaccactttgggaaactagaattatctatgagagtggaagatttgcacaccataaagcccagcagttctactccttatgtatattcttgacagactgtatagctgtgaaaactaatgaattgatgaatattcaagaagtgagtaactctcacaaacataatgttgagagaaagaaaccagacactcagaatatatattgtttgattctgtatacaggttcaaaacaaaggcaaaattaatttatggtgttgcaagtcaggagatgtagttacctttggagagtagggaggatatattagcagggcttctggggtgttggtaatgttctttcttgatgacaggtgtgatacacatgcacacatacacacaaatatatttacaatttgtgctgtttcctgtttgtatataatattttaataaaaagttcactgaaatggggctgggcacagtggctcgcgccagtaatcccagcactttgggaggctgaggcaggcagatgctggagcccaggagttcaagaccagcctgggcaacatgacaaaaccattgcattacaaaaaaaaaaaaaaaaaaaatgcaaaaattagcccagcatagaggtgcgtgcctgtagtcccagctacttgggagcctgaggtgggagaattgcttgggcctgggaggtggaggttgtggtgagctgagattgtgccactacactccagcttgggtgacagagtgagagagaccctgtgtccaaaaaaaaaaaaaaaaaaaaaaaagtttactgaaatggtatatggtgtagagtagattattgaacagcagtgagaaatgagcaaaatacagctacatgcagcaccatagaagaagattctcacagaatacatacgatcagattctagttttctaaagttcaaagagtcaatgctaagctattgtttaaggacacataagtaactcgtggatatcagtcaggattcagtcagggaagcagaaccactgtattatgtaataagggatttattttttatagcaataagatattttacaactgtggggaaaagctggaaaaatgacagtctggaaggaagaattagaggaccagagaagagccacgaaagcacctctcctgaagcacctgtacgggtggctgagttagaacttgtgggaggctctgagaagccaggcatgagcagctgctagaacgggaccacaaaggaaagctgatgaaaaagtctatgaaaagctattacctctgcatagcaatcacttctctaggtctgctggccagcagctgatggtccaggggcttctgttcgctgacaaggccggcagttgggggaaaaagctagtgacagaagcagcacgtggacaagctggaaccctctggcatctccgtttatatctgctaccacctctaactacctcggccctcaggaagtaatggtggttttacttttcgctttttaaatcttgtccagattcagggaagggaatcctgagaaaattctagcctaaccaaattgagttaaaagctgcaatagtgatggttgcacaactctgtgcatatattaaaaaatatactttaagtgagtggactttatgatttgtgaattatatctcaataaagctgttatttacttaaacaaaactgccacatgttgaaaactttaaagaaacaatgttaccatggatgatttaagtgctgcttcttggagatatggaagtttcagtttagtaattgcttcttagcaggttgtatctatgttactctacactgctattctttggaaagctagagcgtagtaactaagatctgtttgttaatgacagacctcaaggtctcctgacaggtctgggaataagttttgaaaataggttaatgggatattgtattagtccgttctcatgctcctagtaaagacatacctgagactggataatttataaaggaaagaggtttaatggactcacaattccacatggctggggaggcctcacaatcatggcagaaggcaaaggagaagcaaaggcatgtcatacatggcagacgagagaatgtgcaggggaactcccgtttataaaaccatcagatctcttgagactcattcactaccatgagaacaatatgggggaaacagtccccatgattcaattatctccacctggccccgcccttgacacatgggaattattacagttcaaggtgagatttgggtggggacacagccaaaccatataagatacattttctcacttttcaccatgtatatttggttttaaaatttgaactaggatttctttacttatacttaaaagtaggttttacagattcattaaaactttcatatcaaatctgttttgataatctgagatattctcatcatctcaaactattggaaaatgcccttatctactctccatttacgtggagccacttttcatttgaatgtttgttatggctctttttattctctttataaggagacaattgcccaaataaagatatgcagctttcctgcctggggctgtagttgtaccatagtaaggaaatggatatgaaggttttttaaaaagttcaaaaacagagtagcttgtatcatttatatgcaaaaactagaaacatttttagctgtagttacgaagacttctagctttttgtcaactttttaactaaaaggagtcccaaaacacaggttatttctacatggattaaatttataataataaagaatcattagtattactaaaccatattgacagaattcttgctaaaactaggctagacagacaaggatggatactgaaggttgacactgaagacctagttgggaagaggattcagaggagcttggctagagtttggtcaaggagacactcttggtcagtatgtaagtctggctaattggaagtaaataaaaggcagccatagtcttggagggaagacagacataaaaaatgattgcaatatggtataaaaggtataatagaattataaagtatgtgtgtataagatgtatctgcggcaaaaaggagcagtgatggtctgcttgagcacatgaaggatggatttttttttttttttggagacggaatcttgctctatctcccaggctggagtgcagtggcgccatcttggctcactgcaacctctgcctcctgggttcaagctgttcttttgcctcagcctaccgagtagctgggattataggcttgtgccactgcgcctggcttatttttctactttttagtagagatggggttttgctgtgttggtcaggcatgtctcgaactcctggcctcaagtgaaggatggattttttttttaaaaatgacactaaagctgtattttgaagatgattagaaagtttgctaggcagacaaagagaatcagcaagaaaactttctgggctgaaggtactacgtttagtcaaactattaatacttcctttcctgtgcaaaggaacggaagaaggaagtagtttgagttgcttggataattcgctatggctagtttagggtttaaggagagagatggatgagttaaggttagagagtagcagctagatcatagaaggctatgtatgccacgttgcgtttaaattttgtttttttttttttgagacagagtcttaccctgtcacccaagctggagtgcagtggtgtgatttcggctgactgcaacctctgcctcctgggttcaagcaattcttcctgcctcagcctccctagtagctgggattacaggcatgcactgccacccccagctaacttttttttttttttgagatggagtccccctctgtcacccaggctggagtacagtggcgggatctctgctcactgcaacctccgtctcccgggttcaagtgattcttctgtctcagcctcctgagtagctgggattacaggcacgcatgtggcacccagctaatttttttttttttttgtatttttagtagagacggggtttcagcatgttggtcaggctggtcttgaactcctgacctcgtaatctgcctgcctcagcctcccaaagtgctgggattacaggtatgagcctccgcgcctggcctaagatttttatttctagtagaaaaagagtttcaccatagtgaccaggctggtctcaaactcttgaccacaggtgatccacccacctcaccagtgtgccaggattacaggcatgagccaccacaccagcctgggtttacattttaacagatttttttgttgttgttttctttgaaggtctcactctgtctcccagcttgatcatagctcaccatagacttcaactccttggcctcaaacaatcctctcatacctcagcctccagcgtggctgagaccacaggggtgcaccaccatatctggctaatagttttatttttattttgtaaagacagagtctccctacatttccccggccttgaactcctagtctcaagtggtcctcccgtttcgtcctcccaaagtattgggattacaggcataagctactgcatctggccttttagcacagtttaatcagaagaggaaaatgagcagatttttattttatgcagttaccctgtggaccatgtagagaatggtttggaagaacgctgggagtctggtgaggaatccatcccagaggtagtaactaagacctgtttttagacattggcagtagcgaaggatctgacttgggaggtagagttagtagcatttatgtgacctctaagacgtgatcctgtcacactttttctctactctgttaggttcagtacttgagggcctttgaattaaactgacagatgatagattagcaagagaaaaggtagattttaattttgtaaatacttaggggagttcacaaataaatgtgactgaaaagagttgttagaatttggggtttatgcaccatcttaatagatgaagaggagagggagaaagggtacttccgggaaaacaaagaactatttggaaagataaatgggctcataggagaataaatggaagctgtatattttcgtgacattttctgtttggttgtcttctcatctcagatgattagagttgcccctgtgggaaagggttcatgacaattgagttctttgagttcttttgggaggctctgcttttaggcagataaggggtttcaggaactcaaatgccttcagctcaaaataatttttatgctatagtggcttattctggatcctttcacggtgaaggagaggagaaattcctgagattctggtttgagtgatggtggtactgtagataatgaaatacataaagaagagcaggtttcaggacatactgtattttcatttgtatggttgagcttggagcacctggggaacatctagagatcctagaaagcagttggatgtagatttgggacctagagagagctcaaagaagctgagagtacggataaaattttccttggagagtaggagaatgagagaagaaagagcttccagaaatgaactgaaggaggctggaaaatgagagaggatgaaatgagagaggggacatagaaaggaaattgagcctacaaaggagactaagaaggaatagttgaagatgaggggagctgggagagttacagaaaccaaggcaggacatagtagcaaggagactgagcaatagggatcagcagtgccaaggtgcagagtaaaattatagaagtgttaaggaaaaaaaaaattatatatatatatatttagtatatgataaaggtacagttttgaggaggaaatggagggctgtttatttaaatggacatttgggacaattggcttaccacttaaaaaatattaggttaggccggatgtggtggcacatgcctgtaatcccagcactttgggaggctgaggcaggaggatcacttgaagtcaggagttcaagactggcctggccaacatggcaaaaccccgtctctactaaaaatacaaaaattagccagatgtggtgacgcatgcctgtaatcccagctacttggcaggctgaggcacgagaatcacttgaacctgggaggtggaggttgcaatgagccgagatcatgcaactgcaatccaacctgggcgacagagcaagactttgtctcagaaaaaaaaaaaaaaaaaaaagttagtttaggtccccacctcatgccttataccaaaataaatctaaaaattaaatgtagaaattgaaaatagtaaaaatattaggagaaaacgtgggtcaatacttactttgtgttcaagttaggaaggaccatacccattctaattataacagaaagaaaagactaagaaattttcatgtaaatccagcatgtctgtgtgctaaaaatatcataaaattaaagtgtaaatggcaaactaggaaaagtatttgccatagatttgacaggcagaggtttaatatccttcatatctaaatgatctatcaaaaaaatgaataactgaaggtttctggttaagtaggactcattgaagatgtctttatcttccatccttccaaaattttgataaaatgacaggaattacagaaggggtagacccacaaagagtgaaaaagggagagtagggaagatttttctggttgatgatagactaagttgttgggccttatttcctgctgagagcaagtcgagatgatggacaaaatttaaaacaaaatttatgtgaaggaaatggagagttaacaaaatagtgaagatttgtgggtgtaagaggtggggcgtggtgatgaggtagggaagcccaagatgtgagaccagcatttgcagtcatttctttcccagaggaatctgctcattccagaagaattaggcagatgagaagctggacggctgaacagagtttttgttagactcagagggcggaggacaaaaattggagtttggctcagatcagggagcaggaaaacttcttaggctttgagtaggagacccaaaagcctatatcttagagatagtagctcctaacaggtattgaagtccagctccagaccctctcagttcctggctggatcaaggtgttctggaaagaagcaagtataatttctttcattaatagaagaagataacatcactcagaacctcagatgagctctatgtttatttacaatgtttggcactcagaaatcaccaggcagatgaggatttaagacaatgttactgaacgccaagagaaacaacagactatggaagtggatcgacagggatccagatagtgaagttattagaaaagggtaaggtatgtagtatgtttacggagttaaaagattaagaatagggaaattggaaccacaccaccccctccccagtagaaaaaccaaatgtaaactgtagagttaaaggactgtaaatgaaattaagatgtcagttaatgggtttagcagtacattagtaataagtagaaaacaaatgttcagaatgaaatatggaaataaaaatggtctggacatacattatagagtgagtcttagggattctgtggaaaggtctaaccaacatgtaattgaaatcctagtaggaaaggaaggaggagtgctgcagaagcagtatttggagtgatgatagctgagaattgttcataacaggcaaaagccatctcatcacagatttaaaaaatactaccagaaatctaagataaggagaacattttaatagtaaccagaggccaggtgcggtggctcactcctgtgatcccagctctttgggagactgaggcggatggatcacttgaggccagaagtttgagatcagcctagccaatgtggcaaaaccccatctctactaaaaatacaaaaattagctgggcatgatggttcatgcctgtaatcccagccacttgggaggctgaggtgggcagatcagttgaggccgggagttcgagaccagcctggctgacatggtgaaaccctgtctctactaaaaatacaaaaattagccgggcgtggtggtgcacgcctgtaattccagccacttgggaggctgaggcacgagaattgcttgaacccagaaggcagatattgcagtgagccaagatcccaccaaagtactccagcctaggtgagagtgagactctatctccaaaaaaaaaaaaaaaaagtaaccagagaaaaactacgtactacattgaaaagagcagtgagattgacagctaatttctcaatagatgtaatagtgcatccttctcagaaggcaatgaactaatgttttaaaaatgtaaaaaagaaggtaaacagccaaactagaatgttatacccttcaaaagtgaggacaaaattatcacttctttagatcaacaaaaatgagaaggatttaaaagaaaaagccaaaaccccaattctctttcttctacactcacaaaacttctcataccaaatgtgtagggtttttttcataccaaccaattctccagttctctgtggactccgggtattctgcaatttaactcaatttggatactaactgcctggaattacttgcttcacaggttgagagcttggcctcacaagattgcttagaaaccaattgcaagtccaggtctccgatatttcttaccgactgctatgaagtgattcctataaccccctcctcagattcagtgatttgctagaatggctcacaaaacagggaaacatttacctaggtttacctgttgattatacagaatacaattcaggaacagctaaaagagagatgcatagggcagggtatggggaggaactcagaacttgcacaccctctccaggtgagtcaccctcccagctcccctatgtgttcaccatcccggaagctgtctggactctgttgtttgggtttttatggaggctctattacgaaggcatgattgatcaaatcattggccattggccgttggttattgaactcagtctctaacctctctcccttcccaggaggtggtggggtggggagcagagtgacaggggatgaaagtctgaatcctctaatcacatgattggttgctttggtaaccagtcgccattctcccgagagtcctctcatcataaactcaggtatgtctgctcttcttactaccgtgtttcagggctcaatgccaggaacttgaaatgaagaccaaatatatgtttcttattatatcacagtatcacagagttaattacaccagacctgcactaaagggaataatagaaagattggtctttggcagaagagaaatgatcctgcatggcagctttaagatgcgtggaaaagtgaagaccaaagaaaggagaaataagatggtaaatgtaaatgaacactgttgggtaaaataattatttgtggtttaaaatacacatagaatttaaaaatatagtagtagcatataagttgtgggggtgttaaataaaagttaatatcttacggtcttttcattgcccaggaagtggtaaaaatattaatttacttgagactttgataagtcaaggacacatgttgtaatctctaagatagtcattaaaagagtagtaaaatatatgtaattaacaaattaatagaggggaaatatggaatagtaacagcagtagtagtagtaaaacttgattaatctgaaagaaggcaagacgaccaaaaacagaaacagagcatgtgggaaaaataggaagtgaacagtaagttgttagatttaaacttagtctatcagtaattatattaaataaaaatgaaccaaaatttctaattaaaaagcaaagattgggaaattggataaaaaatcaaagcagatcacaactctgtaccgctttcaaggatgtagaaaagttgaaaataaaatggtagaaaagccatattactcaaacattaaaagaaaactggtgtacctttattaacaaagtgggctttagggtagaaataattgcttgggataaagacatacataatggtaaaatactcaattcagttctccaggaagttacaacagttctacctctgtatgtacctaaaaacactatctcaaaatacataaagcaagaattaacaaaaatgacaaagaacagacaaatctgcaattcatagtggaaagttttaatataccgtcttcattaactcagaaacaaagtatcagtaaggacatagaagatttccataacataatgaacaaacttgacctaattgaaatctcagtgggtttatgtgtaatctagacgtactactgtcctgtgcttcataacgatgtttcagtcaacaagggactgactaaatatatgatgctggtctcataagattttattggaactggaaaattcctgtctcgtagggatgtcatagtgtcatagtgtaacacattactgtttctatgtttatatgtgtttagatacagatacctatcgtgtcacagttgcttgcaatattcagtacaataatacgcagattcatagcccaggggcaataggatataccatatggcttaggaatgtggaaggttgtactatctaggtttttgtaagtacatctttgtgtaagtacgtttgtgtaagtacattgtcatctttgcacaatgatgaaatagcctagtgatgcatttctcagaatgtatccctgttgttaagcaacaaaagactgttgaaaataagatacattcaaaatgaaatatggaatataatgaaatatgaaatacaacactgcacccaataactgtagactgtacattcttttcatatgcatagggaacattgatcaaaattgttgatttatagagtaaatctcaacagatttcgaaagactaaattcagaatatcatacttacaaagacaggtttaatatttgaaaaattgatcagtataaatcactaaattaatagagtagagcagaaaaatcatgtgataatgtcagaggtgcaaaaattgcctttggcaaaatccaatacccattcaaaatggaatctcttaatacattatgaatgaaagttaacttccttaatttgataaagattactcagaaaaatcctatagcaaacaccatgtttactggtgaaatgttggaagttttcttttgagacagggaaagagaagttgttttcactgtcaccaattctgtttattattttactggaagtcctacctagttgagtatggcaagaaaaatagtacagggatgagaaagggaagaataaaactgtgattttgtagatgacatgattgtatatgtagaaaattaaaaaaaacctctttataacttattataaataataagctaggttgcaagattcaaggtaattctggacacaattgcaattttatatgccaacaacaaacacaaattccaaatttgtatcaatctggatccaatcaggagagagaaaccagttgtattagtttgtcctcatagggctataaagaaatacccaagactgggtgatttataaagaaaagaggtttaatttgttcatggttccacaggcggttcaggaagcatggtgccggcatctgcttggattctgggggaggcctcaggaaacttacaatcatggcagaaggagaaggggaagcaggcttgtcttacatcgccagagcaggagcaagagagagagagaggaggggaggtgctacacacttttaaacagtcggatctcctgagaactcaatcatgagaacagtaccaaagggacggtgctaagccattcgtgaaggtgcacccccatgatccagtcacctcccaccaggccccacctccagcactggagattacagtgtggacatgagatttgggtgtggacacagattcaaacttcatcaccagtaaattgaaagcagcgtttaatgtggataattactaattataacagggaatcgaagtaaggagggatttggttaggctagtgaaaagtgaagagaattgtaaagaatatgaaaatagcagataaacagagcaactgctgcccctggggctgaggtagagtctgcaaggaagagtctctccttcccccaggaccaagatccagacctcatccagagagggcatggctggtttactgcatggccaagaagttgctggcatgtcatactagtggaacttaatggaaatccaccctctgatacctgccagaagttgctcactagggcgccacacaaaagctcttcatggggaggtgtctcactggaggtaccctgctacaaaacctccagagtgggatgctggggggagctgctggctgctgggtatggcctgctgttgtgtgctgtagtctctggaggctggagcagctgcaggtgcttgtagagatgggtactggagaagccacctgcgttgcaggagctggacgccatacaattaacacaatgtagagcaatctggaaggctgtatatatcaagatggccaagatggaaccagtgtttttttttttttttctctgtgacagatagaattatgatgcttccccctgccgcttttttttttttttggtattcattcagcatttatttaatgaatgttgagtattttctctattccagacaatgtgtttgttacgagatacataacagcagacaaaatagacattgaacttgtttttgcagtttataggctgataggacagtcagtcattcatctgagctcttttgtgccaggcactattctagtcactggggggatagatggatagattaaatagattggttagatagatgggatggatgtatggatagatagatggatcaagataaaatcttgctttcaaagggagacagccattgagcagataattaattataagaatgggtacatacttacacagtgctataaagggtgtaagaaggaaaaatacaggctgctacaagagaggacaatgtaattcagatgagaagccagggcagacttctcttagaaagtgatatttttatgatgaaagtgatgaggaggaggttagcttggtgagatgagtgatcagagaagaatgatctagatggaggggaggcttgcgggcagacttcatgatgggaagagctcggcatgtctgaagtgaggagtgggaggtctctagagggtagggggaggtagagagtggcaggagaagaggccacagcaggggtcatgctactcacagccataggccaccttggaaactagggtgtccctgtgaagggttgcccgtgatagaggtctgaaataggagattcttggactgttttgctatttacagccaccgtgtggggtgctgagtggtcaggggattggaggcaagaatggaagttgagagaccactgggtgcaatttgcaggaatccagtgaaagttaacggtggaggtggcgccaaggcccagcagtggagctggagataactggatggcttggagatggggtttggaaatagagtcattcagaactggtgatggattgagtgtgggctgggagagacagggagacattgagaataactcccaggtttctggcttaagtcattacatggcatgtgatgccattttctgtgtacttttgtagtgaatacgaattacttgttcaattaaaaaagtaaaataagtttggatttgcagatgaagaaggctttggtgaccaaacaaacaaaaccaaagcagttgcagtgaaagtgaagaggtggagatagttgctacagactactgcagttctgcatcttcaaagaagccagaaagtagcaggcaaggtagggtcgggctgtaggacaaggacatgtgttttgtttacagagtaggatagatgtgagcaactttcattgggagagagagctagaccatagagggaagagaaggcattcgttaactcaacaaatatttgaatgtctgtatgacaggcaatactctaagctcttggaacatacaaaacataaaaaacattcctgtcttctggagcttaatgttctaaagtggggacactgaaaatcaaatcatgtgccgagtgcactgtaaaaagaaaaaaaaagcctattaatggggagatctagggatgttgaggtgggacggccagaaggatgtaattttatgttgtgggtggcactgatggatttgatgccactagaatgcaagatatgccagggcagagattttagttttactcactgctgcatctccagtttagaatggtgcctggcacatagtaaatgctcaataaagaattgctgtgcgaatgaattaatgattcaggatcccaggaatgggaaggaatgaggagtgggatactgaagaaagaaagataggccagtcataaatgaagacatattgtagggatgttagtactgatatctccaattcaaattacagttgtttttgcttttaaaggattttaactgttcaattgtattttgaattctttgaattagctttgtttcatggcattcattttgtttactgtatgtttcttagacacagtaatatagtttacagaactacttatccttagggacattacccacttaagaagtgactgttttcagtattattacaataaaattgagattacatatcactttgtatattgaggttctgttacaacctgtcttttcagcattatccttaaagtggtgtgtgtggtggtggtggtggtggtggtggtggtgtgtgtgtgtgtgttggggggggggtgttgtgattgttttatgcccattacagaaaccagtttagccggcattatactggtgtggttatatattaaataagttaaatttcttgcagctactcttttgatcagttaattggtctgatcctatagtgggtattttcatgggtctctgctaagtttagcctcacaatgattttgtgtgtctgaaatcgtattgacaggctgtagctccttctaatttatgcatgcgtgaagaagattgtcctctatttgctgagtcttatgcttttatatgaggaccccagtgtcgtaactttgccataactcaggaagatctaacttctgactgtgcagtatagagcattcctttgtctaaaaaaataatatggatgttttaagaccattcagtcataactggaagctgccttatagttaaaggactttacatattaatgaagaaagggaacatacaaatcattatgtcctttttgccatagattgctgtcccctcccatagaaattatcttattatattttattacaacagtgtatgtaaaatatatacttataaaagtaataaatggtctttgaaaaattctaataacaggagtgtagagattataaactgattttatcctaaaattgtacatcctaggagataaccattgtgagcaatttgatttatatccttttttggactttacaaatgcttgtgtaaatcgcgtgtgtgttgtatgtatatatgtttgagtgtacatacaagaggaatcatatacagcttccctgttttttcctccccatttatacaccatgttgtggacatttttgtgtcagtgcctgtgtgtgggtatgtgtgtgcataaagacatagcacgggtatgccataaaaagttttcagccaatcccttattggttgtcgtcatattttgctcttacaataagtgatgcacttaacatctccagttatgttctaggacagaagtgcttgtcagagtgtaaatatttgacatatgcccttagaaatgttgtaccaggccaggtgcagtggccactcctgtaattccagcagtttgaaaggtctgggcagaaggatcacttgagcccaggagttcaagaccagcctgggcaacatagggagacctggctttacacaaaataaacaaaattagctgggcatggttgtgcgttcctgtggtcccagctgctcgggaagctaaggtgggaggatcacttgagcccaggaagtcgaggctgcagtgagctgtgatcgtgcgagtgcaccccagcctgtgcaacagagtaagtccgtgtctcaaaaaaaagaaaagaaaagaaatgttgtagaataccaatttggactctcattagctaaaagtgagagcatccatttccccaaacccttaccaatggtaagtgttgtcagtcttttaaatcctttctcagcccaacaggtagaagactcagatctccttttaatttacatttctttgtatattcctgcaatttagcatggtttgaccatttatgctatttttttggatatgttactttttataatagtcttcagtctttttttctagtaggttcttcgttctttttctttctgatttctgtttttcttttaaaagaagtatgtataatatttctccctttagtcatctgtatttcagtcttagttttcttaactcattatgtcctcatgccaatcctatgagtcatgctcccaaactctgaatctttttggccttgatggcatgtgtacttggtctttcccacaccagtaattaagtattctccctagattttcttctttgttttgaatttttatccttagatgtttaatatagctgaactttttttatatgtgaatgggatgagttagagctctaatttcatttttctccaaataagatggttattattgagtcattgatcattttctactgatttgagatgttgccattaccatgtgctaagtttccacaaatatgtggttttttacctgaactccttgttcattgatctgtttattctgtgcctacaaaattaccacattgttttttctttccttatacactgatttagtttttgtcattctaacatattgtaaagaggaaagtattgctcctattctgttcttaaaggtctatcagggccgggcgcaatgactcacacccgtaatctcagcactttgggaagtcgaggtgggcggattacttggaggtcaggagttcaagaccagcctggccaacatggtgaaaccccatctctactaaaaatacaaaaaattagcctggcgtggtggtgcatgcctgtaatcccagctacttgggaggctgaggtgggagaactgcttgaacccgggaggcagaagttgtagtgaccccagattgtgtcattgccctccagcctgggtgacagagtgagactccatctcaaaaaaacaaaacaaaaaaaccaaaaaactgtcagaagtggagtgtgacttacttttttttttttttttttgggtcagagtcttgccctgtcacccaggctggagtgcagtggtgtaatctcaactcactgcaacctccacctcccgggttcaagtgattctcgtggctcagcctcccaagtagcaggcacatgccaccacgcccggctaatttttgtgttgttggtagagatggggtttcacctcgttgtccaggctgttcttgaactcctgacctcaagcgatccgcccgccttggcctcccaaagttctgggattacaggcatgagccactgcgcctggccatggagtgtgactttacagtagagattcatttgtctaacatctctgttactggtttcagtaagatcacatcatcttttttgtcctttggcagcagaagttgtaggttaacgaaaactaaagcaacttttcttgtcactgagatggaattgaaatgatctctaacccatacttcttcagccatgacttctcacatcttagaacacattaaaaataagaatatttgtaggacgtactggagaatgaatgagtatccttgaggtcagaaaccactggtcaggggttagcgtggcttagttcccctcacaaggcacgtgtaacccatttacattgaactgcatgtcagtagggaagtgtttaggaagtgctgctgtaggctaatgttcttcaactttaaaattttctcatgacacgtcattgtagcttgatatggattggccaaactgctttaaaaaatttttaattgtggtaaaatatacatatataaaatttgttgtcttaaccatttaaacattcacattgctgtgcaaccatcagcaccatccatctccagaactcttctcatcttgtaaaaccgaaactctgtacccagtcaacagtaactccccattctccctacccctcgcccccggcaaccacccttttactgtctgtctgtatgaatttgactattctaagtacctcataaagtgaagtcatatagtatttgtcttttttttttttttttgagacggagtcttactctgtcacccaggctggagtgcagtggtgcaatcttggctcactgcaacccctgcctcccgggttcaagctattctcctgcctcagcctcctgagtagctgggattacaggcttctgccacaatgcctggctactttttatatttttagtagagacaggatttcaccatgttggccatggttggccaggctggtctcaaactcctgacttcaggtgttccacctgcctcggcctcccaaagtgctaggattgcaggcgtgagccaccacgcccagcctagtatttgtctttttttgtgactggtctatttcatttagccttatatcatcaaggttcgtccatgttggagcatgtgttagcctttcctgccctttaaaggctgaattcgttatgtgcacaccacattttgttgatttgttcatccatccatgggtgcatgggttgtttcagcctttgggtattttgaataatgccatgaacataggtgtaaaatctgagagccagacgtcttgaaagagttttgttttttttctttcattttttaactattccaatttgaatttagcttccattattccgccaaaccttctttcttagatcactattaagtagaaggaacatttttcctttttaatgatttttcagacatactcacccactttggctgtgccatcctcccttggctcttgggatggtgcatgccccctgtttctctcccacttaggagatttcctttgtgaccctcctctcgcatcatttaaaggtggaatttccccagagcttgaccctgggccttctgtctgtgaccattaaatgtgggtatttctcagcaattagagcgaggctcttttcttttcccttgttttggaaagaagagagtcaaaaaagcttaatcaaataatctcatcttttacccaaaaaagataactattttcttcgggaaaaaaggtgacaagaatataaatcatcagaattacactaatttgtttctgaaggaaatgataaactttcccccagctttgttgaggtataattgacaagtaaaaggtgtatatgttcaaagtatacaatgtaatttgatgtgtgtgtacattgtgtaatgattagcacaatcaaccagcacgtccctcactatacggtgttttactgtgtgtgtatggtggaggagaggagtgaggacacttaagatctgcttattaatttgcttagcaaatttcaaataaacaatacagtattattagctgtagtcaccgtgctgtacattacagccccagaaaatattcatcttataaccaaaagtttataccctttgaccaccatctccccattccctccccaacccctgtgagttcaggcccttctctatattccttcttattctaggtgacccccatctgcttacagagatccaatctgctgatggctcctaggtttgtttcatgaggtcagagctctttgctgagccccactccagagctgcctccttgctgtctatgctgagtgtctgatgggtgctccagcctcatgtctgagatagagcttcatgattttcctcccacgtccccttccgtgttctcagtgaagggtacttgagcctcccaggcgatcaagtcaaatttcagggatcagttttaaagtaaactttttaatttaggatagtttcagagttatagaaatgtctgaagaatattaaggagagttcctgtgcactccacacctgtttcccctgctaacattactgtggtacatgtttcacaccagtgaaccagtaccaacacattatttacactgaactctacacttcattcagatttccttaattttcccctaaagtcttgttctttttcagaatcccattcaggatgccacgttacatctagttgtcatatatcttcttaggctccattagactgacagtttgttagatttcttcttgtttttgttgaccttgacagactaagtattttatacagtgttcttcaatttggatttgtctactgtttttctcgtgattagacttggataatgggttttggggaaggaagaccacagcggcaaagtaccattctcatcacatcatatcaagggtacctgctctcaacatgatttactactgatgatattaaccttgatcacctggctgaggtagtgtttgttagatttcttcactgtaaaattactgacatttttgacactttcctcttctttttatctgttttgaatccaaaacaattcctgctggttctttttcccaaataaatttccattctgtccaagtcactctttgcagccactgctgcagtccaagccacaattgcctgtgcgcagacggtattgagcgatcttctgactcatgccctgcttgtgcccttgccttctccagcccagtctccacccagatgccaatgtggtccttttcaaatgccagttggtcagtggtactcttgttcccaagcctttgagcggcttcttgttgtacttgagataccaccccaccttctagacacagtctgccaggcctgcttaagctcgtctcttgtcacctctctcatctcctgccaagcccctctcgccttgtcctctgttccagccaccggtttcttgcccgagtcccttcaacactctcagctcccttagacatgtcgttgcctctgcttagaatgatggtcgccctccaccttggttcccttgggaccccagcttacatgccatttacatgttgtttcttcaggggacatttcccatccacttgcagggtccatggggcactcttgctgggtgtttctggagcatgccacactgtacccctgatgctgggagttacttgttctatgtcggaattgttcctcagtgctggggtggacaaggctgagacgtgcctcggcatgtcactgtgtgtccctgttacctgtactgagcctgtgccagagtggatgcttgataagtatttgttgactgggtgaaattttttaaaaattaaaacatttttaatagaaatggggtctcactatgtggcccaggctggtctgaaacttctgggctcaagcagtcttccctccttggcctcccaaagtgctagaattacaggtgtgagccaccgtgcccagcctgaatgggtggattttatcttttgaatggaaaacactcttcatttttagcatgccagtatgcaaaaaagtacttgaatttatttttcttagtccattgatttaaatcccacatgtattcttttaaatctgtcacataaggtgctgtggtgggtacagtagtggatctagaaagtgtgttcagcctctgccactcctgagggcccattcattcattctctcattcaccagacagttactgggaacctgggtctgccaggcctagtgcagagtgtggggttatgagggcttgtgagtgagcctgttgagggagagggagaaacttatagatccttcagcatttccagttgtggttaggatagatttgggcggatttagtttgaattctggctctaccatttttaagatctgcactcttgagcttaacctctacccgtctgcaaaaatgtgggcagcattgtctcccttgtaagttgtggaaagaatcagctaagaaaaggaatgtaagaggatcagtataatcatagtaatcacagaactaatggtttttgcctttgaggtcctgagtactagcctaagtagttacattaattatttttgtttattctcacagcaactctgtgaggtagggatgttactgttctcatgttgtaaatgaagaaagtgagaccttagttgaaaaattaaatactttgtccaaggcacagaagtagtaagtgggagagctataacctgaacccaggttcaaggacggcgtgattttaaagcccagaaaggactccttacattctgtgtagctaccccatcttccagtgtggctttattctttaaagttgtaaagactttttaggtatcttggcatttaaaaaaatgtaatagtctttagagggacgattaccttaagctattatcaacttgaatttgtttctttattcacattttagcagctttgacatctgtgacttggtgcctgtgttgaggagagagggtatatgttgggactggaggatgaagtttgaagttagacccatctgggcagtatttatcttaaagtgagaattgtgaacttgtaatcagactcacctggaagatttatcaaaaacgtaaattccttaaccacttctttggtaccccacattataatctcttaggggtaggacttagaaaacatttttgcaagtgatgttatttagatagtggattctttttcattctgaagtttgagaatcagtgaatagagggaatgggaaatgtcaactccttgatgatccagactgccctacaggaagccagtggaaagatgaaagtgaaccctggtatgcctggctagtaagtttaaaaacaagtaatgtggaaataaaatcaacagtcggtgaatttgtctccctgttgttttactttttatattatttgtgtttgggaggaatttgatttgtattttatgatcatttttccctagtgggtagtggggtagcacgagaaatgagtgggtctagactatgatagagttggtgcaatgcagcaggccaatcggaagaaaaaaatttaagcatattttgtggattagcatgtcagttgcaaaaataggagtatatctaaagctgatttcagatagtctctttttagcgaaactatgtcagactgtgcccggacttttgctttggaaaatatggtaatttcaggtttgtggctaatttgaaaattagtaatcaatactaagggttttaaatatgtagcatttatgtgtttattatgtatttctatattcataaacattgaggattcttttattgtctcatgtaacaagaagacaagcagctcagggatggcggctcccgtgtgcttctccatgatctctcagcttcctttgtgtggatggccacagcatggctgcgtgcctaaagcacgcggagagggcagcattcttgtctcaggctccccacccaccattcttaagcagctttgttgaggtataattggcatactaagttgtgcattgtcttgtacattttgcaagtgtgcatctgtatacaccgcacaaccattaccatactatgataatgagcatgttatcactctccaaagtttcctggtgccttttgcgattccttctgcccacccttctcctccttttgtgaaagctttgatgtttttagggaaaaaaaaagttacattattgaggataaaatactaggtagaaagatatttaacttgtagttttcgctttttttttctttttgaggagtattgtggaaataatatgattgtaggtataggttgctgtaatatttatagaaagttttgagaaacagattctctgaacagaccatcttggaagagtttgacaggaaatatattttcggaaaggctggaatagaggtggagatggtgcctgctggcaggagagggagagaaagggaggacagcacctgccggccacttgcgggtgagctacagacatgaaagccaaaggctgcgcttttctttggtttttcaatagatggcatttttatcatgctagaaagactaacatgaattctaacatgaaatggtaataaaaatgtaatccccactaactgtagtgtatacatagctcaagtgcatttttttgttgttgaatggcatgctggtgattgatttatttatatttatagattaaaaataataaactttgctctcattgtaatcacctctttttttttcttttttttccctcccccagagactgggtcttgctctgtcacccaggctggaatgcagcgagtggcacagtctcagctcactgctgcctccacctcctgggcttgtgttccttctgcctcagcctcctaagtagctgggactgcaggcatgtaccaccacacccagctaatgttaattttttgtggagatgggatctccctatattgcccggctagtctcaaacttctgggctcaagtgatcctcctgcctttgctttccaaagtggtgggattataggcgtgagccacagaagcgtgcctggcctgggtagttctttttaattgttgaatatacttgctgaggttagtttctgctgcagaaagcattatataatgttgagttaacagcgatcttgtaaagagttagtagaatgtgtaaagttttacctgggaggcggaggcagcagtgagccaagatcttgctactgcactctagcctgggtgacagagcgagactcttttttttttttttttaaaaacaaaacaaaacaaaacaaaacaaaacaaaaaacgactgtatagggttaaaaaacgactgtatagggttttattttaatgggtttcttcagctgtctccttttagcttctatgactctgcattttcttggctctttgtttttcatttctttacagttcttccatgtattttgttttgaaagtaatatgcctgaggtgaaaatggcggcatttctgtcatgatttaaccttactagaaatgacattctttgttctttgtctgtttagttgagaagtgaaccaattccctgtgcttaaagtactactccttggtgtggggcagggagggaggggggaagatttttaacatagaatacaaattgagtttgttggaaaaggtatccctataaaatgttgtccaggtagttagagcttaatatgggtgataatttccctagaagaatattctttgctgtaacactgatgacttgatggacttgtgaaagtgaaacttggtgtgtttcttctttcagcctccatgtaactcacagatagggcagtgtagagtagatttccagttttagattaaggatagcttgtatcctatgcaaggttttgggggttggttagggtctttgagtatttcctgtctaattcacttactagttacaaagagacaagctgtaatgtaaaaagtcttccttgagctagactagctttctgtactctttgatttaaaaatacctggtagttctgccagttggggatttgtttggggtgaatgaaaacccctcaggctcagtctgttcatgcactggtgtgtattaattcagtccattcatagtcatgagctgactgtgccttattgaagaaagggaggcttctggaagagagaggaagatggataatcttggatcctgaagcactgctgctggcgcctgggagtggggcaggaagacaggaggttctgaagagagggctttgtatccaaagttaagacttaggccagcccttgatggggagagaagctactcaggcccaataacctcaaatagttcaggttaaatcgacagttgtcaagtctaattcctctttacagcattatttctgtgggaaaatgtgtgtggcttatatacttgcctcagcaaacagaccggactcagaatcagctctttgttgtcataatttaagtggaattagttactccctagggttgcattgccccttggatggcttctagccttctttttacttattaaattatattccaggttccttgactgtgagggacatagtaaactcctagtagcctttaccttcccctccctaaatagcaaactcatgtagaaaacattagctaaaatcctttgcagatttttttgaaatcacctaaaatgttgttattggcaccatttcatttggagccattttgtcagaaccactaagtatttaggtgaggcgattgatttcattcccacgtgggaatttggttggttgtaatattcaggcactcagagcaattcctgcctggacgtcacgttcaggtagtctggtgtctgaaacttttggcagagattaagctgatagaagatttgggctaacattttttagtgtgtgagttggtgaattttcaagatgatttagaagactttaaaaaagcatctgtgaatactgcatcatcttgatgtcaagaagagattgttatttaatacatacatgttttagtaatgaaggaggtacatagagataattgatttgaaccggtttactttttcccctttttaatgcaaaatatttttgggaaacagaacttgactcgtgttacactactcgcttcttgttttttgttacaaacatgctgaaatggtctaaataatgatgctactaaaacaacgtatgcattgttttcatggggtgttgattccttctgcagtgttcaaaattacttgcatgcctccgagcaacaaacacatatgtgacagactttatgtgagatgagcattccagagaaatgaaatgcaagtttacttttcagtagctatgcaacttaaaaaaaaaacattgtgttttttgaaacatggctttagggcactaacactcggaccgagtgcatgagctctgcaagttattttaacaaaacctaatcacaggaacaaacatctggcatttatagagtttgtttatttattgattgccgtaagcctctagaaagaatattctgtttcttttaataaaatccttttggaagttgtctatattttaatatctaagtgtttttggaatttagttttaacaaggttaactcaaatgttaaatttattgtgggctacagctgaagtaggagaatgtaagaagaaatggcaagtgggaactcttgtaaaaagaatggtaactaagttctttttcctggttatgctcctgccatttactcttctgtatggcaggccatcatttacactgctttgtagaatctgctgtctagtaagcactaaggaatttggatccctaaaccagggagcatatagcctgctaaagcttaatttttagacaggagacactaaagatgattgtgttatgatactgttcattttatatactagtgaaatgaatactgaaattatttagtataaccattaattatagtgcttaccattactgcaaagtttgtcatgatttgggtggtagcttcatgtttcaaaacaaaaccataggtctatccttttaaaaaacataaactgctttagtttgttaatgggaaaagtgagtaaataataacacttattgatgaaatgaagcctgtcagatacaggaaaaacaaaacaaaaaacccttgtagatattcctcgtgtcaagcccctattaattctgtgtaattccagtagaactagcaagttattttgcttaaaatgtcttttttttcccctgtgcagtgaaagttgaatgtgagaccacatcttaatagatatagttacacggtttattttatcatgtatcactttattgctgtcttctagaacattgttatactaaatgttccaataatggaaattttatgcagctacttcaaatgaaacaaatttgcaaaaactcaattttggaactcattccttgaggagaggaaaaactcaccatgctgtgaccacattagatttctgatatgttggcaacttatcaaacactgtcatttccagaaaacaggttatggggtcaaattgaaatatcagcacttttggtcactttcagttgaagatattttaggttttaatgattgaatggttaaattaaaaaaaaattgttggtaacaggtaatgaaagtgtggttttgtatgtaaataaaaatggctctacacgacatcaggaatgatggggttcagttacagtggaatcttttcaagagcttgattttaaattctcagagatactagttttacttactggagctcctttgttttgcagagatcatgatgcagccgtccttttggatttctttttaataatgtgtgacccttcacctttgatcccctgacctgcattaccttggtaaccatttcattttttaatttaatttcattttttaattttggtgtacaagctgtaacatttcatctttcaaagtgtaacacgctgatttcctcaaatagagatacccctttgagtgataaatttgcaaaatgctgtcttcattttctgtattaaaattcatttcagttttaaaataaagtgtaatctgtgttttcatccttttaaaatttaagtttaatgagtgcatttccccatacagtatatttccttttttattcatgttttgcagaagctgaattaacttgatatttacgtataacttacacacacccaggacacccatacctcttctctactcccaaaccacccaaaccattgcccctcaccttatcacacatacaccctcaccatcaccaccaccaccaccaccaccaccaccacataccctttcctctgcagagtaacttatctttctttcagaaatagtagcaacttgaatttattagtcttagctgccacattatacatcttcagattatattttgtattctgaagtattttggggagaaaaagcttagacttttaattttaatttcatttaaggactagaaaaatacaaagttgcctcattacccaaattcacctttccccactcttttaatattttatttctttaattttaggcataagttaagaacaagcaatttaacatgaccaaaaaatgtacttttgtctctgccaaaacctggtcagccagccctggtagtctcaataccagattgatttctgccatatgcaatttcatgactgtttttcaaacaatgcatttttattgtatttctcttttcagaaaattcttaatctaaagcaaaacaaaccaaaaccgaaagacagaaaccaaacttgagtcagttctttgaactggcaagatactccttagaaatcatgtccttaaaaaaaacatgtgaattctctcagcatggcccactgaagcacagattactttttaagtgtctcattattttattctctaacatttaatgctgatgttttaattgcacacagctgaagctgctaaatgagtactgaaatggatttaagtcctctttgagctttgttgatacctataaaagtttatgtcattcattagaaccacaaattaaaattagtcgtggttagctgttcactggcgattggaactctcacgaacagttttgttcaggctcacgagcttgttcttgcctagtatacttggatgcctgaaaagctgcctttggcctgttgggtatgttttcttttcacagaattgcaaaatatcagagctgagaaatacaaataggtaaaccatcctatgattataaagcccctgtgatttataatgtcccagtagtcaggagcaacttttttgctaaacctggaattttaaggtgattttttttttttttaaataatgcttttcacagttgtgctggcatgtttaccagatccccaaagacttttttgccttaagtatgtcctttatttgttcctttgatgccatgtccttctagcactaaaggaatggcatctggctcagtggatggtacatggaagccatgtggggggccatgactgcttgttgcctccattcctcttgctcaagcagccccaaaccggctgacccctgagggatgagctggttgatggtccccaggagagtcacagctccctgctgttggaatcggctcccctggggctcccatctgcctttgaggtagacagtactttatttgtaagtccagtagcagctgaagagaaattaataggttaagacgagaaaagtttttaattctcttattttacgattagatcagttagattttctttaaagttttctgcttaatacattttaagataacctcatttttctaagagagctagtacatggacacatttatggcttatttccaatgagccttgtttatttggttagcatttaggacatttagtagactgtaagccaatggatgtttttgtaaatgtgattcattgagaaaaaccttcatttgagagtcaggtaacctgctttggactagcaaagtctctggatatgttactggtatctgttgaggtagtcacacaaaactgaaatactccaacagaaagacttcagaagactttcattttggtgtaaaaacagtgaaattagctgtttgacttaaaatataggagttgtaagacatttcatcgatgctacttctgttttatcctctgtgaaatgtagatactgtgtgtctcccacttgctttttagggttgttgggaggataaatgaaactgtatgacagacacactgggaactcagaagaaaggtgctgttgaaactgaacctcatcctatggctgtgccgttggcaggcataaccggtgtgctgagaggcagtggtagtgaaccccgtggtgaaaggccaggaccatgggctctggagccaggctgccttggttcgaatcccacctcgacctcttgcaagtggtctgaccacagcaaatcacccaacctctctgtgcctgagtttccccctctttaaattggggatgataatagtacccactaaaggatcctggtgagttttagctgagcacatgtccacaaagtccttagagcagtgcctgccatgtagtgtggctgatcctcacacccagaaaaccccagcagggggactcacaccttacagaaaatcaggttcgaaaccattccccagtagtcttctaacactgacttagagacccttatatgtttagagagaggaaccgaatagtttatggtaattaagctcctctaaaacagatgcaagttcaggtgcataaagttaaatctgggtttttaatctcttaggaagaaaagtttagatcacaaagagctccataaccctttgttgataggttcttttaactgtttttggctatggagggacaaggaaggaaacctgagggacagacccaccttttacctgcttagcctttctcgttcccttttacgcttggtaaggtgtctagggagctttgaaggagtcagaagtgttgaactgtttcaaggttttcacccagctgcgggaggcttcgttgtcctcttgagtgaggtggaagggacatcactgcctttcctgagtgtgtaagaatgcctgttacatattcatcccagggctttccatacattttaatcatccacatttacctacaaggtgggtggtatgttcaccccattttgcacatgagaatgctgatgcccagataggttaaataaattcacccaggctcacaccctcagtaaactgccagacaggcacttaaatccaagtgccattcatatcacagcactgctgccttgcattgagctgcaaacctggctgagccactcctaggaaacggttttgcccttttagttgtagggacctcagctgtacgcattatcatccttcagccatcagacctttttttgtttttgttttttgagatggagtctcgcactgtcacccaggctgagtgcagtggcgcgatctcagctcactgcaacctctgcctcctgggttcaagcgattctcctgcctgagtagctgggattacaggcgcccgcgaccacacctagctaatttttttgtatttttagtagaaacgaggtttcaccatgttggccaggctggtctcgaactttcctgacctcgtgatttgtccactttggcctcccgatgtgctgggattattggtgtgagccactgtgcctggcccagaccttttaatgcaacagcgcccctaacttctgaaggcccctagctggcttcaacaaccgcccctcttcctgccccccatggagggctctgtcatacatgtgtcacttttagggactcttattaccaatggcttccttaatcctggctgcacatccagattcctctgtacagcttttaaaataattcactttttaagaaacacttgccccatcccaagactcttgttctagagagatggataggttcagaaatacaggaagtttattttgtaaacaagaaaacaaataggtccttacattgtgcacatatggatctgtgcttctggagtgtgggccaatgctgttaattctgtagttgactccattgtaaggtaaaatgagttttatgggccagtttagttgttcagccaacaattgttagtactgtttctgtaggaaaagttcctggcatccaccctgtagaataccatcttccatgagtgagcacttgatcaccacagaagccaggtttgaatttagttagagtgaaatgaagtagagggccctgcttgcttgcttgttctttcatttttttttctcttcctctcttttatgggtttatcgttcccttcttttcttctccttcgtagttccctctttccttgttttctctttcttccaccatctggcgtatgtttacaatgtatctgtcatcagactgtgaggtccctgaaatccttcaggtgcctaccacagagttgacgtgcaaatgaatgtttctttattttttaattaattaatttttttttttttgagacggagttttgctcttgtcgcccaggctggagtgcaatggtgtgatcttaactcactgcaaacctccgccttctgggttctaccgattctcctgcctcagcctccaaagtagctgggattacaggcgtgtgccaccgtgcccaactaatttttgtatttttagtacagacaggatttcactatgttggctaggctggtctcgaactcctgacctcaggtgatccacccgcctcggcctcctagagtgctgggattaccgtggtgagctgctgcgcctggccaaatgaacatttcttaatttgtcttagtatctgtctttcaaagaagtaggtactgcccgtcattagcttgaaaattgtcagattttgtttgtgattgtctgtcctaacttaggtggtttatcttgaagatcttaggtaatttagcctcatagatttagatagatcgagaaatggcaggcttcaatcactgaatagtacagaatgttgggcaataagatggatttggaccattcaagggagcacttatgtcaggcttttagcatatctgctgcatagtttttagagctggaaggtctgagatcatctgggttggacccttcatttttggtggtgaggaacccactcctgagagagaaaggtgcttcttcggtgcccgcctccaggccaggacttgcctcctcctcctctgtgtccttagctgagtgagagttgggatggcggagagcagaggcaatgtgaccgcatagctgctgcgattaactgcctgcctctagacatgttggagaaacagtcaaagtaatcatccttctgcgctccccctcccatggaaacaaatgatagaaggttagggcagttttgagggcaagcggcagacttcctcactgtgaaagtcgggaagctttggttgtgccctagaccctgtccttttggccttggcaccaccaagtgggctgctttaggtgtccatcctgatggtgtttaaccctgcttgaggcttttgaggacactaagaaacacatggtgaaggtgtggaaggattttttgtcattcctcaatgaagatctgccctaggtagaaagggagttaatgaaggaaaagtcggcaacgctattgctgcacgatcaggaaataacagaaaacgtctcccatttgttctcatttgtggtgattgtttccctgggaaactggccgtggttaccatcacgctgtgtgatgctcctcagaatcctagaattagacgagattttccactttccgcacacatcttcaggtggggtcgcaaatactccatatgacagactgtcacatacgctggccacagaacttcaattattcaggtttggatatccagccccttttctctcttctgtgtggatccttttgagtactttatacctctaagcctttcgtatttccaaaggagaaaccagaatgacttttgtcactcttttgtaatggtgggaaaaggactggtaggggaaactaccaaggtttgacctgggatctactttacctgctctagttcaccttggagcatctgaccatacataggtccttgcacatagtagatactcagcaaacattaactgtcttttcatttctcattagcacaggtaattaggaacaggagctgatagactgcacgtatctgtgcagagatatatctgtaattaaagttttaattaaagaaacaccagaccaggcagatggttcttatccctgcatcctgtaaaccaaacagccgtggcttttcgatcttgcaaacatgcaaagctgagagtagcaacattcatggtggtacaccaaagggaataggttgtcttataaactaaccataatctaattttggtagcactctatgtgatgccagattcaaggataatcattgcagtttgaaatgaaagacaatacatcaaagttatgtcccaaccaaagcttttaagcctcaagtcaagggcattaccacagcccagctcgtagatcacaagacgtgtggttttgtgctagatcacaaaagctgacaaggtgttatttaggattatcagctaaatacagtattaaattagagggctatcattctgatttttcaggcattgccacggtatagcagtacagaattgagaagtgacttgtacctgcctgcctcatgcagatcctctcagccatgtcacagtgaccttaatggtcaattgagtgcagaatttgaaaacaaaaaacaaaaacacccacaaagagtgacagaagacgacttctctcatatcttagcacttttccaggaaccgctcccccaaggatccccagcgatttgttctagttccgttgccatcagcaggaagctggatcagtaagggacgtgggcagatggtaaagtccatggcagttcaccatgaccgcttgggcttcacccattccataacccccagtttcttacccctcctcaaaacccttcactttgtcacacatgtcattttcaggcattcagtgcagataggcagctgtgcaacgggattacatactagttgatacaagtatgtttttaccacctacatctcactaattcattttctacttggtagaaccagtactgaagatgttcatttcttttatcacagcgaagagttttagtttagaggctaggagagtaatttctactttgctgaacagtgaattaccttaccatccctgcacttcttttaaaggaagtagagtttccgcttgaaaaagagtccatgttataccgggataaatataaggatcttcacattaaagaatatgtcatcaaatgtagagcctggaagtattttatcttaataccatctataaaactcagtcatcctaggagaaatgtgtgtgtgtaagtgtaaggagacataccaaacccacaagaccctgtgatgtgctgtgagcgaagcctgtgtcttggctggtagacagaaatgtgtccattactttctggcttggggaagacttcaggtatttgatgatatgtcctttggtttcagaagtcaattaaatcttagctgctctgagtaaacagccatttgtggttgtgtttagaaaatacagtaagatcagatttgtgctgctaggtattaggttggcattttacatgtggaatttgaaccggactatgaaatctatttcttctctaatttggttcaagacctgaacatgtaacctttgagtatacaacacaggtttagattataaaggcttcttttccttttttctttttttttttttttttgagacaaggttcttgctctgtcacccagatgaagaacccgcccactggagtgcagtggcataatcatggcttgctgcaaccttgaactcctaggcccaagcaggcctcctgcctcaacctcccgagtagctgggactacctttgctgctgcgcctaattttttttttttttttttggctttgtagagacggagtctctgttgcccaggctgatctcgaactcctgggctcaagtgttcctcctgccttggcctcccaaagtgatgggattacaggtataagccaccatgcctggccctgtgggaggtttcttataaagtgaaaccacttgttactcagaacggcattatgcctcgcttcagggtaggaaatagagaagcatcagcaaacccacctggaatggtaggctttttatttctctttctctagtagggtttttttttaaattttatttattttttatatttatctttaatttaatagagacagggttttattctgttgtccagcctggagttcagtggcacgatgatcatcactgtgacctcaaatgcctaggcttgcctctggagtagctgggaccagaggtgcataccaccacgcccagctaacttttttgtttttcttgtatagacagggtttcactatgtgtccaggttggtctcgagctgttggcctcaaatgatcctcctgtctcaacctcccaacgtgtggggttacaggcatgagccaccaggcccagcctctaaaagtgttttttttttttttttttttttttgagacagggtttcactctgttgcctaggctggagtgcaataacatggtcttagctcatggcaacctccacctccagggctcaagcagtcctcccacctcagcctcctgagtaactgggaccacaggggcatgccaccatgcccagctaactttttgtgtttttgtagagacagggtttcactgtattgtccaggctggtctcaaactctggagctcaagtgatccgcccgccttggcctcccagagtgctgggattacaggcctgagccattatgtccggcctctaacagattttaaggaagcttttgttctgtctgatatctgtatgatcatgggaggggagtggagtgttctgcccaccccagagtgacttaaattcaaatatttgtttgttcaataaatacttattgaataccgagtactaggcactgtcctaggtgtatctagaatgaagcaataaacaaaaccatgttattcccctcgaagagcttattttctggttgggggagaggaataataataaacaataaacaaaaacaaaaataaataacagtaattgcgtgcttatatatgccaattacatttattaactcactcttcagaatactgaggaagtagctgctgtcattatccccatttcatagacaaggaaaccgagatacagagaagttgaattaacttgctcagtgtcacatagctagtaagtggtgctgttgcattcctgtccaggtcattggactccagatttcatgcccttaatcactgtggtattttgtttctcttttaaaaaactgcccaatctgtttatttctaaagaaggaaagaaatgtcagtgatagtgtggtgaacagtgcagcaaggtacacagtgagagggttcttgcatgtctgtttgtgcatgctattctagtgtgactgagcgggtatctctcatgaggtgaattgaaggaagcaacactgtgaccacttgaaggaagcaacaccgtgaccacgtaggtgtctagagtgagtattccaagcagagggaactgcaaaagcaaaggcgctgagatagacagagatagatttggcaatggcgagagagaagccaggagaatgacaaggaggcctgtgttgctgtgcagagcgtgggaaggggcacgggaggggaggagccaggaagtagtgtcctgtgcagccccgcagggcttggcacggtcttttggttttgccgaaagagaaggaaagccacctgaggatttttgagcaggaaaaagacatgacagaaaggatcattctgggctgggcatgatggctcacgtctgtaaccccagcacttcgggaggccagtgtgggcggatcttgaggtcaggagttcaagaccagcctggccaacataatgaaaccctgtcactactaaaaatacgaaaaattaactgggcatggtggcggttgcctgtaatctcagctatacgggaggctgaggcaggagaattgcttgaatctgggaggcagaggttgcagtgagtggagatcgcaccactgcactccagcctgggagacagtgtgagactctgtctcaaaaaaataaaagtaaaataaaataaaataatcactctgaatgtagtgcagagaatcttccagggcagggccagcagaccacagcccatggcaggttctggcccactgcctgtttctatatagctagcaagctaagaatgctttgtatgtttttaagtggttgaaaaaaaatcagtattttatttcacatgaaaattatatgaaattcaaatttcagtgtccagttccagttctattgaaacagagccacactcttgtgtgtattatctgaggccgcttttgagctgcaacagccaagctaagtagttgtaacagggagcatatggcctgtagaggctgaaagatctatactgtttggccctttacagaaaagagttgttgatccctggtttgggatagaagtagggagaccagtgaggagactgttgcaagaactgatggtgccttggacagagcaggaagaaatggtcatatatgggttatgtttgaaaggaagagctggtagactgtattaatataggaagagtcagggatgatgactgtgtttttgcactgagtaactggaagaatgctattcttctttactgagatcaggaagactgagaacagcaggttggggaggaggggtgaagagaatgtaggttgtgttttgcacctgttgactgtaagatcaggtggagatgttcaataggcagtcgtatgtttgagtttgtaacttcaaggagaggctgaggctggagctagattttgagtgttttcagcatatagggggttctaaaagccgtaggactggatgaaattttttagggagtgtatacaatagagaagtccagacatggagccctgggacacccaatgttaaggggaagcgggtagaagggaggcaaaggagaatgagaagcaatcagagaaggaagacaggagatgggggtgtcctggaagtgcatgtttctctttgctttgctttgcttttttgagacagaatgtccctctggtctcagctcactgccatttccacttcccgggttcaagtgattctcttgcctcagcctcccaagctgggattacaggtgtgtgccaccatgcctggccaatttttttatttttagtagagatggggttttgctgggttggccaggctggtctcgatcccctgacttcaagtgatccacatgccttggcctcccaaaatgctgggattacaggtgtgagccaccgcgcccggacaaggaagctcatgtttcaaagcagagtgatatctatgtcagatgctgctaaagctggagcaagaaacagacgggtttcactgtgggcttggtagcggggcgatcgttggtgactttgataagagctgtatgagtgaaatggtgagaataaaagcccagttccaggtggttcaagcaaaaacgactggatagggagctgagctggtgctctgaaggaattctgctttcggcagcctaagtgtagggcaggagagggcaggagagggcagggagttggatttaacctgggattaggattttgccaggtgagtacagtggagggaggaggcataagggagttgagcattgcgcagaagaatcgatgtgaggattgaggatagaccatgtggtctaagccaggcaaggagccaggaggcatgaaggagctgagggtcagtaagaggtcatggggtcagtggattcaaggaataggatcgaggagttgttggagttgggatagtcgaagagtagatagagggcttgaaatcggtatcatggaggggtcagttttggttacatcaaggtcaggggctctgctgtacagtagcagtgtcagtgagtcacgtgtaatttttaatgttctagtaaccatatttttaataggtaaaaataaaggaaactaattttaataatatattgtaatatattttattttacccagtaagtctacattacatgaccatgtagtaagtataaaaattgagaagttacttattttggtatgaagtctttgaaattggtatatatcttatatttccattaccttctaatttgaagtagacacatttcaggtgctcagtggctgccttactggacagctcatgggatggtcatggagtgtagtccaggattatcacaggggaagtgtttaaaggaacaaggaggtcgtggttcatgaaggattggccgtgtagatctaaaaccatttctcactccttctgaggggagcaaggctgaagaggaaggaggggacaccatggcagttggtagaggtcatgtgcttcgatggctgaacctagcagccttttaccatgcagagaatttagcttattctctagagacacacacacacacacacacacacacacacacacacacacacacaattttgtttggctttgatccacacaatgtgtttttaaagatgaataaaaattgataatatcaggtattttttagcctcgtaggccaggaaaaagtaaaatattttgaaagagtaaacaggagcgtctcagcagcatacatgttacttttcatcttaatcatgtgagcctctcatgaaagcctccaaggaggaggttaatggatgccccaattctgtacctttatcaggtttaagcttacttcagtttccctttagtttgttgcctgcagtatcataattaaccaaagaattcttctcaaaaattaccctcaaaaatcctacaaaccccactgttaggaagcgagcccattttgaggaagtatttgtgaaccctgtgttcttggatgccttatgtgttgaaggaataattacttgttcattttgtagtgctaaaatcctgggaatgcgcagtctaagcagtctagagcatgtcagtatcccacctttggaaatctcctaggagcatgtagagactctggtttatcattaactgtgttgctttcctatcttttacacaaagtattctccttcccgcaccattgtattcacatgacagaaagctcagttaatgccttttagtaataatgaaagcttactcattacatacattttcttaaactctctttattctaattaaaatgtttccatctgatgaggaagtgtatggataccaagaagtggaaattaagcaagaaattaaaagaacattaatggctttcttgtaatttgttttgaggtttttcttcctgctaaatggtgttttgcttacagagtcacccctcacacagaaatctttatgatgaatggactggaataaatcccagcaaaagaagagctattttatgatacctcttgtaaattacaacacatgttatggaagtatttgcttttttaaaaatattagctttttaaaggcattgttagtataattaatttggcacacacacaattctagtttctttgaaagtgaaggtcagtgtgtgtgtgtaggggattaagaaaatgagagttctgacatttaaaaaattattttctatttatacctgagtcattagaatgctcaaaccatccaaagtataacatttaaacttgcagttcattcattccttcagaaatttgctgctgaaacttaaactttaaccagcatagccagcgtagccttaaccagggcaggtatttggtctgcagtaggcaagcctttgcccccatccctcgtcttcaggctgcagagtccacatgcatgccattgctctggtgggttctttttctggtcatttggacttgtctctactaataaagtattcattaacttgaaactcctacctctgaatgtagatgcaggtgaaagcagagaaataccaaacccaccccttcctgatgaagtgcaacatgccccacccagctgcatctcacctgctgcctcccctcctcctcccctgatgtgtggacactctttctgtccgttcctacttgctgttcccttctctgcacgagtccttcccctggagggcagcccgcatgccactcctcccatgcaccttttcttgggaactgtgttcagtacagcctgtcctttggttcactcttaccctgggcactgcttcccatgtcctgtgcgggcccttgccatagcatattgtgatttatctctgttggtgtctttactccactcaagtgggagctccttgggcaagggtgctggtcctcccttatttttgttttccttgagcccaccatctgcacgtggttatgggtggatggatgggggaagtgacagtggggtaacataccttcaagcccaaaatgtaaacttaataagtgttttggaggaagagaagaataaatactgtttttgtttatacaggtcttaaaattttggtagcagaaagcaaatgtgcaaagagcaatggaaaacaagtcagaagctgctgtctgattccagaggaactcgtattttatgttaaaaaaaatgtaattgacatttgattgccttgaaatcttcaatttgttgtgctgatatcttaagtaactaattatttagttgaataactactagggaaataggccataaatgtcactcgtgctttccttgtaagaagcccacagctcttctcgcagcatgctcttttcagtacctgttctaggtacttgtgacttgtgaaagtcactggcctctgcgcattgggcacaggcctgaaggcgatgttttactcacattttgtccactggaattaaacagctgtgctgatattcagttgatttgaggtttgtttggaaatcagtcccaaatttgggaagcaaatgagacagaaccctccacaccctaccacatgcttccagctcatcccatgaaaactcatgagcacagtgtggagtgttttatctacagccactccctttttgacccttcccccaaaatagtgagggagagaaatgaaagaacagatctggggcttgccttcagcttcactgtgcatttttggtcattttggtcattttagaagtcatctttcacttgttaggatgttacattaattgggagatgctagtcgttttgttcatggaaaccagagtatccctttgaagtattatattcttctaatctatgaaactggcccaggaagtaacaatgggaagtgctggaaatggaatttaagaagtccaccttcttagtcctgtgcttaagcagagagtctctagcagggagcctctgcaagcattgtgttctgttgtatcaatatgtacttagatatgttaatctgaattagggagttgattgtacataatgactcccctgggttgctatgttagaagaaaacccaaaacttaagtagtttgctgaatatgcatagtaagtaaaaaaattcttccaaaattagtgttaattgaatctgagccttgatcttctttgaacctttaattttttatttgatcttttaaaaaagttttgtggcctcttaaagataaaacctacaacccaataaaagtcatgctgtaacgattgcaaaaagaccattgtatgagacccagttttggattatcataggcgaagaagtcagacatatatggttgtatgtacatgtgtatagtatgtgggtgggggtagatacatacctgttcatctgtatacgtatgtgtgtgtttaatatatactttagtttgcctttacccagatgtctcctcctctctctgcctctggaaatggggcaaatttttcttcagttaaaaacagaaatagaagcgacggttttgacccattttacacctatttatttcaggctctcaccacacacttgttcatgggcgcagcaaagaagagggatccacagagctggagccatgagggctgacacattggaatgaaagctggcagaattcgtagggagagctttcccatcctgccagccccatgtctggctttaagacagttctattagtgaattaactgttctcaaaaccccaaattaatttgaaccgaatgttactaaaaatgaaatagaataaagtgacctactcttgcctcatccggagttattacgaaggagctccgcagcctgactgagctctggagagcagggctctgtgcacacgcctcctggtccagaggcctccgtgaccatccatgatgccactctgtcccctcagcaagctgcctttttcttcctagcacctgccccagcggtggtatgttttccagtcagttaccacctgtctcatcagaatggaagctccatgagagcagggcctttgtcttgtccccttgtatcttcagtgcataggacagtgctgacacagtgcagagtctaaataaacgctgttgaacgaatgtgtgggtcacttgcgtcgcatcctttctgaatgtttttcctttaacttgccatttataaataccttttccaatgataaagcagtgaaagtttggaaagaagcataaagcttttgttgtgattgaagtaactggaagcctagttcagggtgctgtgagaagctggagcatatcaggactttggaattatgaattacagacttactatatgtgatggtatcggtgcctcctgaagaagtagaagacagagatgcatagaaacatgagtcatgtctctggaatactgtaatatcgacatctagtgagagtctagaaagaaacatggagaaataaaagggaggcaggaaacaggcaaatacttagtggttctcagttatttaaggtaaattttggcatcgagtaaacaagataaatcaaaatattttctagatcaagtaggcattaacaaagatatagaggaaacttggaggcgattacttagataatactaacagaagtacttttgttccagatacctccacagatgccatggttaccccgtctttattcgttgtgtgttggcataggccagaataccaatattgttcttaaaaacctttgaggaagtttttctttttttctttcttttttttttttaagcaaagaacagaaacaaaaccaaggagacagtatcctgtgatgtaggctgttacctcaaggtgagtttatttgtagcactaacttgtaacgaattgtttaaagaactgaaacttctttttaggtatagcttatttgtcagattttgttcatttcagtgtaaacttcagttatttattacacactgagggaaatcaactaaaatcaggaaaaccaatgtccaattgaacttgagttttattttgcatagagaagtaaccaatatttctgatcaaaccattaaagctgtttcagttccttttaaataaaagcaaaggctaaattttttacataccacaaagcaaaataaaacgaaaaaacctttggtcatgatgcattttttattcaactgattgctgaattattttgattatataatcttacactcttatgaaagtataacaagtatgaattttctgaggtgaagaaataaatgtagaaagcagttaatgaggcagaactcacaaatctgtatttatagtttcatggcaaataaatcataagcagaggatacagatgtaaagaaaaattcttgattgcattcaagaaatgcaaggtcgaactaactttttactgaaatggaattgtatcgctgctcagagggatgtggggagtaaagtaagtgggatgtgcttagaacagcaagctaggccgcagtgcgcactcgtcagtgtctgctgcttgtcttacgaggattctagcacagaagattaaatcatgttttaatcatgcttaataaatggtactgtagttttattatggttaatgtccacttgtaattcaatgaagagtggctttttaaagcaaaggagaaatcagcatgtttttcttggcgctcttatattgtgtgtgtgtagaagatgctgggatgggttatccatacgacaacccctgtgaccagagatgcaggagcacatgcatcactcttagttttattttatttgttttatatgttattttcataaatctgaaggtttgatcagcttactgtttttagtattttctgctgctgcatgtgtgtacctttaagttttgtagaattaaattgaaaattttgaccagcaaatgcttaaagccactgtcaaaattacatagttagcacttcattgatttgaaggctagttttcattcaacattcctgcagtttgtgtgtgacctgattttaaagagcagttccatgagttagtgccctctggtggcacacagaggacgtcaggcagagagggactctgacccaggagccttccggaggctctgctgaagagaagccagtttatgactggccctgtaatttcatattttttcatgtgttcagtgctcgtcagtttcctactccattaagccatggccctggcattgactcagtaccagctttatagcaagtcttcagcagcttaggttgtgagggaatttccaggtggacttgatataagaagggattaccaatgttgagatttcccatgaggaaccaggacatccatttttggatgcatctcttagctccttttgaagagcagaccatgtcacttcctgggttaaggaaggaaggctccctgatggcctttgagtgactgactggcacagcttggggtgggccttcagtgggttagtctttgataggcctttgtttcccattttggtcttccctggagggcagcccaccttgcccacttaggctcttggacagttttctttttttttttttgttgaggtgaagtctcactctattgcccaggctggagggagtgcagtggtatgatcacagcttattgcagccttgacctcctgagctcaagtgatcctcctgccttagcttcctgagtagctaggaccacaggtgggggccaccatgcccagctgatttcttaatttttctgtggagtcgaggtcttgctattttgcccaggctggtcttggaactcttggcctcaagcagttttcctgctttcctccccaaatgctaggattataggtgatgagccaccctgcccagcctgcttggccagattctgtactctttaggcagaccaaaaactgaatcctgtcatcactctgaaaagttgtgggacctcaagaaagtcactctttcatgagtttctttagctgtgaaatagtcacagattctaagctgtcttttgaacctgtgtcaagagagagttgtgaggatgatgtgagatgatgtgtctgagagtcctgacacattgacctatgcagactgctgctaaagacatttctctttccttcctcaaaggcaagcctccccaccttgattagaaggtcattaaaaaggaacttcatttgacaataatcccatatttataatgaagttgctaagatagtttggagtgcccatagatcccttacctggtttcttgtgcaatccccacttttatactgttgagtttccctgatgagttttcatatatataatctctgtgaacttggatcaaatttggcttaaatgcctatttaccactttgctaagacagaaatgtttgcgctcagtccctgaattccattgtagatgtgttggcatttgcttccaaaccatccttctggttttagcttgccctgtgtctgtggtcatttgacattagaatagccttctgtgatcttccgggatcttaacacctaaatattttccctgcttgtacagctaatgagttgtgcagcctaaggaaacatggggtagtcagttttcatcagtatttcaactaggcgtttttgccatctcatagctacttctcaagcaattacaatttaagtcaaggtagtagcacctgcatcttcaaaaaacaaaacaaaaagttttttatcttcagaaataaggaaagaagcttattggacttcccaatagaaagtccaccagccaattttaatacataaataatctatgattagcattagtatatgaaaaaaatagtagcagctcagattttatgtacttctgcagtttaagaaagtgatgccacagacaacatctcatttggtttcttagcaaccctgaaagaccagcaaggagagcttcgtccctcccttttcatgaacctgaatgttgtaagggaggccaaggagtggcctggtgagactgcacagccagagttagagcccaggtccacgtgagtcattgtacagacacatcctgagcaccagcccacccacttctgccatcaggaggctttgaaactgctgtggttcccctcttaaaatggctaacctctacttcagcaaccttatttatgcattcatatacataatcattctttaaagtctagtagacaattttcacattttgtttcagcccagatctttactaaattttgtgagatcagcattgttgggcttgaattaaccaaacttcgccatactgtgccttcagaaatcccagattgggcgggttgtgagttcatctcatcctcttcctgacattgacactaccagcaccatcagcaggctctgggataactgcggccccctctgagaggctacatcttgtttgcgatctgtgggttacatattgtgctagagataaaccttgacagtagagacgtgtgacatattttttacaagagtcactgagatacttgaatgagaagatgatgtagtttgaaaaagtgataaatgggccaggttcttgagaaactagcagaatgtcttattgaaaccttgggatccaatctgaaaacagaaatgagtcttccaagcaaatttttttcttttctttttttttttttttttgcaaatgtggtgggggtagatgcttttatataaattctatacctgtttctgtggtataaaaatcaaattttgtcctcttttgcctcggttggttggtttcattttcaactaggtctccgtttctaacagcatctcaggtaacttttctgaaaaatgtgggttcagaggagctcatgtgctggtggctgtagtggcagctagttctagactatgagatctcagtgaccactttggtgggtgttttgttttaaatcaacaatagaggtgaatctgtactacaaagtaaaatgtatgagtagataggttttcatgttttgaagttttttatcttcagaaataaagaaacagcctcattaaagaactgttaaaaaaaaaaagagctgtggccgggcgcggtggctcacgcctgtaatcccagcacttttgggaggccgaggcgggcggatcacgaggtcaggagttcgagaccagcctggccaacatggtgaagccctcatctctactaaaaatgcaaaaaattagccgggcatggtggcgtgcctgtaatcccagctactcaggaggctgaggcaggaggtggaggttgcagtcagccgagatcgcgtcattgcactccagcctgggcgacagagcaagactccatctcgaggaaaaaaagaaaagaagaaaaaaaaagctgtttgtctgttctagcctggcacctatgagttctggagcagcacccaaagccagttcctgctggctttcctaggagcctctttggcgtgggtgggcgagctgctcccttgcagcagtttcagatgtcacttgagaaaaatatttgttgttgtttggttgccctcttcagttgtgatgcttttaggaagttaggaaacagatgagacagtctggctggaataagagggtgggtaaccactgatctgagatcatccctgttgattaggtttgcagaattctaaatggagattgtagcttcacatgcgcactgagggggttgtgcgttttcataggcttatgttccatcgggcttctgcatgatcttggaagagagagactaggtgtggttcttggctctgttggctggtgggtttagctgtggatcacttaagagacccataatccttgcttttgtaccgttctgtattccgtttgtcaggctgcgagggaagggggtttgtgctaatttgtatcttactgaccctgactggaaaagagattaagattttggttgtataattaacataaatgaccaaaaatatcaagcccactcctcacacaggtgacccaggcatccaaatatttactccaatgattagtgtctttcagctgtagatgggcacttctttcctttcctttctcctctctcttttctttacccaccagatagattcacactgaaagattaaaacaggctgtgggatttaaatgctgaaaatgaagattgatgctttcaggtgccttgtggcaagcacaattaagtgaacggagaactggggcaattgtttatttgaaggttggtgtgacatatgaatgaacttattttttcagtacccacccatctacccggaactgaaataggcatttggagtaggttttgcattttaggttcaattttaagaaccagccattcactgtgaaagcgaagttgctgggaagtttgttttaaggatgatgccaccctctatttctgtgaacccagtaaaaatagcatggaataaaatttaattatgctatactgaatatttcatgtggaattaaggggcaaaagctgcctttaaaaagcattaggtttggaaagaataaaggctttgtaggttctttggaagatactataattaaaagatttgctcaaatgtatttttccctttttgaagaatttaaagaaatccatccctcccttcctaaattgattacctctcaagcgtcagcccttcttggcagtaaatacggtgaagctgccgctgtgctgatttgacggcttctttctgttaaatgtaaaatagttttttaatcttctgatttagatgtttaatagaaagtaaacgtttgacttgctttggtttctgctgaacctgtatttaaatccacacaaacagtttgaataaagtgaaaacatcactggactagctattttaaacatttcaggatataagaatgctaaatgggggttccttttaaaaatagaaatggcggcttgcatttacataattactgctaactagcacaacattttaaatggtgacaaactcagggtagaaaaagtatctgttttaaaagcctggtaaaaggaagcagaaaatgctctgtgagcagctgcttcagatggagggtctttgcaaagccgggagaccaagacttttcagtagggagggcgaggtcaagggaggaggcaagaggtagctcaggcaaactacttacaggccctgagcctgtgtgtgggcctgaactcacccacctttcattttggagcatgattgtctaagtattaacacttaaatctgccttggtgtctgtccggacagggtgcagtgttctctgtccgctgttaaaaggtgtcaggtgagggttgaagttcaaagttggtgaaagagcatggaagaatatttatgaacatgaaggctgagattcacttaacacaaactcatcagtagttcaagccagaatctcaggcctgtccttgattctgcccttttttccccatcccagacacccatctttctccttccaaaatacatccatctttgcacatctctgctagtaccaccctagtccaagccaccttcttttctttgcctggagatctgtcacattttcctgtgtggacttcatgtctccagtttgctccccttggaatagattccccatgcactagccagggcaatctatgaagaatgtaaataggattcgttcactagcttaaaccctacagtgactttctatccatttggagtccggtcagcatgaataatctggcctctgcctctccatttcctaccaggtgcctcttccctctaagcacccttcccatacggggaatccatcaaacatgattcttttttgcattcgctgttttctctacctaaaattatttcctctcctccccatctttgtttgctggctcctttgtgtcattcagggctcacctcaaatgttatatcctcagagagaccctcccccgatagcctgatgacaggtgatagtcccctgtcactctgtcatgtggcagtgtggtttttttcgtagcatttattactgtctgaaattgtctcttctttttctttttgtcctcagctcttccccatcctattagctcttttagggcagggggccctgtctatctccttttcagctatgttctgagtagttagatgtacctgcaagtgcctaggtatccattgattaaatcagtgcaggagcggaaccctgcagatcactaatgcccaagaagagctcccacttggtggaactagctgcctagaagctgctcctcaaattcttgcccacattttttttgaaccgtttgggaaaaaaactgctctaaactttgccttttagggttgaaaattgaaatttggggattcacagaatgcttgtacttaaacagaatcagcctgtgtccctagaaggacatgaaattcccctagttcaccccaaatgagatgaaaatataatttcctagcattcttggtccatagtaggagttcaccagtggcgatctgcctctgtgtccttcctggggcagtgggatggcactgcttgcctttgctgaagactgaatttgaattccctcagatccagccttcggagccagatagcattttctgtgatttctcctgtggcgtgtctggccgggatgctttctgtgttgaatgttcattttggggttaggtagcaaatctgttaagatagagatatttgcggaaatctaaactttggtcagccacttttcgtttcattagttttccacctggcaacatccaagcgttcaggaggaaaacatggtaatggctactgatacctaggcagttgtgattccttccctaaagaagctgatgcagagggttcaattaactacttctgaggaaccctttgcatcagcttccttagggaagaaaagaatcacgtttccaactcactgagtctcaaatgtattatgccactccaagctgtttgttgaagtatttactttggtcttgaatatactcgttggggactggattgtagaactcaggagacccatctgcttggcagaagctcccctgtgcaacttttcattcttgttgctgtctttatcagggcattattacagtgattgggttgtgcaaggagaaacagtaacttcccagttaatttatagtgaaatggacctttttagaactgagacctagagataaagccatggagctggaggatttcagttgcttttgagtgagcatcaattcattagactagttttaagagaacctctcccttctcatgtttgaccagagctgaagatgcctcgactctgcctggttccccacttgcctgagtagagaacaggttcaggtaggagggaacaaacaggttgagcacaggcagagtcaggaaagggcctggcctgttcaggatcaagatgtgtgaaatgaaggtgggaagatgggggtggaaaatgggttttgaccaacatatggatggtcttgtgtgcaagaagcatgtaagcacagcagattgtgttcccatggtgacaagctgctgagccactgtgtgtttagggtcagtgtggggcggggagtagtgttggaagtccatgtcagtcattggtttcctagttagtgcaaactcaataagcctgtatttactggaagccatttttctcatatatacacccccagattgtatatcgcttttctgatttgactttttggctgattgcttttgaagttaatgtggtttagtcaactgaatgttctaaacatctccctttacctacctggtcggtactcctggtgagtttttgaaaggcagtgtctttcccacagagattaattagaagttagtgtgtgcagtacacttgaccctatgtttgacacacattcagtatatggtggtgattatttgtttgaaaatgaaacagagctctctgatggaacctgaagaagtgggattggcacttctagatggatatatgggttgtgtttaactgctttgaatgttagtaagggaaaagtatccacttactattgttcatttcttttttcccagccttaagagccaaaatgattttctgcccacaaacgtcttggttttctttttctagcctgtcttttcatggctaagatatttgcagaaatttctggctagccaccagtccataactttttctcttctttgcagacactgtgtttagtggtatctgaaaaaccctacgaatccaaagttgtttaccctacgaaagttgagattccagttcatttgctaacctgcagtttcttatttcttgtcttggtacttcagttggctcattaaatatttcttaaaattggttgaggagcttaaatatttgttaaaattgtaatgtgtcctgatttagaggaaactaattattatgtacatcttactagatccatctgttgcccattcctcagatacagtgatagaaggagagagaaattctgggccgggcacggtggctcaaacctgtaatctcagcactctgggaggccgaggcaggcagatcacgaggtcaggagatcgagaccatcctggctaacacggtgaaaccccgtctctactaaaaatagaaaaaattagctgggcatggtggcgggtgcctgtagtcccagctactcgggaggctgaggcaggagaatggtgtgaacccaggaggcggagcttgcagtgagctgagatcgcaccactatactccagcctgggtgacagagcaagagcccatctccaaaaataaacaaacaaacaaaaggagatagaaattctgtctccaggcagataagttatagttcatagagtgtgagagaatgggctcataatggaacagttatcctgggtggagttggtgcttcgtgatggtacagatgctttccagggatatgctcaggaaagatactggaaagagattttcctaagtctcatctcaaatgagctttgctttgcttcaactggcctaactcagcaggcccagctagcctgataccaagaaggacctccagcctcttgttgcctagccgacctccaaacaggtagctggccaacatggggccccctggtttgttttattttgtttgattttttttttctttaaatggaatagatgatctagacgtagcaccaaggtgcccctgtcttccatcaccttcatgtacctgagtacccacaagctcgcctgtggatctgtaggaaaaccaggtaagtctctaggatctgtgaggtcatcggtaccgtggatgcttcttcagggtggggagggtttgctgccattgatagccctgcaccatcatggaagcgtgcccagtctgtttccccatctttgatgcactgtggatgataaataatcatcactgctgtgtgatggctgagagggattccagccagtgtgtgctaggttatagtgttttcctgatggatggagcctattctgggaagcagcttattgtctcacgtgaacaggctttctaaaataaatgactgctttcttaatattttgaatccttttcttcagcacatgttttgttgccgtggtttgaaagcttgccaaatatatgcctttgcacaactccctgtagggctgggtatacaatcagaccaaacagtgtgatttaagtttgagcataattgggaattcagcaatcacttgccttgcatttgatggaatggcagtggagtgcttgagagttacttcgctgttaaaaaattatatgtgtataacgcgcacgcgcgcgcgcacacacacacacacacacacacacacacacacacacacagagtttcactatctcataataaagttgtacctgaaaccactgggcaaaaataacactagcatgataaataattgcttgatttttgtgatggaggcaggaattaacttcaacaaatcatagcagttgatactgtagatatgactgaggacttaagttatataaggttgtggaatggaagaaaatcacgtggtggcagcaatacattttaaacacaagcccttgtcaagtccttcatcggttgatctgtttccttgtttctgtgtactttagtaattgagccataaacttggtgaacttggtgttgcctctgtgttatacaagcatctttggattttacattgccaacactgtgcgtgtttgttgctgttggattgtcagttacctataattgagaccttttcgtgtgtctctttgctggtgggaaaaatgctgtcaacagccccactccctgcagctctttgaaaagtcacatgtgaaatccagagtttgtttaccaggctgaaagagatcactttaccagaagcttacagtaaatatccaggtgatagagcctggagatactaaacatatgctgcttcattgcttggtacattggtagtcatcaggcctgccaccagcactgcagactgcacaggacacagaggtggtgtgtggaagggataactttgaaactgtgtgtaagttatcatagccaccagagtttcttgatggtggcctcccgttcccgtgcaatgagacagcctcctgtcatcccttgtaagatggtgttaatctgacaagaaagggaagtaaaaactctgaggtcagaattcttaagtttttttttctggaattttggacactttctaataattgaaaagcacctgtcttttggagttttagacagtcaaattaatctaactccagaatttagcctttatttgcaaacaacatgattatgaaaaacccatggaatctatataaaaaaaaacccaagcacctatgagaataaatgaattcagcaagacaacaagatacaagatcaattgtatttctatatattagcaacaaacaattggaagaggaaacttaaatatcagtaccatttacagtagcttcaaaaacttcagataccttagaataaaactaagaatatgtgtaagacctctatgctgaaaaccacaaaatatctgtgagagaaattaagagaagatctatataaatggagggctataccatgtattgaaagactaaatagtaagatgtctgttttccctaaattgatttatgaattccgtgccatcctactcaaaatctagataaactaattgcaaggtttttatggaaatgcaaaagatctagaaagaccaaagcagctttgaaaaagagcaaagctaggagatagcctgatttcaagacttcctgtaatgctacagtaatcaagacagtgtggtattgcaaaaagatggacatataaatcaatggaaccaaatagggaatccagaaacagatccacacatagatgctcaattggtttttgacagaggtgcaaagggaattcaatggagaaaggatagtcttttcaacagattgtaatggaacaactggacattcatgtgcaaataaaatgaacctcaacccataccccatactgtatataaaaattaactcaaagtggatcatagacctaagtttaaatctataagccttctggaagaaaacatgggagaaagttttcatgaccttgggttagcagtgatttattagatatggcaccaattgtgcaatccataagagacaaaacatcagacttcctagaaattaaaaaatcctgttcttcaaaaggtactgtttagataatgaaaaaacaagccacagactgggaggaacctttgtaaaacatacgtctaataagggatccataatgtatgaagaactttaaaacctttaaaaactttaaaacaacccaatttaaaaatgggcaagagagttctctagacatcttaggatacacagatggcaactaagcacatgaagaatgttcaacagcgttattcatcattgaaatgaaactaaaaaccacaatgagatgctggtacacagttactagggtatcttcccaaaataaaaccaaaaagaccctggtaataccaagtgctggtgaacatgtagggaaactgaaactcttgcctggtgcggtggctcacacctgtaatttacccagcactttgggaggccaaggcaggtggatcacttgaagtcaggagttcaagaccagcctggccaacatggtgaaaccccgtctctactaaaagtacaaaaattagccgggcatggtggtgggccccggtattccagctacttgggaggctgaggcaggagaatagtttgaacccaggagttggaggttgcagtgagcagagatcacgccactgcacttcagcccgaatgacaaggtgagactgtcacacacacacacacacacacacacacacacacaaaaaaaaaaataaaaataaaaactcgtactggcttttaggaatgcagaatgctacagccactttggaaacaacattgacattttcttataagtctacacttaagaatcttacaaatctgcatttacagcaagacccagcaatcccacttctaggtatttacctaagagaatataaagttatgcacctacagaaatttgtatgggaacatttacagcagcattactcatgatgttcaaaagctgaaacaacccaaatgtcattcaactggccaatgaataagcaacttcattggagtactactcacagtgaaaaggaacaaagtgacacaacatggacgagtctcgaatgcattatgattagtgagaagaagccagactcaaaaggcctgattctgtttatgtgaccttctggaaaagccaaaattgtatgggaagaaaacatcagtggttgctgtggactgggttgctgtgggtgggtcggttacagaagagcacaagggaactttttgaggtgatggaaattttctgtatggtgtttgtgattgtggttatgcagctctgtttgtttgtcagaatgtatggacctgtgcactttgaacaggtagttcacaaaagaagttatacacatggccaataagcatgtagaaaggtgttcaacgtcagggaaatacaagttaaaaccacagtgagatgccatctattattagagtggctaaaataaaaaagactatcaacatgaaatgttggtgagattgtggaacaactgcaactctcaaacattgctggttggtgtatgaagtagtccaaccccttgggagacttgattggcaggttttctttcctgaaattaaacatacatgtacaccatgatccaacagttccactcttaagtatttactttaggaaaatgaaaatatatgttcccaaaagaacttatataagaatgttcatataaagccaaaaatagaaacagcccaaatatccatcaactgaagaatgaataaattattacagtggaatactgctgagtaataaaaaagaatgaactactgttaacaaccatatggatggagctgaagaacagaaggacataccctatgaatgcatttagataaaatccaagaacggatgagaccactctatggtgatcaaaagtgttttcttaagagtagggaggggaattaaccggaaagaggcaaggaaggttttgggtggtggaagtgtaggctcactcccattttgggtagtgattacgtgtttatacacttcttaaaactcatccagcagatgaagatctatacattttattgtatgttaattataccttaattaaaaatatatttaaaacccacttttacagctgttttattgaatcctaagtttatttagaaccatttattctgttgggtcatcattatgtgcattttgcataacccaagtttctatgtggtgcatcttgttggcattatccagtattttactgaagcacgaggaaagactcagcttgtgattgtgctcttggacatggctcagagcttcagaatatccaaggaacaggtgagtaacccatgtttctgaccctgggtcctataggacctgtctttatttaccagttcaccatctgtagaacctcagtgttacgaagaagttgaagactttccatatgcctaatcttaaggggcaactccttccagaaactaatgtagctggaattcatcattatggattgagctggatgggtgggaaggaaggaacggtgtggacaaaggattggaagagaggcccttgctccagtttcctgtggacatcgcagaccttctttttatctgtactctccatgggcagtgtcatcgttgggcaagacttctatcattaccactctgttgacgattcccaaattatctacagtttattcctctctcttgagttcaaacgacatatccagatatttattctaccttgctcactctactcagcaatgtgctgccattctcattttgtgtaagtttctcctggcccttccctggtactattttctctctccatttcccttcccattctttccttcaccacagaaatcgtgcatctgcctcctcattccattcaataggcacttctcatgttagaattcactgaacacgcttagttattaaatcccatggcctcttttcagccctcatccttcctggcttctctgtagcatttgttgatgttagctgtccttttcttgaaaggagacctgtctctccctcagccctgggacaccgtcttcctgcctcaccatctggtccctgcccctttcaagggcaccctctgagatggctctcctgagctttatattcttggctctcttttcttttactaagagctctctggactgttttctgatttaaatttctgtttatctgccaatgacacccacatctatatctttaggctctcctcccctgaactttaagcctttttttttctttctttctttttttttttttaatttttgagacagagtcttcctctatcgccccaggctggaatgcagtagcatgaacaacatagctcacagcagccgcagcagcctcaaacttccaggctcaagcagtcctcccacctcagccactcgatatctggaactacaggcatgcgccaccatgcccagctaattttttttttttttttttttttttttttttttaatttttggcagagacgaggtcttgctgtgttgcctagactgatctcgaactcctgagctcaagtgatcctcccgcctcagccttccaaactgctgggattacaggcgtgagccgccacacctggcctaagcctttgtttcgtattgcacgctgaacactccgactcgctgtgtgtccaaagccaaacattctttctccaacaggttattcgtgtggtttgctgtgtgtcctgaggccagtggcccacgcttgccactctggggtccgctctgttgctgtgtggcactccctggagtcatgaatgaagatccataaattctgcctgtgaacttcatgttttctcccatcttctccatctccactgccccagcttgggccctcgtgagtccctgaactattcctgggtctccttgccttgttccttttttttttttttttttttttgagacggtgttttgttcctgttgcccaggctagagtgcagtggtgcaatcttggctcactgcaacctccacctcccgggttcgagcaattctcctgcctcagcctcctgagtaggtaggattataggtgtgcgcaaccacacctggctaatttttgtgtttttagtagagacagggtttcaccatgttggccagggctggtgttgaactcctgacctcaggtgatccacctgcttcggcctcccaaaatattgggattacaggcgcgagccactatgcccggcctgctcctcctttctttaccatccacctctgtcttgccccacccctgccaccagccccgcttccctctcataataaagcttcagctcctagtggaaccctttgtccatgcagtcccttggcccttctgcacttgggtaaaggcttcacattcaagtttcagttaaactctccctcttctctgtattgtccgtgcccctgccccctgctttgcgtttgcattgtgctttgtctcttattaatagttcatgcaagtatctgtcctcatacttagagctctttgggttagtgcctgcatctcttattgcgtgttctggggccagatacagggcctcatatacagagtgtgctcggtgcagggttgccagagtgcagagttgctgcctgtggaccctatgggaagtgctgcttcatcctccctggagtggctcctgctgctggttctgtgcctgcagctcccacacacgcctctgctccttcagatagatgtcctgaagggatgtggagctggtgttgcctgtgggaactctgaggctctggccacaggagcccagcacctgcttaggatcgtgagccctccaagtcacccacggtcttttctgacaagccaggagcgactgctgttttatctggaagctttccagtgggtgatgctaagaagagggattccctctttcgtgtcatgtcaaatggtactcccaggtcctcctcctcctggcaagatgagggaggagggagaagaatggggagaaaccccctgccaaggggtctttctggatatagaggtgccaaatttgtataaaggactgtcttcccaatactgagcccagtgcatttgttgtgactaggctactgatgctagctacttagagatggcagaaaaggctctgcttttccttcctcactgtggcagggccatgggtagtggcccttctcccagccttaaatcaaccaaagaagaggctctatcctagactggctctaccccactgacacagaaaatcagggtggtggcaggtgctgcaggcaatggcgggagatgtgccagggactttggccatgggagcaatggagttgggcacttttaattgatacctttaataattattgttcaagcaacagaaggcaaagtggaattgtttcaaaggcaaattggagcaacaggagcttggaacttggctcagaaatgtgtgcctaccttccccactctggctgttgttcgaatatatttttcctttaagtttccctccccctcattttcgagtgcagcagtcttttccctaaagggagtgaaagaggaaggtgctaaatgaaatattctcatgtagttattatttgcctggggccagttcaagtttctaaagtaaatcaaaatatgtattttagctaagtttaaaacctttctgccttagccatgtgggcaactaaggagaagcagttgtgacccgctgtagaggtgggagctgttgtctctcccatcccccgcgtcccagccctgtgacatggcctttgttctctcgcaggaagtctcgggtctgaagaggaaattgagatccatcttcgggataggcaggcatcatttaagatctcagtatttaaatatatgtgatttgtctgttctaattgcttttcagttttgtttgctttctaaaaatccggtgtgtggtttctgctgtgtccttgagttggtaaaacagtaagagttataggatgttctggaggccgagcagcatcatcaacattcagtgtttgctgagtcgccagacatctgggctctgggatggatggagggacatagtccctgacctctaggaactttgttgtaaggagacatggcaaacgaacttgcagtctcagcagcagctctcccggcgccccctcctgccctccccccgctgtcccgtgtttctacgcagggtgcatgcagaggttttcaagtgtgagtgggttgctgcagcttgactcaagaacacttccccagcagggcatgctcctgggggagtttcacatgaaggcaactgaagaattctggcttgtccagaccgccgctctatgaccttcagtgagccaggcaccgttcggggcttcatgggactcctgctgaatggtgagccggtggtcccctgggtccatagtctcttcccagtaagactgaaggttctgagtcgagcagcaggtacggggccagcctgcccagggcgtaaggacgaccacccctggcctgggaggagtgccctcagccactccagaagtagcgtgggcatgtgccccgtgactggcagaccagtcagccctcggtggggcccttcctgtccagcccttctgctcctgccccacctgggagccactgtggtcctcagacctggcgcagttccagcctctcccgccccactgtcattcctgcctgcccatcacagtgcccacaaaacccagaggcctcccagccctattgccgtggtggtctgccttccggctccctcgccagcctcgtggcctcatgtcttgtcactttttccttgcctactggagccaggctggccattttttctccctcagacgtgccaagtaagttgctgtcccttctgcctggacccccagacagtgcccaccctgtgacttgagaaccccttctttgctcgtcaccctttatgaagaagacatcccatccccttctgcctgcatcattttcttccaggcacttaatgctatccgtcatcatcccacgtcctgtcccctccagggtgccaaggcacacgcagaggggccgttactccccctcactcccttcacgcctcttgtgtccagcagtgcccacggcaagcaggctgacaggccagggttcttgccttgtttctccaccatgccctctgctctcaagtttatctcctggctctggaaatgctgcccgctgctcgctgcaagtgtgaagccagaatattcaagaagtatatttaaagtaaaagttgagcatgctttccccaagaaaaggttttcatgtcagtgaactggcaacgcgatcacctcctgatggtctactgtcaactggaggctcttaggaaagtggctctgtcatcttctccagggtttggtgcagcccaggttcatagttgtggattatagtcctcgttccttttcttggggtagagagttagggaaatggacatgaaaatttttaaaaatatgcttggttcaactttgataacatacccttcatgagactctggggttatggcattgtgagctcaaccccagagctaggtaggagtcttcgtggaagtgctcctggcttcgcctcccctgcagctgctcagtgggacagcctgtgccagggcccctgaatgtgcagttctccaccaggagttgttattgacaagtaagtgtgcaatattaatttagccagatgctggcatcttcagaatcacacatgagtattgagaagtcatggctgaaactgctcgatcaatttaaatttaattaaaaagcatcgaatcaaagaataacatggcgaagtacaataataaccacaagcatctgcatcattttatatcataatccttttaaaaatttttttccaatggtgacaggtaggattaagcaggctgacttgctacgttctcttctactcctcaagaaaacaaggatttcctggcctctaaaagaaaactcaatttatttgtctgctttgatcatctgaagtattagatgtggactggagaatccttgggacttttaataatttagatgaaaggacacacaaagtcacctaatactacttaataatacctagtacctaatatttggatacagtatgtctgaattacttccgaatacttgtgaatttctaagcaaaagtatagttatttcattctcaggaactccctaaaaatgacaaagaagtgcttctggcatcacgagggaggttggaagcaggcacaatttggaaattcagagccagaaaaggcccatctccagcagggtaacagttctcaggttggggcggggggcctctaccctgcagtgggctctacagcagacccttgggctggcagacacagcaggcggtagagctgtgcctcacaggggtttggctgtatgggattggcgcagcccatggggcgtggagggctctggtctcctaaggggcctctgcctgcctgtgagtttgcaatgagggactaactggagcaggtggggtgacccacaggaggtggcctgggtacattcagctctgtcctggactgattctgtgaccttgaggatgagccagatacaattaatctgtgtgcacaaaaagacttggggaaaagactcctgagtgaacttcctgggtctcccggttttcaggctcagctctaagcaaggatagtggtgacttttggctttggcccctctggtgttaagctgaagccaaggaagttttcctgcctctgcatgtacttaggctggttgccccaagggtggcccagcctgtatggaactctctggagcagctaacctggtccaggtcaccaatcctgaaaatcagttggcctttctcacaatgtgccattgtggaatttgcagcaatccttgtttgcttttggctttatctatatattgactaggtgtttgggtccaggccaagccacttgctgtcctcttggagttgacatgctaaggcactagtacccgttatagggcccaggtggctgcccagcaatgcaaggggcaccttgtttattgttctcctgctgggtcataattaaggttcactattcagatgattccaaagccttcatgggcttgatctaggtgacctgctggtttgaaaggagaagctgtagtctcaaaacaccagtatggcaactgtttttttcttctttttaccccagttttctttcagcttctgcataggcacagagtcacctgggtggccccaaacttctttttagccaggctggaacgtaactttgcagggttcattccctctactgaaatgtttttgctacattggaggctcagctcattttttgaggggagcagggtggggagggaaatgctggtcttgtttcttgaaaggaaaatgctaatgtaacttgacttgggcctgagctgttggaaagcgggtctctgcataccttgagtccctccaacatgtcactatctgggaaggtcattgtgtccttgcagtccatcttgtgccttttctgtttatagagcgcagcaaacagggtcaggaacccatgctgaatatttaatgaggaaatatttcaaaggcggaggtgtgcttgcctgtcacctactggggctatatgtgggaacccaaggttgctggatccgtggagctttggacccaggccctgggctgctagaaccctgtggctggacttcagcagctcagaaccttctgctgggggtgctttgttcataattgctcaacagtgaggaaatggaagtggcgggcaaggagtggacttgccagggagctgtgtgtccccattgctcgcgtccaggatgtcatcctaaattgcagtacatctgctaatgaggagacaaggtgttaccttccgtttggagcagctgcattaattacatcctctcagacatcccctgtgcctaccactcctggccagcttcctttgttttaagttaatagaccaaattggagggaaagaggggagggtgtccttggagaccaggtgccctctgctccttgaacgtggtgaggacgttagctcaggactgggagctggtggcaaatggcaggctggctctgtgaggtggtccttggagggagttggggcccaggaggccacctgcatgaagaagcccactggagctgagaggacagtacctggtgtcagctccttcgacctccctgtgaccttgtgggggatgaggagaaggggctgagccatcctcctgcctgtgagtaattatcgtcaacacggagagagagatatgagccacaaagccagaaaccagaaaacaaaggccctgtgcagtgtcttcctgtgtttgagccatctctgtaagtgatcttcctgtgtttgagccatctctgtaaatgatcttcatgtttgagccatctctgtaaatgatcttcatgtttgagccatctctgtaaatgatctgtaagacaggtagaccttcatagggctgagaagccccctgtccgaggccagatccacccctccctttaccaagtcccccagaaaccccgctggtaaggtgctggctgagctcctcatctgaaaaatgggaaggccgagaaccacctctctggtctcttgtggaacctaaattaacaacttcgagtgattccctcatgtgtttcctcgcttgctgtctgcgggctctgttccgcgagccctgcatcaagcatattcctggcacacactgagggcacaggagatatttgatgagcagctgaatgtgacagtgatctgcacaatgctagctgctaagatcaactccctttgtcttcctgaatccctgctctctttcccttctttctcttatctttccctccccttccctctcccttcccttcttttcaggctatagctgaagggtgttgtttgtaggatccccggattggtgggtggctctagtgtgacaggcctggagggctgagcagtgtgagcctggcttaaggaacataagacagacttgctttacttttgcagctcaattgcttggctttcaatccctggattagtgggtttcataggagcctccccaggaagtcttgcacaatggagttcattggcttgagtagctgtaaccctgaaggtcaagttctttccaactggctgcttcaggatgcttagcaggccagcggggtaagcagcagtagcatccccctttgtttctgaatgagaaattattcccaagaagtcaccaagtgtgaaaatgtgtgttgtcttgctaatgggacactaatgaaatattaaagtggctttcttcctgtcagtctcctggggaccactctatcctctggattttagtctgtctttacataaagagccccggggaattaacatttcttggtacttttcaaaataaccttggtctttctcatgccatagtaaagaagttcatgtttccgttagataactgtctggcttagggaggggctctgtccctccgcaggggaggaggattttggtcggccctcccagcagcctgtcctccaggcggatgcctgctcccagctccctcatgccccacctctgcctccctctcagcagaagactaccccagttcacaggggaggcgctgtcatactgccccacactgagcttgagctgggagccaggcgtgctgcccgcctccatgcccgtcactgaatcctcccactacccagtcggcagctgggagttgtttctgtttccactgtgtggggagggaagcttgggcaccaggaggttgtgtggccagtcacagaagcaggatttgaacccagcccaggccctgtgaactccagcgcccagcgtggagttattgccttgccagcacctccctgtttttggctacaacttggtctccccaggctgccatcagcatgccgtgaccttgagtgatttacatgatctgtgctcaggttcctccactctaaataaattccctaagtgctttccttcctcttcatgtttgtaaacacttctggggacaaaaggatgtggaggaaggggtcgtattttagaggccagtttctcctttaggtccatgccctgtctttgctctggcggccactgcttggccccaagtccccttggcctggagggtgagttggcctccccaccctccgcttgctctgacccagtgtgtgcagtgccacatggccagactgtttccatcaggacggtcagagctctgctgaggagcctgcagaaacctcccagatctgcctgcttttggggttccctggccctccagccttgttggggtgccctccccagcagagccatcatggtaacgaggcattcttcccctagtggtcagcaccctgcttgaccccctgcgtggggtaccttgcctccctttccccctgcccccagcttcctcctgcatagactcagattgacttcttcccagaagtttcttcctgccctgggtgctgatctcttcttttcctgagtattttcaagtagctttatggatgagcgtttctgtttgattcagcacaaactgtgctgtgccaggccctgtgctcagttccagagatggtgctgaggaaggtcctcaggagggagattgtgggaggagaggactactagatgcatcacaaaagaggcagcgtggatgtgggttcttaaggcagagtaggatgtttgaaaggtagagatgggggccttcctggtggaagggactgcatgagtacaggcgtaggagcaggtaatgatgaatttggaggcaaatgagtagtatttttgtctggagcacaggatttccatcagtgtcctgagaaaggagtaaagaggctacaaggccagcttcttcactcatatcatctcgtactgcttttgggacactgggcacaaacacaccgacctatttctaagatgatccatttgagcatctgcctccctcacattaatgtaggttgcaaaaaggcagggctcatctctttttttttttttttttttgagatagagttttgctctttttgcccaggctggagtgcaacggcgtgatctcggctcactgcaacctctgcctcccgggttcaagtgattctcctgcctcagcctctcgagtagctgggattacagatgcctgacaccaagccctgctaattttgtatttttagtagagatggggtttcaccatgtcggccaggctggtcttgaactcctacctcaggtgatctgctgccttggcctcccagagtgctgggattacaggcgtgaaccaccacacctggccatctctgactttttcactgttctacctctgtgcacttgatatatttaacagatgctatataaggctttcaaataaatgaatatgtactctgagatgaggcggattctctcacaggcacatgcacacacggctatcggctgccctagctagtggccatgcaatggccattttttgtggcctccgactagtggttaggctgtgtggggtgctgtttacccactggtggaacctattcccaggcaggcccctaggaaggggtggcacatgtacatggttgggacagagaccttttccctctttaaggccaggtctggcttgaacgagccaggggcttttagtttagctgggctgaggcgctcatgtggccagggagatgctgggagcctgcagactctgggatgttactctgcgtttttttctcctctccccagaaacacgtttttgtctccatctgaccaactttttaatcttaatttatgagcctgctgtagcaccagtaaagacacactgtactgcctgaaagaatcactgctgaattctaattctgtgcgattcaaaggcatgcctttggccggagctgcttcaagaataagcagagcgggaggctcggccctgctctggctctgtgggcttgtcaggaagctttgccctggctgcctcttacgggcctcaggcttaattaagccttctgatttatttttcaattcattactttttgaaaaaagaaaagccactttaatggaagcttttaaaatccagacactttggattcctctactttgtcaggcaaaagtggattcgtctaagtagtttcattaaaaaagaaaagcatatatttatgaaggtttcagagattagatttttttactcctttcactccaggaacctaaaagccaaacttggaaaataatttttgtggttaggtatgtgcattcactcagccaagaaatctagtaatttcataagtaccctggatttctgcattttataatttccctgtcctgtcttcttggtgacttgggttttaattcttttcctgcccagcttcctgatgtgggggcattggtacaggctgtggtttgagaaatttcacaggaagagaagaagccaggccggaagggttttagtggagccaaggtgttcaagaaggtgggagcagtgcagcctgaagctagagagagtggacaacgtggtctagaaggagaggactgtgggagggagggctgtgcagtggagggctcatcacagggcttgccggagagggaggagaatcacagcagaagcagcagccggcctctggtttccagccctgtcagccatggccactggcgtggtgaggaagatggagtcagtagcattcatggtctctaagcaagcagtgatcctatatgctggcgaagcctgtctctctgactggggcctgcagacaggggtggccctgatgacttctccaagaccgtctatcctacaactgagtctctgaccccaccatcggtcattcttagacttcagcatgggggactgatcccctggggtctgtgcattaggagcccttgaatgtgccctagctgctttctggtgggtccctggcacttggagtgggtggtggagccctgagtctcctgggcatgcctgtgagtgctgttcgcggtctgttcccaggtgcagacatctcagaggcgaccaggctgccagagaaggggacgagaagggagccaggggcatgtgatgtctttgtgttcttcctctttgctttctcctgctatcgggtgggaatcctcaggaccacagagacctccgggtctcaccctgcctgggctggattcagctccaccacctgtcagcgcagagcccagggcgcttcccgggcatcacagagtagaaagctcatccgttttccaagaaaggacactaagacgatggccaaattgagttaggagtgccaggaatccagatccaggagccgccggccgagttcctgtaaggcccgccccacctctgaatgacaactgctttccgagtttctgcagggaaaccaggctgctctcccccagcatttacggcagcttgacttacaggccctcatgtttgctgcacactccaaatcaattctctctccttctttaaacttttatcactttgctgtatgaataaggccactgattttctaggttccatgtgcttttatatcaggatttttctttcttctctcctactttctccacaagcttgttctgaacacctgctctgtgtgagacccatggtgggctccctaggcatccagagatgaactggttgtggtcctgggcctccaggagttggcactctagggagggatggggaagtagcctcacagtagatacgttttctgctttgttcacccattgagcagatagatacgtcatggacacttattccgtgcagatgtcatagcaggtgctgagctgtacaggtgatgaacaagaccaatgtggacctgagcttgccgtgagcttccactgtagggaggcggaggcctgttgaggtacatgaggggacaattacaggccattctggagctcatagaaaagcccacgtagtctgtgtggggtgggtcagggaagacttctctgagcaagtggtgtctaagctgagacatgaaggatgagtgagagttagccaggtgaagggggccagggagagaaagattgttccaggcagagggagttgccctataaagagatggcatccagggagagagtggcatgttcatgacagtggaggaagccagagggtttgcagtgtggggaatgagcctgttcatgacactggaggaagccagagggtttgcagtgtggggaatgagggtgtggctggtgcaggatgagggtggagttgtgtgcaggtgggcgggatgcagggcctggtaagccgtggtggtttaaatgaagtgccgtggagggcctaggagagagccagctgatgagatatctgacttggagaagcccagggtggcaagattggatgcgaggaaactgttaagagaccaagaacttgcaattattaacctaggtgacagttggcccagagtgtggcaatggagctggagagaagtgacagattcaagagattggtaagaaaaggaatctgtaggacttggccatcgatcagacattgagggtggggggaagggaggcgttaaggacagccctgaggtctctgttttggcacccactgccatgacccaggaggagcagaggagagttcagttggaggccgccctgagacagccaggtgcggctttgcagtaggatttatgggcttgaaattcagagccaaggatagcccaggaaatacagatttgggagtagagaggaagacccacaggagagggcagagtggggtgggggagggggccccgagaaagacgcagcaaggaggggaagggcagaagcaaaacccatcgggggcggggggggacatctacatgccatctttggtgctgtgaacaagggacagtatttcagcaggtggaggccatgggtcacagcgaagacgttccaggtagctggaccaacatgaccaaggtggagaggcaagaggtgtccatgctgtctgggacctaggctgggtggggctgggttaggcctcacatctagaaggccccaaatgcccaagttcttgggccttgcttgcttgtctctaactttccttctgtggctcctaatggtgaaggcctcccatgctcctgtttgggaagaattatgcaattattcctaaatggagtgcatgtcagcagccctggcactgaaaagggaagacatattggaggaggagaaacctttcacccagccctaaaccagctgcttctggagagtactgaagaagaataatatttttttaatctaaaagaactttacatttatgcttgactgaagcacaggccacatttgtcctgggagccaatgagcagacagagtttgggtaatctatgcaaaggcccctcagctgccctgcatccatcatcccaagtgacagaatttacatcattaatcattggcagtaatagaaaagtcattggaatagaatgttgtcacagataaatgtctcccaattgcatataaatgtctcggctttactgtactatttgtgcttgagaaatactgtggcttcaaaacggtatttatctggcattgggaaaccatcaacgccagcctgccttgccgacagcacctcccgaggaactcagaacttcccccgtgggcctcaggcccaggatcgctgcacatctctgcccatgacaggagttgggcagagggaggggaggctgggctccttgggacttcctggtggatgacgcctggggagttagaaaacactcaagttcagtcatgcccaccgcgttcccccagcctgtcaccctgtggctggagggtggcttgctgccacttgatgcagagaagaaaggagggtctgaatcgggcccagcagaactagccgctctcatggcctcaaattcaagggtgtggccgctccaaaggcaccacaggccacagagaaaggagaggcgaccctgcaagctagaagccaaagagctgaacattggaaggcctccttaccatttttgaaatgaagcccacagtggttttgggctggcgtctttctgttttgtgacctgaaaacactctgtttttggaaagtgcagatctgctgacacctttttccggaggtttgtgtgtttctctccgtggtgagccgccctgcctctgacagggccagatgctggcaggaggagggacgtggcttagggagcaaggcattttttgctcaggtttgaaggaattctttttgtttgatccttcacctctctatcccctcaggggtcctgcagccctgctgggcctggctggaggagtgggccccagaggcaaggcaggcaagtcaggggttctgaggcaggaggatgctgcctctggtggatgggcatgtggggctgtgttaagggtgtgcgacagccatgaccagtgagctgctggaagctggagctaggtgtctgagctgacaagccagggcaagtttttgtagagtatattttaagaggtagatctcctctttctacagggaatttcagaaatgtccacttctcagatgtggaagtgatctgagaccagctagctgggtgttcccaaaccttgatgatgaagaccagtcaaatttcagaacgctggtgggtgtattagtctgttttcacactgctgataaagacataccgaagactgggcaatttatgaaagaaagaggtttaattggactcacagttctacgtgaatgaggaggcctcacaatcatggcggaaggcaaggaggagcaagtcaccttatgcggatggcagcaggcaaagagcttgtgcagggaaactcccccttataatactgtcggatctcaggagacttattcgctattacgagaacagcatgggaaagacccacccccctaattcagtcatctcccactgggtcccccccataacacgtgggaattatgggagctacaagatgagatttgggtggggacacagagctaaaccatatcattcctcccctggtccctcccaaatctcatatctttacatttcaaaatcaatcatgccatcccaacagccccccaagtctcagctcatttcagcattaacccaaaagtccaagtccagagtctcatctgagacaaggcaagtctcttctggctatgagcctgtaaaatcaaaagcaagttagttacttcctagatgcttcgggggtacatgtattgggtaaacacagctcttccaaatgggtgaaattggccaaagcaaaggggttacagggcccatgcaagtctgaaatccagcagggcagtcaaattttaaagttccaaaatgatctcctttgactgcatgtcttgtgtctgggtcacgatggtgcaagaggtgggttcccatggtcttgggcagctccgcccctttggctttgtagggtacagcctccctccttgctactttcacaggctgttgttgagtgtctgtggcttttccaggtgcactgtgcaaactgtcagtggatctgccattctggggtgtggaggatggtgaccctcttctcacagctctactaggcagtgccccagtagggactctgtgtggggctctaatctcacatttcccttccacactgccctagcagaggttctctgtgagggtcccacccctgcagcaaactttttcctgggcatccaggcatttccatacatcttctgaaatctaggcagaggttcccatacctcaattcttgacttctctgcacctgcaggctctagagtgtgtgaaagctgccaaggcttagggcttccaccctctgaagcaacagcctgagctataccttggtcccttttagtcatggctggagcaactgggacatagggcaccaagtccctgggctgcacactgcacgggaaccctgggcccagcccacgaaaccattttttccttttaggcctctgggcctgtgatggaagaggctagcatgaagacctctgacaagccctagagacattttccccattgtcttggggactaacattcggctcctcgttatttatgcaaatttctgcagcaggcttgaatttctcctcagaaaatgggattttcttttcaattgcattgcaaattttccaaacttttatgctgtttcccttttgaaactgaatgcctttagcagcacccaagtcacatcttgaatgttttactgcttagaaatttcttctgccagataacctaaatcatctttctcaagcttgaagttccacagatctctagggcaggggcaaaatgccacctttttgctaaatgtggcaagatgccactctttgctaaaacttaacaagagtcacctttattccaattcccaacaagtttctcatctccatctgagaccacctcaacctggaccttattgttcatatcattaagcattttttgtcaaagccattcagcaagtctctaggaagttccaaacttttgcacgttttcctgtcttcttctgagccctccaaactgttccagcctctgcctgttacccagttccaaagtcacttccacatttttgggtatcttttcagcaatgccctactctactggtaccaatttactgtattagtctgttttcacactgctgataaaagacatacccaagactgggcaatttacgaaagaaagaggtttaattggactcacagttccatgtggctggggaggcctcacaatcatggtggaaggcaaggaggagcaagtcacatcttacatggatggtggcaggcaaagagagcttgtgcagggaaactcccccttataatcccgtcagatcccctgagacttattcgctattataagaacagcatgagaaagacccgtcccgctaattcagtcttctcccactgggtccctcccacaacacatgggaattatgggagctacaagatgagatttgggtggggacacagagccaaaccatatcagtggggctgacccaggatggccaacttctgatttgaccaaatgaggccattaaaagccagttgtcagctactgtatcatcatttcataaaatgaaataaaggaaagaatattttgacaccaacaatataagaaggccatcatttcaagatacaaaatatttcttcagttgattataattggttttatgaaggatttgctccactatacctgtttttttaactccccctttttccttatttctcttttttttgccaaaaactcacacaattctgttctgggtccccaggcctctagtttcagatgagcaaaagcaggtgcagagggaagggacctggccagggtccacagctagtgagatttgtgtattgtttcagttatttctggcttcataacaaatctctcctgactcagcagtgtgaaacaacagtcatttattattatcacctctcttggttctggggctggcccaagcagcttcacttggggtctcagtgctgttgcagtcagatagtggctgggctgtcatcttaaaggcttctctgagtgggtctgggaagatgcaagcatttggggacagagcagccagggctcctctggcatccctttctccatgtggttttcagcatgacggctgcaggacagccacatttctcccctggggcctcaaatgcatgtcctgagaaaagccggtggatgctgtgttgcctttcatgaactggccttgaaagtcacacggcatccctcctgccgagttctattagttacaagtgagccattaaggccagcctgtattcagtgggaggagaattggcctccacttcttggtgggaggagtgccagaggatttgcagacatgttttaaaaccacagtgtggatccaataggctaagtccaaagcgccctagggagggccaggttttaatttggagcgctgggatcttggaacacacccccttccgttaagtgttccaggaatgagtctgctggaggatcactccggtgacggtggcaagctctgcttcctggtccctgcttgcacttgtatgaagtgataaatttcacgaataaggtagattccatcaaataagtatcaattaagctgttttatgatctagttgagatgatgaattaaagtcgatttagataaatgatcagtaaaagaacagagacttcaggaagacagcataaactctctgaattgcaggcactcactcttcatcagaaagcagcctcccacacttgtgcacttgttgagcgcttgctgtgtgcatagatagcactggctggtgctgtccgaccagtgatggctgcagtggtatgtggaagcgagaggggtcccagtttgcactcctgagtatctgtgatccaattcgggtcatccctgtgccatctgttaggatctgagtgtgggaagggggagcactgatctcttttcaatccccattcctgggtgtgggctacctgctttcagtttcagggaacagagatgccctcaaggttcctgtttagaggggtttattgtaagagttctctgaaagatgaggaagagaactagaccatcccaaagccacgaggcccagcccctggctcagtgccggcagccctccttgttgcttccagggaggcctggcttattcaaggtccacaggtgtgaaatggagggtggcggggctgggggcttctggtatgcaggaagagggcagccacactggtggtttcctgtggcggtgagctgggggtgttggggtcagcctgggaagcggggagtccatgtgagtgaccaatgtcctagatcctctccttctttcatggatagtaagcacctgtcctatgtcaggcacgcctctagaaacagggcagtgaacagatagacacctttaccttcccatgagactgccaagaaggtgatgtcctctctctgaatcccctagacctgccaatttggtggataattgttttctatcacagctcttggcaaaaggaaggggaaaaacaattccccaaggtgtagaattcaccagagagaacccccattactcgcccaagaccattaggctggtctgtgacttccaaaatgaaggggctacctggttgtgtccacaagaagaaaatggaggcttacccagagtcagtaagagactgttaggaacgcaggctgagcctggctggccacacggcatgactttgttcatgtcatgaatatttattgaacacctgccacatgccaggcactgttcccgggactgggtgtgaatagtgcacaagagggaagcctccctgctctcttggcgcttaccttctagctggggagactggaaacataaagatggtgcaaaggccgagtggagaaaaaccaaactgccaggaggggctcaggctgggaggggatcaggccagctgggagggggtcaggccagctgggagggggtcaggccagctgggaggggcttgctgagcggaccttgagcagcctcctgcagggtcctggagtcagtggtgcccaccccacccctgagctggggctgagggctccacgactttcatccccttggggtgcagggaggtgaccaggggcggccctccctggcctggcttctccctctttcacccactgagtgtcgactctgcctttctgatctgggtccctgtgaggaggaaatatatatttagactcttctgtactttccgtggtaacagccgctttattcctggtgaagaatgaggaaaatgggtcagctgtatttactaagaagcatgttccagcttcttttccgaggctatttataaactttaaaaaatgcgagctaagtttttgcatcttattggaagccggagtgcctatgaataccctttctattactataccggggaatctagcacttcggaattgaaatgcgttgagtagggcagataggaatcttgcaaatagtgattttgatgaactctggcagcccacatttgcctcttggtctgatttctctgggagttttttcatgtgacattggtgtagctttcttggatatggttgggggggactgtgctgtggctacaaacagctgactggctatgctggcccttcacggccggtgtgctgacaactttatctggccttggagccttgaggaggggctgctgccagtgactgggccctgcttttgaccagccttgcacactgggcagtgggcagggggcccaagggcagaagggcctcctgagcatggggacttggagaagccatttctgaacctgctccatccctgccttgtctctagggggaatggggccatgaggcctctagaagcttcgccttggcccaggcctctttcccacatttcttgatgggccaagagccgccagcagccctcctgtctctcatgcctcccctgcgcgtcatggggttacacgtgtcctcacactgtgcctcgtgcaaaaaaagggtcacttctccctttctctctaagtggcctgacctcgctttcgagggggaaaggcttgggggtcctacattttaggcccactctggtggatttaatcgaatggctcaaattgcctcttgaggtaacctgtgttgaggctgtgctcgatctttccaagtgcctcctctcctgctcccctcggcgccttggagtatggggaggagtgcgtccctgtagcctggaggtagctgagggaggggtctctgccctccagccactccttggtaccctctctggttccttctgcagagaggctggactattgagccccaggagcaactagccccgtggagactttgctggggaatcctggcacccataagtggagccctggtcccactgtttattttcttggcttttcaatacctcttcccaagaggcatctccattctgacagtgtgaggtcactggagcctgcaggccatagggccctaagctgtccgctggctgatccatcaccaggaggcagggtagtagggcaagaggataggcatggggcctcctccccctcccggctccagctgtaaccctgaggacctgacttcctctccttatgcctccatctcctgtgggtatcatgtccataatctaagtcacagccaccactactgccacttactgagcacttaactctgtcccaggcgctgttcctccctgtgtcatctatgaactgattaaatccacagggcaaagagggctgttaggagaatgaaataagttactcaaagccacttgctcaggacagtgcttggtggttgtcactaatgatcactctcatcatgcctatctgccccacgttgggaggggatgggccaagttctccccagagcagaagttcccaaactttcttgcatcttgtactccaagtgcctcagtgacctaccttcctttcctctcctctcctctcctcccctcccctcccctctcctctcctttcctttcctccctccctcccttccttcctttctctttctttctctgtcttccttcctccctccctcctctctcttttcttttctctttctttcttttctctttctttctttctttctttctttctttctttctttctttctttctttctctctctcttttcttccttccttccttccttctttctttctctctctctttctttccttccttccttccttctttctctctctctccttctctctctccctttcctttcctctctctctcattctttctttctcccctcccctcctcttcttctttctttctctttcattcccttccttccctttcatttccttccttccttccctccttctctccttccttccttctctcttttctttctttctttcttttttttttttgaaacaagatctggctctgtcacccaggctggagtgcattggctcgattgcagctcactgcagccttgatctcttgggctcaaatgatcctccgacctcaacctccaaagtagctgggactacatgcacctgccaccatgcccagctaactctttaaaattttgtagagatgaggtcttgctttgttgcccaggctggtctcagactcctgggctcaagcaatcctcctgctttggtctcccaaagtgctaggtctcccaaagtgctagtaatgagccactgcacctggcctcggtgattattttttttttaatttttatttttagagtgcagtggcacaatcataactcactgtagcctcaaactctagggctcaggtgatcctcctgcctcagcctcccgagtagctaggaccacaggcatgcaccaccatgcccagctaatattcattcattcattcatttattttgtagagatgggattttgccatgttgctcaggctgatcttgaactggcctcaagcaatcgaccacgtcagcctcccaacgcgctgagactgcaggtgtgagccactgcacccagccgcctcagtgattttttttcctgatgtccctaggccaaaataaatatctaacagttccgtttattaagtagttagatataaacaccttaataaacatttgtgtcctaacaatagctgtttgaaaatataatgcacataattttaaaaattccattcttaaataaccaaattacgaatgggatatgtgtgcctatcaggcactggacaactgtaaaatcctgggatcagattagacaccagtgccctcatttcctgtttcatattgatttttgtgaggtactcactttttctttcagcagccactgaaaccccagctttaccatggcctgacatcctcagaagacatgcaggacagtctaatggtgaaactgtccactgcctcaagctagtgggaccagtggtgtccggcagatgttaagtattgcttgtttcccacaaaaatgtaaatattcctgcaggtctcctgtgagttagcagaggctcctcaggcagccttggtgcacagtttgggaaccgtgtttctagtgacttgtggccttcccctagctacccaggaaactggccaataggcctgaggctctcagactcctacgtacccatctggcagttgcaggagagacgacaaggatccaggtgtcctgccttcttcctgcctccctcctcccacaatctctcaggacaggaggggccaggctccactctctccgctcccctgcatcctgttctcctcctgcctggggcatcagcctcaggacccagccaccagcgctggaaggggcatcttctttgtggccgagggagaactcggtgatctgaatcctctaggatgtggattcagaaaaccctccctcttaacagagcgctttcaagtctgtggccacgctgctgatgctaacagaaatcagtcttgccgttcagagcagagaattccctttgttgttttggtgcgtacgtgccctctgcctgaagtactgaaatcattgcttcaaagggcagggagctccccaaaccactagacttataagacagggagtctgaagagatcagagagagaatcgggtgttcagtgcctttgtgttcagcaggtgcttacgtcttagggacaggtcgactgtaaactcaggtgtcttaggataggtgcttctgctgttctagctcccacacagcccctcccctttacctttattcccatctgccctccccaccctaactctcccctgggaagatgcctgccgttgcctgttcccagagagccccttacttgcagtttcagagcctgctgcctcactcctcctccctcactgacttctgtcaatttgaagatctcccagctcattctcaccccaggacctttgcacttgccattccccctacctggggttccattatcaggcccgtccttggcttgccccagctcattttccaggtctcactttaaatgttactccttaaacagcccagccaagagcaccctgtctaaggcaggcccccagctcctctgtttgctcctcatggccctttaaatgcaagcttcatcatgcaggcagagaccacgtccatctgcatctaccatgttcactgttgtttacttagcacttagtcctgtgcctggcccatcggaggcaccagcaagcgtgtctgtaggagtggggcttccgcaggacagtgctgctttttattattatttttttaaatagaagggacttaagggccaatgacttttaattctgctgagtaagatgtagaaaaattacagctaccatatatcatcaacatgttgtaaaagttggaaggacatactcttagaataaagaacagttcttttcttttcttctctttttgttttgtttcgtttcgtttcatttcaagacagagtctcgctgtgtcactcaggctggagtgcaatggtgcgatctcggctcactgcaacctccgcctcctgggttcaagtgattctcctgcctcagcttcccaagtagttgggactataggcgcataccaccatgcccagctaatttttttttttttgtttgtttgtttgtttgtttttgagatggagtgttgctgtgtcgcccagctggagtgcagtggcgtgatctcagctcactgctagctccgcctcctgggttcacgccattctcctgcctcaagcctcccgagtagctgggactacaggcgcccgccaccacgcctggctaagtttttgtatttttggtagagacggggtttcaccatgttagccaggatgatcttaatctcctgacctcgtgatccgcccgcctcggcttcccaaagtgctgggattacaggcgtgagccaccgtgcccggcctaatttttgtatttttagtagagatggggtttcactgtgttggccaggctggtcttgaactcctgacctcgtgatctgcctgcctcggcctcccaaagtgttgggattaccggcgtgagccactgtgcccggcccttaaaggacagttctttaaatggcataactttagcactattgaaaacctgctgtgtcgtccctcttctcacctcttggaggttggatgaaaattctccttcggtccatgagcacctaggaggtgctgcatttgccctcggtggaacttagtaacccattcaatgtggtcttgaccgtgctctcgtggtatttgtcccctacaccaggctgtaaatgctgtggcgggacatggtgttttaggatgagcctttgcaccaggctgtaaatgctgtggctggacactgtgttttagggtgagcctttgcacatgctcttccttctgcctccagtaccttgttggtctctgggtacctccaagttctgcccagacgccctctcctgaagctttgcaggactggccttgcctctcctcgatccttggtaatcactgtcgactcgcctgcctgctgggatccaagtcttctctgttttggaccagggtgctggcgtaccatgttcccaccattgtacaccgtcatatgctgaaggatgaaggatgttggctggtggcgactttgagtatgtggcagaaacagataggccaccctcaaggactctacatggagcccactctgtctttctgtaactgattctaatttctacttcagtctttcattccaccaggttacagaaacagaatcacatttaattgtgggttttctcagccaacagaaagttcctccagcctcctgggtttgcgcgcatgtgaggagctcatgggggttaggggttcggccctcatcactgctgttccccagctctctgtacccctgtgcaggtctatgctgtacccccctttgtcctaactgtggggtctctgaagggaagggtgagatcctcagctgcttccacacccctcttggggagcaagggaccatttggctgtcccctgaaccctagcagccatctctggtctctggggctcacggaaaaatgctcattggctctgcatgaggagtaaggctcagcccctgctctggagcttgggcctctctggagtcttagcccactcttcaccaggcgtgggaaggagcatctgtttccttctcctccctcagcctggctctgggcagggagtggcccttgctggccttggctccgccgcgtctcctctgcacacatctgggccctagcttttgaaattctaaagccacggctttgattcttctgttctctggttcctcataagggcccttccctggggcatagatgcctcggtctggttagaataaaaggctacaaggcatgggggcaaaaagaaacctccgttcatacccccagtggttaacctgcagctagctgctcatctgagggaagcaagagggtgtgggctgggcacccctagggagcttacttttaaaatgtgcctgtgggtgtgggtaagtaaatgcagaagctatttagcattctagcttatttgggtatttttatttacttaaaaatcttaattttcagaggtaatatgtgttcggcgaggaaaggaaaaacaggaaggtgaatagaatcagagtcacttatctcagcacctggagatgccctcattccatcctggcgtgtgtctctacaggtagcgtagtaataaaagtagtggtaattatagtactaaatggaacacacacttaccgagggcttaggaagcgccaggcatttttttaaagaatcacgcagatgataatttaggaggagcctttgtacatcctcttccttctgcttccttgttgatctctgggtacctccaagttctgcccaacgaactaacgaccctgtgatgtggatattactgttttcctcactgtaccaatgaggaagttgaggcattaagcattcatgggatttgcctacgctacgtggctgggctgcctcgctgtgcacacatacccccacatgcctgcagatgtgcacattaatggccaaggtatagaatcagggttcctggtctagtttcttttgggagagaaaccatatctttgttccctggggacttggtacctcatttgctgaatgaatgaatgaggagagggggatgcttttgaatttggatgcaagcttttctaccatcggtcacaggcaaattactgttccatttggcaattattatttttctttcctgggcttataacacctgtacgcactggtgcctccttgtgtgacctcagggaacaccattcacattgtattcttttctgaaaacagctttattgaggcataattgacatataataaattacacatatttaaaatgtacaactcagtgagttctggcatcaccatcgccaaatcaagataatgaacgtacccatcaccccagaagtatccttgagtcccttggtgattgcttcctccagggcctcccccctcctcgccaggcaaccaccactctgctttctgtcagtctgttagttagcatttctagggttttatataaatggagtcatacagcatgttgtctttttttggggtctggctcctttcagcataattattttgagattcatccatgttgtgtgtatcagtaattcatttcttttcattgctgagtagtgttctgttgtatggatatgagacaatttgtccatgtacctgttgatggacatttgggttatttccactttttacttttataaataaagctgctgtgaacatttgtgtgcaagtctttgcatggacatatgctttcttttctctcgggtaaatgcctaggagtgggatggccggatcatatggaaactgacacgttgctttgcaaagtgaccacgctgttttctatccccactgcggggtatgagagttccagtttctctacatccgcgccaacccttcctacggtcagtctttgtcattttagccattctaacaggcatgtggtatatctcgtcatggtttgaatttgtatttctgtagtaaataatgatgttgagcatctttacctgcatttagccatacccatgtatcttctttagtgaagtgtctattcaaatcttttgtcctttaaaaaagtcgggctgtgttcttattattgttttgagagttctttatatatattctagataaagttctttatcagatatatgctttgcagagattttcttccagtctgtgatttgtcttttcatcctcttaacagtatcttttgaagaacagaagttaattatgataatgtcagtttttttaaatcttttttttttctgtttttagggatcatgctcatggtgttgtatctaagcaatcatcatcttttttttttaattaaaaagatgtgggtcttgctatgatgcccaggctggagtgcagtagctgttcacagcctcgaacccctgacctcacatgatccttctgcctcagcctcctgaatagctgggactacaggtgcatgccattgtgtctggccatctaagcaatctttagctaatgcaaagtcacaaatattttctcctgtgttttcgtttcttttttttttgagatggagtctctggagtatagtggcatgatctcagctcactgcaacgtccacctcccaggttcaagtgattctcctgcatcagcctcctgagtagctgggattacaggcacatgccaccaaccctggctaatttttgtatttctagtagaggtggggtttcaccatgttggccaggctggtctgtaattcctgatctcaagtgatctgcccaccttggcctcccaaagtgctgtgattacaggtgtgagccactgtgcctggccttctcctatgttttcgtctcagaattttatagattttaaaatttaggcctatagtctattttcagttaaagcatatggtgtgaggtatgggttgaggttcgtttttcattttttttttttttgcacgtagacatccaattatttcagcactatttgtggaaaagactcctctttctccactgaattgcattttgcccctttgtaagaaatcatttatccatatatatgaaggtctatttctggactcagttctgttaattgatccggtggtctgtctttaagccaataccccactgtcttgactagtgtggctgtataacaagtcttgaaatcctgtgaatctaagtcgtgttagctctgcaactttattcttgttcaagttgttctggccactcgaggtcctttgcatttccatatggattttagaattggctgtcagtttccagcacaaagcctgctgggattttgattgggattgagcctcacattgctctctgcagatggcctcttctggagctatgccacctgctgtcctgccacaccggtgggtgtaggaccatatgagtgactgaggggccagcgcccgtggtcggcagaaggggaggttattggtatttaataaggcattttcagagacactctgcattgaccttagggtttcaggatgggatgcttttggctgagcccaggtgtcctctgagaaatgtggaccggaaggatgaggcatgctcccggaagttagcatcgctcatggccctcagtcagggcatggcagaggaaccacccctcttgtaaaagaggcacacacagccctcctgctgtaatctgccccatgtcacctgctttaggcattcatatttgaggctccacggatgtggtgaatgggtgccctgggaggatgggtaagggcaggtgtgggaggaatttcctttccagaacattcctttgaggaggagagaaaaggaacttggccactgtggacccgcttgggctagctgcgtgtctctgtgtgttgctggctgtgacaggtactgtggaatccttgccttccaggggagacctgtggccggcaggagctgcccgagatcccggggcaaatgcctcccctcccttcaccaccaccccctcccctctctcccctcttatgcccgcaccatggctttacctagccctgctcttcagtgaaggtatcttgcagagggcgtatggttggagaggaaggcagggctctgaggatgctatgatgtgccatttctttgggcttttccgaggactgctcacttgaggcttcccctggggagaaggagctgttaaactgtcaaaataaaaagtccaccaaactccttaggccagtcgaaagcacctaactcagaccacaggcagcaagagcaacagatttccctgcaatatgttacaaggggaagaaaagactattggggaacttaaaagaaatgcaggaaaagtttcaaagatgggaatatacctagtcaatcatacattaaatttgggattcataaaaagaaattgtggtgaaaatcttcccaaataagtttttattctagaatttgatgacaaatctctcacggcgctggttatcccgtaggtgtggtattctgaaatacaacccgaggcatatatattgtcaaataataaagtattatgaaaccaatcagctgtgagctccccacttggcagtttggaagtaaaaccctttctcctttacaaggccaagtgactcttaattcttcccaggagatttcacgttaaaatgtgttcactgccagctgacaaaagaggcgagtccagatttattaccctggcacctgcagcaaaaaaaaaatgacggatgatgaaaatatatttaattatcattccatgccacatctctgtctgctccagtcgcggggctgcagctgttggcacacactttattttaaagtcaatgtgcttatctggagagaaggctgctctctgaataaattgacttgagggaggaaggaaatggcgatctcctccagacccagctgaacaaatgcagatttgtattctgtgcgcctgctttaattgtctaatccgcccgacatcacatcagctctgggatttggcttttgtaaagaaaacatttgcaaaaagtaaacttttccgtggttttcttgagccaaaatgaatgattttccttcctggactgaaaagtgctggccgacagtggatgctcatgtttctgctgcaggcacggaaatcactgttagttgcatctcagaatggaaggagccctagacagtccctggtggaccgtctccttcaccagatggagaccccgcagagtctggaggggtgggctcagggtctcagaaggtggcaggtcggaaactggagaccagaacttctggctcccaggaagccactgtgtttttgtgactcgaggctgtcggaggtctaactgtttaaggttatgcgcctgagcctggaggatggcctcagagaattgccttcctctttctcttccgttaaaaccttctggaaaataaaaacttgggatggagcagcagtgccctgactgaggtggaaagcatcagatttcttggagtgaagtctgcggggacttaggttggctgctgaaagtctgtgccattagttcctgcctatgatgtgttgttttcgacaaaagtagcccagataataggcagtatctaatgtggcaattttcctatatctcttcttatcaggagaagccactcgatgttttgtatatggtgggatttagtacaaagtgatggcatttccactgaaatgaaatacaatcactggtttagcagttaggattcagggaggagagatgatgctgagtgtttctggtggtgcctggtgtcactggtggccagaggcagatgcctgtggatgggggcaggagggggatgaggtttctgtaaatggagctaactcaggggttgggggagagggaggctcatttctcctgaccttctctttgatgaataaggattcaagattgtatctgctgagcctgcaggacatgagaactgggggaggaaagagagctctggcttatggatttgggctgtgaccagagctcttttgccaccaagctttttgatgtattgaccagaagttactataaaccagagagagggtggggcgtggtgactcacgcctgtaatcccagcactttgggaggccgaggcaggtggatcacgaggtcagccgattgagaccatcctggctaacacggtgaaaccccatctctactaaaaatacaaaaaattagctgggcgtggtggcaggcgcctgtagtcccagccactcgggaggctgaagcaggagaatggcgtgaacccgagaggtggagcttgcagtgagccgagattacgccactgcactccagcctgggcgacagagtgagactctgtttaaaaaaaaagacaaaaaaaacagagagaggattccactgccgtctccatcatcatcaccaccgtcaccattatcaccatcataaccatcacttatcaccatcaccattcaccacttaccatcaccatcaccattcaccatttaccaccaccatcaccatcaccatcatcaccgtcatcaccaccataaccatcactgtcatcaccataatcatcacttatcaccatcatcattcaccacttaccaccactatcatcaccaacaccatcatcatcaccactaccatcatcaccatcaccatccccattcactacttaccaccaccatcatcaccatcaccatcaccattcaccacttaccaccaccgtcatcaccatcaccatcaccattcaccacttaccaccactatcatcaccatcaccatcatcatcaccactaccatcatcaccatcatcatcaccatcatcattcaccacttaccaccaccatcatcaccatcaccatcatcattcaccacttactaccactatcatcaccatcaccatcaccattcaccacttaccactaccatcatcaccattcaccacttaccaccaccatcgtcaccatcaccatcatcatcaccatcactatcaccatcaccattcaccacttaccaccaccatcatcaccatcaccatcatcatcaccatcactatcaccatcaccattcaccacttaccaccaccatcaccatcaccatcatcacagtcatcaccatcataatcatcactatcaccatcaccattcaccacttaccaccaccatcaccatcaccatcatcactgtcatcactaccataaccatcactgtcatcaccataatcatcactgtcaccatcaccattcaccacttaaaccaccaccatcatcaccaacactaccaccactaccacctcacttaatttatgtatcacttcttatgtaccagacctttggagaaatcccttaaattggtcatctcctttaatctcagggggcagatattctgcctgttttacagatgagaaaacagaagtctcggtaagtaacagaactaggacttgaagccaggacttggagtccactctcatagccatacctttttatttaggggctttaaatatatacagtactgttaagattttataggataaaaggatgaaaggagacgtcaactctgtacttttgtcaagagaaatgtttgaggatgcaataattttgagtttgaagactggcccatggggatttcctttcccatgtggctggcaaatggggagagaggtacccccctcagctctggggaccagggcggctgagagactggttggctggggtcagggctggggtggggaggatggaggaggcgctgcagagagctggccctggggacttggttgcgtcacagcaggaggtggggagcaaaggggaggtgccaggctctgctccatgctggcagccctggggccacggcagcaggggagggatgcgtctggggctcttgaaggcttggctggcgggccttgggaaagaagtcaaccatgctgtcctcccaggtctcctgggctatgtgagcagcagcatggcctgttctgctgtgtgtttgtcctgctgggttgccttgttttcacatggtcagtcggagctggtaggctgggccaagtggttcatactctgatctctctgtcctggccacacagcctccaggaagcttgagctttgtttttctggcctttcatgatctcctctggctccctgtggcccatctgggactctgggtttggtgcttgactgcggtatagactgaccagtattatggcttcatgcttcttggctgagctgcccagacacatgacagggctgtggccaccagaagatggagacgtgtcacattctcctcgctgccctgcggccccactgtttacatcagttcccaagacgtttgggcctgacagatatgagtctctcaaagagcagcttttagcagatatttgtcatgcgtccattgtccaccaggcacagtcctcgccctgggacccagcatgaatgtggcttgggaaaactcagggagttgccatgacccatagggctggcccacacactcacatgtgttgttatgagaccctagggcctttgggatttgggttcgtaaccagaggagcaggcgtggagcgtcagaggtcaaggagatggacatgtcatcactagttcagcaggggaactgcgggcaaagaaattaatactgattttatttccaagtgaggctgatgactctcctttttacattaatttttattaagcattttatgtattattccaaaaccacatactatgcagagacagtttagaacacattatgggttgtgcatttcataattatcatatggcctcagtccagaatgtagaaaagaaaataaacacaatcattttccaatagaagggaatcattgataatgtgtggacaggacttggagctgccagcaccgcccatgggctctgggctcaggacccagcacaactccatgcacagcaaagtggctccaacctgtcctcctgccatggcctcccgtcctctctgtctccagcctgcaggggtcctgcttagcctggtcccctgtggcgagagttcttcctctccaccttctgctgtctggaccctatttattccctggggcaggactcagcacagaagcccttcttgctgctcagatctcacctcagagaagcccaaacccaagcaaaccccggtcacccttcgtcacggcgcagggctctgttttcatcttggcacttcctctccaaggcttctgcctagcatctgtctccctgcttcaatgcaagctccatgagagcaggcaccttctctgttcaccccagcaccccaagcaactgggcgagtgccgggcacagagcaggcatgagcagatgctcgctggatgaatgcatgcatgactgtgcatctcctccactggactgtgagctcctccaggccagggacagctctacgtggccacatggccaatgccagcatatccgtgtctaagcagaagtgtgttgagttgagtccccaccctgcacctgtgaaatcttcaactaggtgctgggatggagtttgtattagtcagggttctctagagaaacaggacccctactatatatatgaatgatatttatgtgagatttataaggaatggctcatgagattatggaggctgagaagtcccatgatctactctctgtgaactggaaacccaggagagctggttttggaattctagtctgagttcacaggaacaccactggtgtaagtcccagttcaaggtcagaagaccaaggcccagctccagcaggcaggcagagagagggttctgcttcccctcacctttctgctctactcagatgctcagtggattggatgatgccccccacactggggaggaagccctgctttactcacctactgattcaaagcctaatctcatccagagacactcccacagacatacctggaaataatgtttggctgagtgtctgggaatcctgtgatccagtcaagctgacacctaaaatgaaccatcacagagtccctcctggggacctagtgccaggctagggtctgtgaatcgttcagcagaaaagaagaaatgggccttttgggggccaagggtccagaggagtgacacttaaggactctaggggcaatagaaacgagggcctcagtgtgcactggggattactggagccctcggagttgagggaggccagagaaggatagatggcaggtgtccacacagcccccttcctcaccgacacccacctcttcatctgccaaggccgggctcagcactatcccccatttgtgatggactctgcagggtgtcctgacaggtgggcactgtgctcacaggcaggggatcctcacagggaaaggggatcctcagggggaggggggatccttgcaaggtggggggatccttgcaggcaaggggagattcttacagggaaggtgtgtcctcaggtaggagggaccctcacaggtaggcatgactagtctcattttctgccgaggagcccacatggcctggaagtgcagagcagggatggaactgaggttcgccgacttccagtccctggtgtttccctcgtcctgtctgctgcccctctggtatgtctgaagatccccatagctctcaatagctgcatgtagagttccagcatgactgggaattgttttcagttgtctgcggggcactgggcacagccgcacttgaagtcgtaggacaccattgggagaccgggctgtctccaagagaaagatgcccagtggcccccaaagccttcttgaatcgcacacttaccccagctctccagcttttccgaatccgagtccctcagaggccaggcactggggtgttcattgagcagcaaggaagccgtgaccgggagagtgtggggacttggtgcctgcatgtggctcccctagacactgacccgaggcacagatttaggtgtaaatggcctatttaggaggtcatcccagaaaacacatcagggagggtggggctccagtcagcccagtgttaatgagcaggttagcgccgtgggcaattggggcccttcagtgacagcagggagcacacctcagggtgtcccctgacaggcgaggaagctctcgtccttcatgggtgagagtcactcctgaagtattagtacctagcacttctgggcagtcctgcagtgcaggtgacctctggaagggtggaggccgtacaggtgaggcctgcagttctgctcctgtgcccagccagcagtgcctgggatgggctagaagcccatgtgtccactataggcatggccagggctcttttccatgactgcggaaggagaggtgggagccttggcttggtaaatgcagccactgaagagcctgagaaccaggaaaacttgccgaggatggacaacactggccttgctcgagtgagtcagggctgcgctgctgtcctgggaaagcttcacccacgggcttcatgcaaggctgcccctgtctatgccctgattctcttttttcttttttctttttttttttaaagaaatctcattttacaaatggttttctgcacattccaagtgctgttcccagcatttacaccctgcttcataattggcctatacaatacaccctgttcagaatttttaatcaactatggcaagttgccccagcaatttaaataaaaatatataaatgaatttagtattttaatattacagtgacattaaccttatatatgtacttagcaattttgaacagtattacaattttataaaatattcttcatttggctggtggataaaccccagagttaaaccatgggctcacttggtactgtggctcatgctataatcccagcactttgggaggctgaagcaggaggatcacttgagtccaggagttcgagagcagcctgggcaacatagtgagacccctatttctacacaaaaataatgataaaaaattagctggatgtggtggcctataatcccagctacttgggaggctaaggtgagaggatcacctgagcccaggagatcaaggttgcagtgagctatgattgtgccattgcactccagcctgggtgacagagtgagaccctgtctctaaaaaaataaaaaataaaaccaaaacaaaccatgggctctttgtgccacaaacggagaagggagctgagccagttgggaggagcacaagctgtagccaggtctgccctgagaggcctgatagtctgagtggccctgtacccctgtgaggccagtgtggccagctgtgatgggcagcacggccagacacgatgtttgcgtgtttaaggacttcagtctgtgcttggacactctcactcagagtggcccctgggcagtctgctctgggccgagcagggcatgagaaggtgccacagggcagaacgagaacacgaatgcagaggccccggctccagcttccagtgatttctgttgggggccttcgatgtcctgggcaacgtgctgaccactctgtaagcactatccctgctcaaggtcaccagcaacctgcttgtggctggtgccgtgactggccctcattccttatctcgtgggaccccattagcagcggttaacacagccactccggccctcctcccctcctcccctccgtccttcctcccctcttctcctcctcccctcctccctgaccgtcctcacctggcgtccaggacaccatggttcctggttttcctccctcctctcagcctcctcagggctcaactgtggtccccttgtctcccattgtctaccttggggctgctacagtcaggagcattgagggtccctgtggcagaggggaggaggcacctgatttcagagagcggggaagtgcaacctgtcctgcaccagaaataggtggcgccccacacctcctcactcatttcccaactctgccctttcctccctcagcgtcttctcaacacggcggccagggattctgctttcctttttaaagttattttaaattgtgttaaatacacataacggggccaggcgtggtggctcacacctgtaatcccagcactttgggaggccgaggtgggcggatcacgagatcagagttcgagaccagcctgaccaacatggtgaaacccccgtctctactaaaaataccaaaattagctgggtgtgatggcgtgtgcctgtaaccccagctactcaggaggctgaggcagtagaatcgcttgaacctgggaggcggaggttgcagtgagccgaaatcgtgccactgcactccagcttgggtgacagaaggagactctgtctcaaaaaaaaaaaaaaaaaaaaaagaaaaaaatacacataacatagaattttaaccattttaagtgtccaatttagtagcattaagtacattcacattgtggtaccatcaccatctccatctccagaactttgctatcttcccaaactgaaactctgttcctgttaagcacgaactctccatctccctatccccccagccgctggcacccctgcatttgaatttttgtctctgtgagtctgactccttttagagcctcaaatgagggaaccatacagtatttgtccttttgtgactggcctatttcacttagcacaaggtcctcagggttcatccatgttgtagcatgtgtcagaattttattccttttgaaggctgaatagcattctattgtatgaatggaccacctttgcctatccgctcgtctgcccaatgacacttgggttattgagaactatgccactatgaacatgggtgtgcaaacagagtgactcttttagaacacaggtcagtccgtgacagtcctctgttcaacccgggccttcctgttctctcagtggagaagcccaaagcctttatgatggtccccaggacctgtacaccccaccccatcacgtcctgcagccacactgagctcctgctcttgctcagacacatgggcacactgctgccttatggcacaggcacaggctgctctcctgtcccctctgcctggacacccttccccaggcggtcccatgctgtcctccaccaccctccagtgtttgccccagtgactgcaccacctgccccggtctccctgtgtcacattgcgtcataaccctcccatgcatttcagagcccctacctgtttctctcgtttaaaataacatttatcactttctgacatactacagacagtctttgacttgccgtggttcgttttgcagtttttccactgtaccaatggtgaaagtgatacgcattcagtagaaaccatacttcgaattttgaattttgattttttcccaactctagactaatggaaatgctctgagcatatttaaggtaggcaaagctatggtgtttgataggttaggtgtagtaaatgcatttctgacttaatgacattttcagcttacagtgggtttattgggacgtagccccatcgtacgtcgaggagcgcctgcgtgtggtttgtgtttttattatgtgcattgtctggctcctactctgagagggcagggatcttgtgtgttttgtttactgatgtatcctgtccacctagagcagtatttggcatatgatgggtactcaaatacttgtatgaatcaatgaatcttttttgataacagctttattgtgatataattcatatagcttacaattcacccattaaaatgtatagttccatggatttagtgtattcaggcagttgtgcaaccatcagcacaaccaattctgcaacactttttataacccacaaaggaaaccctatgccctttataattttttaattttaattttttaactaattttttttgtgtgtgtgtgacagggtctcactccaggctggagtgcagtggtacaatcacggctcactgcagtctcaacctcctgggtttaggtgatcctcccacctcagcctcccaagtagctgggaccacaggtgtgcaccactacgcctggataatttttgtattttttgtagagatggggtttcgccaggttgcccaggctagtctcaaactcctgggctcaagtgatcctcctgcttcgcctccaagtgcagggattacaggcgtgaaccactgtacccagccaccctatgccttttagctgtcactcctgtctccccgggcctaggcaaccattttctgtctctatagatttgcctattctggacattttatataaatggaatcatgagatgtatggtcttttgtgcctggcttctttcacttatcataatgttttcaagtttcatccatgttgtagcgtgtatcagtacttcattcctttttattgctggataacatcctgttgtatggattaagccacactttatttgttcattcgttagtcgacggacaataggtttgcttccacttttgggctatgatgaatcgtactgctttgacccatcttgtataatcccttttgtggggacacatgttttcagttttcttgggcatatacctaagagtgaaattgctcggtcacatggcaactccatgtttaaccttttgaggaactgccagcctgttttccaaagctgctgcaccatctgaaattcccactagctgtataggggagttccagtttctccacatcctcaggtgatattattgtctttctttctcttctttttttttttttctttttttagagacaaggtctcaatctgtcacccaggctggagtacagtggtgtgatcatagctcactacagcctaaatacctgggctcaagcgatcctcctccctaagcctcctgagtagctaggactgcaagcacatgccactatgcctggctaatttttaaaagatttttttagagctgaggtcttgctatactgccaaggctggtccttgaactcctggccttctgaactcttgtcttagcctcacacagtgccaggattacagggataagccatcttaactagacctatctttctttttgattatagccatcctactgggtatgaggtggtatctcattgtggttttgatttgcatttccctgatgattaatgatgttgcatatctttttatatatatttgtgtatcttctttggggaaatgtctgttagattctttgccaattttaaaatagtatttgtctttttatcattgtgttgtgagagttctttatatattctaggtacagatcccttgtcagagataggatttgcaaatattttgtcctgttctatgggttgtcttttcacttccttcaccgtgtcctttgaagcacaaaagttttacattttgatgatgttccgtttagtttttcttttgctgtttgtgcttttggtgttataactaagaaaccattgcttaatccaaggtcataaagatttacttctatgtttttgtctaagagttttgtagctgtagctctgacgcttaggtctttgatttattttgagttaatttttgtatacagtgtgagggagggatctaactccattcttttgcatgtggacatccagttgtcccagcaccatttgttgaaaagactctattttcccccattgaattatcttggtatcctttttgtaaatcaattggccataagtgtgagggttaacttctgaactctctatctctgtgcagtgatctgtatgtccacccttatgcccgtaccacactgtcatgattactatagcttggtagtaagttttgaaattgagaactatgagtcttccaacttcttttcgctttttcaaaattgtttgaaatcttgtttcaagactgtttattatttgtatatgggaatgcatcccatggaaaacatggggtgtgtttccatttatttccattgtctttaatttttttttttttgtttgagacagtctcactctgtttgcccaggctggagtgcagtagttcaatcttggctcactgcaacctccaccttctcggttcaagtgattatctcatctcacctcagcctcctgagtagctgggattacaggcgcgtgtcaccatgcctgactaattttttttttttttgagtagagatggtgtttcaccatgttggccaggctggtcttgaactcctgacctcaagtgatccaccacctcggcctcccaaagtgctgggattacaggcatgagccaccacccctggtctgtctttaattcttttcaacaatgttatatatagttttcagagtataagttttgcatttcttttgttaaattttcctaagtattttatccttttgatgctattacagatggaattattttcttaattttatttccagaatttttcattgtaaatatatggaaatgcaattgatttttgtttgttgatcttgtatcctgcaaccttggtgaacttgtttatcagttctaatagagttttcgtggattcttcaggattttctacatacaagatcatctcatctgtgaattgagacagttttactttttcctttccaatatggataccttttgtttctttttcttgcctaatttctccacctagaacctccagtacaatgttgaatggaaggaataaatgaatctaaatcctaacgtcatgtcagtaattatcatgtttattcccattttacagataggcagactgaggcttagagtgggtaagtaagttgcccaagggtgtgttacagccgaagagctgtggggccaggccagaattgctgtgtacagtctgcttgctgcaatgcctttcccccagctgccatcttcatatatggtaggcatttgggggaggtaccagccaacctggtggatgacatttagagtttagtgagaagctctggaagtctcactggtagcactaagctcctctctgtgtaccggctgcttcccatatgtacatgcgtaggtaagagcaagatagaaatgacagcacttgtacattccactgagggctttctcatcagtgtctcgtttcatcctcttagcaaccctgtcagataagaaagatgagttttattgtcctccatttaccgatgaggaactggcacttagagagctcaagtgactttcctggcctttgggaaatgttggcatggtggggacagggtggggcatcatgtgtgttgattatcttccctatgttagacactatgctggacagttgctgtatggcgtatggcttaatcctcactcagcattattatcctcttcccacagttcagaaaattgatgcttagagagcttaagtaaagtgctccatgtactcagctcagaaatggcagggtctcccctcaaacccaggcatttgacccccaaattctacctgctttcctcggaccacaaggcctgaggtgatcgaagaaatttattaaagggaaacaaagatggataaaagagcaattcccacgaggccagccttggcaggtgctgttgctccctgacgtgtgtctccttgtgtgttatcccccactttagggtttaactgtatcttgagaggtgggataatcttccagggaaaagcagagaaggggaccatctgctgaggcaagggacctgttcaagcaaactcctgtcttttctgagataagtctgactaatccggtccttgtgactaatccactctgagactttatctttagaaccaatgattaatttaaataggctaaattgttccatttcagcccccatacttgagtgttcctgggggaagtggggttagggcaggagggtggtgcctgggagttgtgagggtcctcgaactgttggaatttcagagtttctagcagatagggctggggccagatcccacataggaactgcagccctttctgctgacatcatgggagatcccgctttgaacgccctcgagggcagacatatgcagggggtccccattctatagaccccgtgaatcatgctgtgggtgagaatctctgcaagacgatgttggcctctgtgactttcctttcctcttccactccaagagccaatattttcctccaagatcacagaactccggctgagcgctgacgaagctgtaaagtgctctagaaaggctgctggcgaggaaattcacccatccaatcccccttcagaccttacctcctgaagacctggattggagaggctagaacccagatgccagagtcagatccctgcagctcactctctgaatgaccttgggcaaattttttagtacttctgagccccaatcttctcactgtagagctaacctagtccaacaagttcatttttcaaaagatgacattaacgttgcatccccaaagccacacaacaagtaagtgcaaaagggagggcagtgaccaggccttctgccctcggcacgccaggcccttctgcgtcattatctcatctggtcctcactgccagcctccgggatgctggctgcatccccatgggacaggaaaaggcactgagactcagatgcgtgggtcatgctgccaagccacacagcaaaacgtggcagagccagaatgggctctacgtgtgcctgattccaggccccatgcaggccctatgacacccaaggaagggtgaatctgtgggcctttctctctgctggcccttagttcagcctctggccgttgcctcacggaggctgagcagaggtctcatctgcccaggggcaggggatggtgctggctgggcggaggcagcaaggagggggacggccttctcatgttcccagcccacccttctcaacacgcccttgctttgcacacaggcctaattaccaagaggagtctggggcccatggaggctgtcagttcctgcaacatcacagcagcctcttatcttgatgggtgtgtgcttttgttatatttttaaattacagacagtgagagtattcccttggcatccagagctgagagctttgggactttgaatggtggaaaaggaacccaagtgcctctgtgccaggcttcctcccaaaactcatatcagaatagactataagaagcagcagccccatagctcagtggattaaaacagcagaaggcgttttctcactcctgccacatgctcactgcaggtgggtggccaatcagagacctggctgatggagtattgttggtcactgtgccagagagaatgtggagtcctggaggccttgaactgattagtaggtatcccagccagaagcattgtgctcctttgcagctcactgggcagaactggtcccatgcacccccaccccccagccccaccaatcaaccacagtgctacgaaggagcactcccgtcatgtaccacaaagcagggagaacaggtcatagcattaatgaccgacaactaccactggggagaagtaggaccaggacgctctacaatcggatgcccagggaggggcttcctgtcatgggctggccaccagcaggaggtgtccagcgtgtgttctgaggcctgagctgggctcctgcagggcatctgtgctgttgctgctcatggagacctgaggcagtggcctggcctctgcctggagtggaaggaggaggctgcacagttgacctccttttgcttttccttgtggttttgggctgggagttgcagacaacctttctatagctgatttggggtcaagaatccccataggacccaagacaggtcctagaggagggaaatgtgtttgttcccacttttttatggggtccagtggcgaaaaggataaaaactcacagttaaaacaggagtctgacatctgtctgctggggaggccacaggtgggggatctggatcagatgggattcgttccttcattcattcaataggtattgaatcttagctttacatttgtgtaaagtgactttaggtaagtcacttaacctctctgagccttagctctctcatctctaaaatttgagaactattccatatctcacagggatattgtggggattgagtgggataatggatggaaagtctctgggagaagcctggcacatattggatgcaacagattcctgtttaaggaacaaatgtctccgttttctcctccataaaatgagggttataagaagcgtctttatcccccaggactattgggaagaacaaaaaagagaccatttccataaagctccagcccccacagacactcaggagaccccagtctcctcctgggttccacgggtgggaggctctagggggaccattctcccgcctcctcggccatcgggctatagctccccagagtgggtccagggtccggagccttcctgggccctgtccgaggcccaagagcctgtcccctttcctgctgaggctggagcagagagaggttagccccagcctgggaaaggcctctgttgtcatcctgcggggttccagggtgagggtgcatgcaaactgtcaagcgcagtaagactgtgagacatgccgtgcgaactgtgaggtgctggatgagggtgaggtgttgcgttccgtctctgggtctggactggcttcctgctgctcccttgaaccacagccccaaaccccatctcccacctgtccagcctctgcccagtgagtcccactctgccagcctgccgtctgcatcccactgtgccttctgtcaatggtgacagttgtgtagagaaggaaaacaatactgggtggttcagatgtttctggcatcaaatgggataacataggccgggcacggtggctcacgcctgtaatcccagcactttgggaggctgaggcgggcggatcacgaggtcaggagatcgagaccatcctggccaacatggtgaaaccctgtctctactaaaaatacaaaaaaattagccaggcatggtggcgggtgcctgtagtcccagctactcaggaggctgaggcaggagaaaggcgtgaacctgggaggtggagcttgcagtgagccaagattgcaccactgcactccagcctgggggacagagcgagactctgtctcaaaaaaaagaaaaaaaaaaaaaaaaagagataacatagtgaagagttttctttgggaataaatattatttaaatatgtattatattttagcacaatcaatttcagttgtaaaaacaactatttggccaggtgtgtctcacgcctgtaatcccagcactttgggaagctgaggcaggtgtatcacttgaggtcaggagttggagaccagcctggccaacatggcgaaaccctgtctctactaaaaaatacaaaaattagccaggtgtggtgacgggcatctgtaatcccagctactagggaggctgaggcaggggaatggcttgaatccaggaggcggaggtagcagtgagccgagataacgccactgtactccagcctgggcgacaaagcaagactccatctcaaaaaataaaaaacaaaaataaaaacaattattaattgcagggaacttggaacatacagaaaagaaaagaattaagaggaaaacagggatcccccggatctcatcacccagaggccaccgtggtggacactgggttctgtttccttcccgccgccttccgaaccccagggcatatgtgtgttttgcttgtttcataacatcgggttcatattttttgtagcttactttttcacttgataccatattgtcagcatttccctcagttattaaatattctttgcaaacatgatttgtaatgtttgcctgatagcccgtcctgcatctgtcccgtcgttttctctccatatcagtgttgcagcttccagggattcagtatagattccattcgtggagccgagcccagtctgagacctagaacagattctagaaactgtcgagagctctctcttttcaccatgcatgtccctggcccttgtgagccatgtggagacctggaaggacttggaggggccagggtccaaccccgggaacgtggccaagatctcagttggtctttgttctttctcgccgcgtgagtcccctggtagccttggtgggggtcctttcaccatcatacccggaggctgtggcttcaggcctgggtctggatcccacctagcaagtccttccttgctcagggccgccttgctcaggagggctggcttaggaccgaagcccaggccccgcagggagcctgcctgctcctgaatttcccatcttcctgaccttggaatccacttttcttacctccttgtcacctccttatgcccagagttggctttgattgagggactctaatataagatggaaaaacccaagggtatgaaagtcactgcactttatagccttttaagggccttttaaaaacaatgttcattcaatttttttcttttttttttttatgagctttctggtacgtacagcacataatcctacataaaatggctgagcacgacactggcataaacagccggtgatggggtggaagtccgtgaaacgacgggtttgcctctgtgggagaagccgcagtctttcagcactgagcaggctccggattccagggctggggttgccaggtcttctgagtgctgctgacctgagggcggcactcgagggcttgggtccttggggagggacgctcaggcccctgcctgggaaggatgcctgcgtggcttgaaccctgacctccaccatcagccacatgtgccatttgggacttgtcctttttctcaccatttcatgaaaagcttgtgttgcttttgccagccagccagccagccagctgggaaagctggtcccacatcatggctttctaaatgacgccctggctggtcgcctgatgattgagcaggccatggttaaggctcttgacagcacgtccaagggccaggtgccccgtggaaagactggagcagacttgatgtcagttccccagctgttgtggggttgaaggggatttaccctgcaggagtaacgctcctattgctcgagctgttggggtgtggacgggggaagctccagcttatttatcctcataaaccatagtgctatcccctttgtcccacgagttccagtatttcattatccaaagtggatctcctaggctgcctccaaattgcacacaatgattttgtcagattttgaggtctgagttttcctttgcagaataggaagagtcactctgtcccagccttgcacctggtacatagtagcccgagtggtggggagtctgccaatgagatgataaaagactctcagaggttaaggctcttgctcaaggccacacaggagacaggctctgagctcgggggagcccgacccttaagactaaatcctcaaggaccgcgagtgcctttgaaagccctgccccgccgcctgggcagctggagtgggagccacgcaggcaggcacttgtttctgagcacagctgagctggcggggccctgccacctccttggacgccgccttccctctgcttgcctgggacgggctggggagcagcctcgtctatggtgcagccctccccttctcaagaccaccctgacctttctcagcatgtgcctgttttccaggtcaccgtttcgatttcgcttcacttcctagtgtttattctcctccgttagaagagcttcgtgtttattgattgttgtctccggaccttcaatttttgtctgcggctctggcaatctggaaatgagtcttccactttcattagccaccctgttctgaagagcatccgacctttccctaatcagttccagctaatcatggccagtggctttggatgagctggggtggggggttgggggagcagggacaggggttgccaagaggcccacaggacctcccctgggggtagacgatagtgacggtgatgatgatgatgtcagcactgggcgtgcaccctgctatactctcaccatctcccctcacccctccactcctcttccctggcgccagaggcatctgacccttaggaagctaggggctgcagtgggtcagagtgagaaccacggtcaagctgaggggcccctgcttgtctatagccaaaggccaggtccaggaaatagtacttggggtttggagtcgggggctttgactcagatctgggtggagtcctggccttgtggccctggacaggctatttaccttctctataaactggggataacaagaaagcctcaaagcttaggatggctgtcaggtgtgcggtggcaaccagtattactactattgttgtgactgttgagtcagatcaggtttctcctgaaggccctacctggagtgatgttgctgtgcccggtccctagctccgtgcctggtaagatgttcacggggcttagtgaacacgtgtctagctgagccccactgagctctgatgggggcattttgttgcttgtggagcaagaagccatttggatggggcagaggtcagctgccaggactgtgtggcctgacctccatcctgcaccatgcccagcagagtcaaggctgtcagagggattttctcccgcgggtcttcctgtgcaaatcaataacccttcaggcagcagcagggagggaagcatgcactgaggaggcaagggtcagggctgttcctgcagcttccggcaagtcctttgcagggtttttcagtatcttccgctcgagcaggtgctgcagcagagcctcagatacgtactgagcgtcgcctcagtttcatgcacaccgcttggggctccccaatccctgagtccagaaccacctggaggtctattgcattctggccccggcagctctccatggaagcagagatgaactagcagggccagaggctgctcactatggtggggtccctgatctcctatcagcaccctagtttctagtaggaatttgggaggcagaaaatattcccccttccctccaggtgaatactcaggtgcatactatgtgcttgaagctcatggccaacctcagaggctgatggggccttgtgggctttctggagagctctgcagggtcccaagtgtcatttctcccttgcccctgcttgatgcacggtttgtgagtactctctttggctggtcctcttcactctcttgtttaccatttgctgttaacaacagtaattacagtatagttgtgagatgaaaacatgactaaattatgacactgcttgtgtaacaatctcttaaaactgactcagaaggcaacagctgcacaattaggctataaattctcttaaatgaacttgtcggtggcagcagtacctgtgtggcggtgttgtgtaagagataaccaggcttaatgggcttggagagggagcaccaaggatggcctcgtaaagagggaaactttgttctttgtcataaaccacttgttctcttataaaaacaaagggctcagtgttggcccattaactccctctgtctgtcgggactgtgggagcagagcatctgcctgacaagctgacaccagggatgctttctgccttgaggtgtggctttgtttgaggctcctccaccctcatcccgaggaggcatggccagcaagaggcctgggtgggattagttagttagtagcggtcgggccagcatggccttggtgggggcccagctgagctgctgcagtcttcccagctgggctgcgaggcctgcccttcttatgctaaatgacaaacttcaagacaaaacccacgaatcagagcgccttggatgtggggctgggacctaagaaaccatgtgattcaacagagggatgatggaggcttgcttcagatgcgctctttgggaaagaagcatgtatgccgcagatctaagggggaaggatgcaactgatgaggtgttacaggatgctcttaccccaccccagcctgaatgtggccagcactgggactggtgatgctgacactgggggccctgctgtctgcctccaggtcagctcttagcagcgtattcactttctgtggctgctatcacaaactaccatagacttggtggcttaaagtgacacaaatgtactatcttgcagctccaaaggcagaagttgggtcttgattttgacatgggtctcggtgttttaaaatcaaggtgttggcagggctgtgttctattctggactctgggagataatccgttgcattggcttttccagctttcagaggtcacctgcatcccttgattggtggccccttcctccgtcgtcaaagccagcactggcaagtcaagtctctttcagagaacatcatagttctctgactctctcttctgcctcttctttatcttccatttgtaaggactcatgtgattccattgggtacatgagtacactaaggtgattgtttccatctcgagatcagctgattagttgccttaatcacatctacagtcttaattccctttcaccatgtaacgtagtatattcacaggttttgaggattatgacgtggacatctttagggggccattattctgcctgccacaggcaggtggagagtagggctttgagccagcttgacttttgtgccctctgagctgggcacaggcaaggatcagacgtgaggaagcaaagctgagctggtcctacaggaaatcagagagagaacagcctctctgttccctcccgcctgtcagcactggactcggcctgcacctcagatgtcacttgcattttctaggggctcccagtcagagacagggtgtggtctttcgtgaacaaaacccaggagtggacataccccatggcttcccagactgtgtgggagtctccctgaatgaaaatggtaagtgtgcaccctttccttcctggagaacctagcattagcatccacctttcccctaggcccctccctggagaaggtgcaaatcgggaagcctgctggtataagataaagttcagctttaacagttttcaaaataaacgaacaacacacaaactccagacgctgcacaaacccaccagcagggagtcatggccacaggttttgaaaactttcaccattctgggattgcagagcgtctcatccgcagccccggaccccctggccacctctgctctttcatcccagcctggcggagaggcagctggactctcctctcggacaggttctctgatgaatttccaggcatctccctggacctgtccacacaacagatttctggagcgcatccccagggacctccagctccaggcctattactgaagtccgtcacccagaaaatctgttgacggaaccgttctccctgaactgcaagcaaattgggaaatttgaatgtgacgcaataagcctgcaataaaacagagcctccaagaagtgcatgaagcgaatctcctcccagcctagtccaccacccctctgcagcttcccgagctgtcaccctccagggtggccacatacagtatttattttttttaattaagctgcgttgctgtgtggctcaccctccacagatgctttataaagcccagccttgtaagttgctgaaagtttttatttttttttaagcggatagtaaaattaagcagttattagtattcacgaaaaatgctcgtggcaggcttcgcacacgtaatgagaagccacctgcagttcaaagcagtacttgataatgctgtaattagatttgagatgcaaaaaagctcattaaaattaaataacatatttgtcactgttttaagaggtacagattgcctagaaccatgctggtctcttgaccttgagtattttggcagagtccttgctgccgacaattcaaaaataacatcagcaattctgcagagagtcctgaaaacatgctcatccttggttcagtttgtattgaaaaaattatatagatatccaggggaaatcacagatttgtacacagtgtgttctgggagaaaagggtggccacagtcctctctgagccagtagctcagacgctgtgaagaagagatggatgtgtgcctgtgggaggctggggcaggtggaggggtcccccataggacacggggacactgtgagggagtttgcaggaagcggcggccttgggcaccactgcttaccactaagctgagctggatgaagccacttgctcagagcaggcccagggcgactggtaatcagattgtcagtcagtgtttcccgggtgcctaccggtgtaccgggtcccgggcaggggatggtggggccgcaagtgccagtgagatttgcctcaggctgcaaaagaggtcatagcctcatcacggagatgaggcataaagtcaggtgccaggaaagtatttattgttaataaaagtagctaatgttgactgagcgtgtctttcatagtaggtagccaagcgtggcatgcattatcttaggaatcatctccatagtctgtgagacagccctgactgccccattttccttgaggttacgttgctcttgtaaggtcacttcactagtaagtaactagtaagcccagagctgagccgggttcagattcaggtctggccttctgcagcaccccttctgcatgaatcacagagtcactcaggtcccatgggcagagcagagagacccagggtgggagaggacacacatgaaggcactcactgaggacccactcttcaccagatcctgctctaaacactgcgtgcctgttcatcattgtatccccatagcaaccctgtgattccattttacagatgaggaaattgaggcatgagaaattaaataaccagtcccaggtcaccaggtagttggtggcagagttaggattaagctctgaccttgactgttattctatgtttaatttttcttgaaatctgtaaagcattctataaaggtaggatgtaatttaaaagcaattatgatgatttttgttcttggagaaagaaaatgcaagttgctttcaaggggcagagaccagaggagttttcctgggggcagagagcagttaaacgagacgtgagtggagggggccagatggagggaaaatgaggccaagttagaaacagaggcctggcctgggctccagggacagtgtgggcccccattttggaggagctgcgtgtcctccagggcagggagtcattgggaaggcagtctgggccgactgcccctcctcccggtggctggattgattttccaggctgactctcttggcactgggtccagatttagttctgtggagagctcgtctttcaaagtccagctcaaatgtcacctcctcggcaaagactcccccaccgcctgaagcaaaattaatcactcctcctccatgtcccacagcactctgttgatacctccggaatagtcttatcacatcggacacggatttatgtgtttacaagtctgtctctccagctagacagcgacttctcgagggcagagcccactctgcctttgtgtcattgtgcctggggcagtgctgcgtgtgcagtgggtgctgaggaaatgatgcatacatggaggaccagtggatggtttaatttgatttcagtgaccaagcacagagctcttactttgtgcaggtcttgttctaagctctttacatatgtgaaaggatttagcctttataaccccatgacatcagttagttctatgatgagcctgttttacaggtgaggacactgaggctcagagaggttgtgtaacttctcaatatcatacatctggtaagtggtagagctgggagttttaaacccaggcagcctggagtgaaaacatctgcttaaagtgattttgtagctacagattgtatatagtgattcttattaggggagtttctggaatgaattctcatttcactcttcttttccctaacttgtctgaatttaggaaggtttggagaaagcgattgggctgcgatgcagttaagtttcctttgttgtaagccgtggaaaccaactctagctaaattaagctaaacagggattctgttgtgaggatctaagtagcttgcagaaggagcacgctggaaggaagggctttggggaggccagagggactgacctagcgggaactgaaggacagacttgctgggatgagctctgcacgtcacgtccctcccagttcaggcgccaccatcgtgaccgtgtagggaattggggtgctggtaagaccttgggtgctgggccggcaagaaggtgcgctgcctgccgaccaccatgcgttcctgctggccattgcttgggtcctgtgttcaccctgggcccagtggcagcctgggctgagccgggggcgtgagagcccagggctctcagtcatgtttccttgacacatagttctggagtttggggcgggtggggagggtgaggcttctgaaaggaatattcactggcagtgacctttcttaggtttttaacattttgaggggattgattgaattgatccaagcccattcattctcggtctccaaaggacatgaataccgcaggaccagcccagcttgaatgtttgaaaactgggtgcaaacgaggactagactgattctttctcaccgggcttgcccccagcctctaaactagaaggggcgtctggctgggtgtccctgggaggacggccagagtgcgccttgctcagaggttgttgcagggaagccccttttcctggggagggagggaaggcgctgtgcatctctccccggcggccagtccagcgtcttccggtatggcagtcctttgccctgtcgggtcaaagccaagccccctcagcctccgggctgtccccaaacgtgtctccctcgcggtgtccgtggcgcgcaagagcctggagcctgctgctttgggcctcacgcctctgtctcatgcctctgccggggccccgatttattcaggacacacgtgtgctccgagtgccagatacatggtggaccccgacaaggcacgcaggtctcagacaacaggtgacgctgtgtccccggcctgtgcagcggggacacccacctcattttactccccccaggtcagctggtccttgctgggaggctggtccctggggcgaggggccaggggcagctggaggagagcgcctgcccctccccaccccgccccgcccctcctcccttccactccccctctgggcccgccctccgatttggcctcttccccgggcccaccctttctatagccccaccctttccgttttggttcctctctccctgccagccccgccccctcagaacctatcccgtttcctttatggacctgccctcgtctggtcccatccacccatcttgccccgcccacatccagccttcccacctggccccacccctcctttttggctccgtttcacccgccccgcccctctggacccacccctctttcctctgtggacctgcccctgtctggttccacccacccacgtggccccacccactccctgccttttatcctgcccctgccccatggctggccccatcctccatcccttttcgtccttgcccaccgagctcctctggacccacccctctttttgggcccgcacccatctggctcctcccacccatctggccccacccactcccctgctttccatccctgccttgccctgtgactggccccaccctccatcccttttggtccctccttgcctgccgagctcctctggacccacccctctttcagttggggccccgccctcatttggcccctttcacccgtctggccctgcccattcccaccttccaccctggccccgccctgtggcagaccccattctccattccttgtggcccttctcctctggaccaacccctctgtccattagggccccgccttcatttgacccatcccaccctctggcctcacccactccaccttccattttgacccagctccttggcaggctccagcctccatctcttttggctcctcctcacccgccccgcccctttggaactacccatctttcctttatgggccccgccccatctggctcctcccacccacctggccccccccccccccccgctttccatcccggccttgccctgtgactggccccgccctccatcccttttggcccctccttgcccgcgccgcccctctggagccacccctctttccaatcgggccccaccctgttttcctggccttcaagctcccgcctggcgccccgcagcggcaagcgtgatttataggccgtctgagccgtgacctataaaccctgttcttcagggggtgcctttcttggattaaatgcctctaaaggagcctctgtctcagaagtgtcatgtagaatgtttccgctgacggagaacatgacctttaaaaccccgagtaaaggaagcagagctgccaggggaagcatcgggcaaggcggcgcctcaacccgcctgcacctgtccgctctccgacccctccccagacctggtggggcgggctgctgacctggctgggggggcgcgctcccggggcctgggggctgggcgcggctcggggagctgcgctttgcggactggaggtggcgaccgtgcgagcagagacgcccctcaccatgggccaagagccctgaccctaacaatgggaaagggccagggcccttgttccacttcagtttccttccctttgtgccctgggggacactgggtcctgctaaaggctggggcgcctgtcgcagaagacccagtgtcctgggtgctctgggtgaggcacagcgtcctgggtgcccagataggggtgcagaatcctgggtgcctggttaggggtacagagtcctgagtgcctgggtaggatacagaatcctgggtgtctggtttggttgcagtgtcctgggtgctttgggtgggggcacagtaccttgggtgcccaggtaggggtgcagtgtcttgaggatctgggtaggttcagtgtcctgggtgttcatgtaggagtgcaggggcctgggtgcctgggtaggggtgcagcgtcctggaggtctgggtaggagtggtgtgtcctgggtctgtataggggtgcggagtcctgggtgttcatgtaggagtgcagtgtcctcggtgcccccggagggtgcagcgtcctgggtacctggggagggcgcagcgtcctggctgttttgtacaggggcacaacgtgatggcttctctggatgttccatctgcagtgtctcagaggatgtcatagaacttggaagaactgtgcctaggtcccaccttttatctgacactgcagtctttgtttcttgggtggaaaagccatggctgcctctctcccaggttggagaaagcatatttctggtagtagccactctgtaggtccatatggacactttatactaaggaggctacattttcttattctcttgcccccacaggctaatgtcacaagtagaaacgtgactgatacactcattcctttgtacacttttataagaaatccccgcagacgctgttttgctttggtccctttgaggtgcttagaggagtggctggattctccaagaggcctcatgcaggaagcactcagtatatgttgcttgtgagatgccgccagggattctctggaaggaggaccaggagatttctatggagagacgagtcagctgaaggcctttgtggatggaagtaggggactgtcttccaccgtgtcttttttgagagctgggaaggagaggccgggtcggctgggaaagagctgtcttgtgttggaggggctttgagccctcctccaagggtcgcagagcagcaggtagagacttagagtctgtgctaacagagagggagggtcttgtctgggagacttgcctgaccctctcttacttgggtgcatggtgctggcaaggaagaagcagggccagcggaagggctgtatttctggtgagatgtattaatatgtgaaagccacttcgggaaaagtagtgagtgtggtatgagcatgagtgtgtgtgtatgactttgtgtgcttgtgtgtgtctgtgcatgtgtgcatgtgtgtgggcacgtgctcctgggggcatgcacatgtttaagtgtgtgcttgtgtctgtgcatgtgtgtatgtgtgtgggtgtgtgtgtagggggcacgcagccagctctaacttgagcagaggcattctgttgttataaataaggctggtttttatattcccatttgaccagggagtgcaaccagcagaccaaaggtaatgcatttcagctgcctgtgggggaaggtaaatgtggtttattagcccccctggctcagagggggctgggcactggtagcagctgaagcaaggcggctctagatggagggaggggacaggttggtgattgtgtgccctggtttctctaaaggaaaaaaaatggacgtgccgcctgttagctaatcaacagtgaggagaaagtcctgacaacaagtaaagaaaacttagctggcaataaaataagggactttttatggtggtttttatgagaacattttcgctttgggagttattagagttagtgccggttgtgacaaaagctgcatttgcatatcgccgtgatgaggtctggatggagcctgaatgcggcattaactgcatatcagagaccctttcagaagccaaacaggatgacatttattgcaagctcgatgccgcacgtctggcattagttactgcttgttgtgtcctgtggaaactagattttctgtcttgggatctttctgggactggtcgcagcagcttcctaggtcaagaacaagctagggctttgggagtgtgtgggggatctcggggatggggaggggacaccatcgggagaggagaaggagttaggcttcacagggctgcgcgctggccaggtgcctgtcacaggctgacctagatgagactgccactctcagattcaagccccacaccaggacaaacaggaatttttcccacttttttaatttttaaaattacgatgtaattaacatatcacgcaatttactcattttaagtattcaattccatggcttttagtatattcacaaaaacgtgcaaccattgccccagtctattttaggacatttgtgttaccccaagagaaacccctcacttcttagccgtcaccccaaccccctcatcctccctagccctaaacgaccatacatctacttctgtctctattgatttgctgcctctggtcatttcatataaatggaaccatacagtatttttccttttgtctctggcttctttcccccagcagaatgttttccaggttcatttatgctgtggcacgtgccagaacttcattcctttttatggctgagtaatattccactgaacagatacgttctatttatgtattcatcagctgattttccctaaacacttttgaaacctttttttttttttttagagacagagtcttgctttgttgcccaggctggagtgcaagtggtgtgatttcggctcactgcaacctccacctcctgggttctagcaattctcctgcctcagccttccaagtagctgggattataggcacatgctggcatgcccagataatttttttgtattttagtagagactggatttcaccgtgttgcccaggctggtctcgaactcctaagctcaggcaatccatcctcctcagcctcccaaagtgttgggattacaggcatgagccaccgtgcccggccaaaaccttttttattgtaaaagatactcatgaaaaaattcatggttgagactgggcacggtggctcacgcctgtaatcccagcactttgggaggccgaggtgggtggatcacctgaggtcaggagtttgagaccagcctgaccaatatggtgaaaccctgtctctactaaaatacggaaggtagccaggtgtggtggtgtgcacctgtagtcccagctgcttgggaagctgagacaggagaattgcttgaacccaggaggtggaggttgcagtgagccgagactgtgccactgcactccagcctgggtgacagagtgagactccatttcaaaaacaaaaaaaccaaaaaatcagggttaagcccattggaacccacctgaattttttcagaaaatggagttctagattgagggagacatagggggttgatgaagggagtgagatggggtggggtggggggtggaactgcgtttcctctggaaaacatagagcccatgctttgcacctcccagctccccacccgcgaatgtggcctcagggctgactccaggattgctgctagggtcctgggagggtctttgttgcttgccattcagagagcattctctatctcaggggaccttcagccactaggtttgaggattcccaggggatgttggtgtggttgagggctctagggcagcttaggctggtggccacgtgttcctgcctcacatccgctcctctccatgagctctggctgtgctgtgtggttcagccagcatttgaaaagtctgggctgaggctgctgtggagaggaagcaattgtgcatttcatagatggtgacatgcatctctgctgaaggctgagagtgatattggaggaggcacagtgggcttctgcctggctcagatttagggagaatcttagggcagggggtgaagtcagaatgtcctattttttctcttccagaaaaatcggtaggatccctgggtgactcagctcttagtcttaattatgctgctatgtaaatatttctgaggtctcttggttttctcagttggcattatatcacagttaataaccagagggcacattataaatatgcaaactagtaataatgctttaactcgaagaacatcgataaattgccaaactgagctggcagcgttcagcagctcattccctttgctgtggagatagcttcctctactcctgcatcatggaacccacgaattccgttggcccctccctgccccagatggcaccctcaggagcagtcggctgtccgcttggtgtgccgagaaaacggctcttaatgtggccccgggtgtgttttccagcatctagaaatctcccagagagagcaaggcatgtatcgtggcttgccctccgctctttctgtgctgggacaagatcggaagtagagtctggaaggatggcccttgcccctctcccgtcctttatttggttggaaagatcatagcccccacggtggagataccgccagagttctcctccccgctccctgccttgtatatggcctcaggaagtcacgtcagcttcttcatcagaaattcatttatatgacaaatgtttactgtgtgcctactgcgtgccaggtgctgtgctgggcagtgcatatggtccttgtcctcatggaactgatgttagggtaggagagacaagcaggcagtagttaggattgtgatcgatgtgtgtctcggaagcacaaggggttactggagcacctgttcaggacgtatcatccattcccggtgggtcaggaaattctaccggaaattctaccgtagcaagtgctatctaagtggagatctgaagataccctggcaaaaggagacggatagagagagtggaggtgggggcttgggggaggcgggttacagggaagaacatcctggtcagagggaacagaatgtgcaggtgcttcaaggagagaatgcgggatgtgactagggagctgcaagtcgccagtgtggctgcagcatggagctagtggaggacaggtgtgctgaggtgggctgcagaggcacggggcgagggggtgtctgtctccaaggagctagtctgtcttgccaagttgagggacatttaaagggtttgactttatcgggacagagaggggccagtcttgccttagaaagctcctggttgtggtgagtggaccagaagaggtcaagaatggcagctgagatacataggggtccttgcttggcctccgtgggcattttcagtgagggctaaaccagatgccttgtctaccgcaaagggcacttgttggatcagcccgagccatgctaaatcaggcagcttctgagcaggatgcaggttgggggctctgaacttggagtctgggcaggaaggaggtggtgtttgtggtttgtggaggcggcagcgggatgcctgtgacctgagtggagctagaaggggcaaggaacgctgcagaagtaaaggcggccaggttgggggagtgagcggctaggttgggtgagggttcctgggctccagccgttggactgccgcttgccctggaacctggtccggctcctcccccggatgatcacatctgctttggggcggtgaggagggcccagatgatgtagtgggaactggtggtgcccagtgagatgagctttttcatgcaggccttggacttcaggcttgttccagctcagtgcacttttcctgcctcagcttcctcatctgtgagatgggcacctacctttggggtttctttgcaggctctgtgtcttcccatatttacaaaataaaggttggatgggtgtttattggccttcaaagccagtgtaggcctacgatttaaacttcatccacattcctcagcaatgggtgtagaccatagttagatgtattttaaactttttattttgaaatttatttattattattacaggaatttgcaaagagagttcagggggcctcatgtagccttggtctcctttctgcaatggcttcatcttacctgacagtatcacagccaggacccagatgtcgatacagtgcacatgtgcagttctgtgttgcttcatgtcacacgtgcaaatttgtgtcaccaccaccacagtcaaggtgcagaattgttccatctccacagacatcctcccaccaaccctgtgtggtcaactcaccctctccctcccaggatctctaaccccagtcaaccactaatttgttcaccatctctgtaagactattttaaattacaaatgtatttttgttataaaattatataataatcttccagaaattgagggacatggaaagaaaacatttccatttccctaccactctcagtgatttcagcgcatctctgtgccttttttggtccacatgcatatatttagtgtatctgtaatcctaatgtgtacgggaccttatgtcctgctttgcttgcacgacgtgccataagcatcctccatatgtattggagccgtggagtgctcacagacagcattccaggaggcggaatgggtggcagggagtgggaggcagcagaaggagtggaggccggtcccagaccagcatcggtgaggaggtaatgggggttcttgccaggccagggactctcggcttggagggggtcactccaagggcctggcaaaggatgtggcgacaggacccagggactccacctgaggcctgaaggataccgtgagtctgaagactccacagaactgatgttgggatgggagagacaagcaggcaatagttaggaatgtgatcgatgtgcatatcagaagcacagggggctactagagcacctgttcaggacgtatcatccagtcctggtgggtcaggacattctactatagcaagtgctatctcagtggagatctgaagataacctggcaaaaggagacagatggagaacagaacagacccaacaacctcaggagaatgaacagccaggtgttccctgaggccagtggtagtgtctgcatggaccgttgctggctgtggtcctctgcagggaccactgctgtgtctgtttccagcctctcctttcctaaaccaggccggccctgtcagcctggctccaaacttcactccctggcctttggagggaagaccctctggttcgggccttccttccttctcagggctttggaagcccctcttctttccaaaggggcttggctttctgtcacccagcagccagctccattgtggtcctaggagtgtcagtgagcacaaagcagacacagaagaaaccttgaagtaattaacagagtgagcatgagacgttcctgctggagaagagcacacgatgggcctcgctcctcatgctccccactcctgatgagtaattacacgtggctgtctgggagtgggagtatttatagcaacgcctcttttgctggagtgttgaactttcttctttgtggcagcacgcttataaaaaggtaatcaaatagcagacgatcggattgtatccgtgtcattctgctgccactttaatgaggactgagaataaatagaaatcctgaaattgtgctatcccaaactgtttgcaagcccctcagtgggggagtccggtttgatttggttttgtttttaccacccccaccctcactactaattttacgttgtctttggagttgctcaggggccaaagtgccttctgggtaagtctctaaccgaaaactagatccacaggcaggccttttattaaaaggcatttaatgactctgaattccttgttgtgttagagctgatttggggcaggataatggtgtctgtggctgggataaaaacccccatgaccatcctccatgcttattaggtaagtgattggtgtggattcctgctctccgaaggaaaaaggaaagagaagaaaaggccaggcctgcctgtggccgcccccgggtctcagcaatggcattatcactgctaacccaggtgtgacttggctccgctgccattggcgtcagcaaggcccgtcagcctccccaaaaagccagagctggcctggagagaggagaggagagcatcgcgggcaggtgctgagggttggccttgtgttctggacaggccgtgagcaggagactgatcgtcttgatgaggtgtgcagggcaggactttgtaatttgacattgttggagaaggaggggcgggggtagagtgaaggccccagaaggagaactgggtcagaagtgtcctttgcttctcattttcctcccaacaaggggcttccctgttgggaaggtttgctaaggcaggggggttattgtgcagagaagggggtgactgccctgtcaccccagtggtgagggaacttggctttatgacatctaagattgtgagcctatgtaaattgcagggaagagtaacaagtaactgaaagtcccgtgtgtgctcctagtgacacacctggccggttgcctttaataaaggcagaaaaacctccgttaagacatttactcatgcctttgagtaaattaatattgatttgacattcgacaactgtttgaatttttacttcttttttttgcatctggagaaaggatctgtgtttagtaagcacttctgtgtgctgatttctgcaattagcctttattcatcccttgcctgccgtgtgccaggctgctctttcccagcatcagggtgctgaccaggcaacacggtccctgccctcggtgagcttatgttccaggagaatggtgttgaggcaaagagggaagtcctatctggctgtcttaggggctggcagttggccagggaagtgctgattagaggggccaaagcctgaattctgcctgtgcttcctggctgagtgtggagtcagtgtagacgtctttctgtctccaaacacagcctgaacctaattgtttcttttactattattattgttttggtaagaatgctaaacgtgaactccatcctcttaacagatttttcctttccttttccttttccttttccctttcccttttttgagacggagtgttgctctgtttgcccaggctggagtgcagcggtgtgatcttggctcacggtaacccccgcctcccaggttcaagtgattctcctgcctcagcctcccaagtagctgggattacaggcacccaccaccatgcctggctaatttttgtatttttagtagagatggggttttgtcacgttggccaggctggtcttgaactcctgacctcaggtgatccatccacctcggcctcccaaagtgctgggattacaggcatgagccaccacgcctagccgtctgaacagatttttaagtgtacaacatgtgttgctatctttaggcatgatgctgtgtggcagatctccaggacgaactcatcttgcatgactgaaattttatacatgttgaacatcaactccctatttcctcccccatctagctcctgacaaccaccactgcagtcattgcttctaggggtttgaccatttttgatacctcacataaggagaatcatgcagcatttgtccttctgtgactggattctttcacatagcatagtgtcctctgggctcatccatgttgtcacatgctgcaagatctccttctttttgaaggctgaataatattctaccatgtgtatatcccacgctccctttatgcacgcatctgttggtggacatttaggtggtttccacgtttgggcttttgtgaatagtgctgcagtgggcacgggagtgctaatatctctttgagattcagatatgacttgttttggataaatactcagaagtgggattgctggatcatatcctaatttatcttgacagtggccacgattctgaacctctttggttttgtcatctgctgggtgacaccgaccttgtaaagactcagccctcacctggaccgtggcattcttggtcccatggctgttcatgtggccctgagagcgaatgaaagtatcgcctcatctcccttctacagtggctggcgggaggtggaagctagtgctgcctcctgccccaccttcccacagccggggaaggggctttcacgtttctgaatctcagcgccaaaaggaacttcctctgtcaggacccacttttgtggaagcctgtgtgaaatgtgatcctcaaatccagcttgaagctgcggttgaatttttgtggggttctcattatttaacgtttggcccagaatggcatttgtctgaagacagacagacaggctggagcttactgggggcccacacagtgtgtggagctcggtctgggctgctctggtttgtaatatattgttctcagtgccaggagctgcagcagcatctccagtgaggaacaaggagagggaggaacctgggagcaggaggggaaacccggagtcggagaatccaatttttcatacagtaacaaaacaatacagttgtgtattcccataatatcccttcagtttcttggggtctaggcttgcatctatttttaaaaacacttggaccaataattctgctttatgcagaccaactggagggtctctagcttggagatttaatgtaaaataaactctaaatggggtggcacacagcatggtggcctgcaactgtagacaagcaatttttcttaaacaagctgagggattgaagtaaatgatggtggtgttcagttctgtcccagagttgggagtgaggcgaggccagggagatggaaggtccaggcttatccaacctcctgtgcgctccctgtgaatgttggtcgggcagggaggctgctcggagggagtctttgaggaagccgactcctcttacctgccgcacggacgtcctggaagacagtctgtgcatccagactggggtttcctagcactttggaactgggctcagaaggcttcagtttggcaaagacgcattgcattttgcaggttcctttgatcacggcccaggtggggccacatccccttagaatacttttctctgtcttcttcccttgggcttagacggccttttgccatctaataataaaaaaaatttatctgacaaatatcaagtatttgttggaataaacataaggcttgctatcttccttggacaaggggaaaataactctccttcacttctgacgagtttacaagatacaagttaatttttggacagattatcctgccaacttaaattatcaataaatcaccctgccacccatggtccttctcgtgaaggaggcgccatctctgttttctgggggaggatgctgcagggctgagatgacggggcctgcctcgagtcacaccagagctggaaggtggcagagctggaagccgagcattccacactgtctccccccaccaccatcagtgtgagccttggggaaaaatagggacgttcagcatgttgtccctgctcttgcggggctcaggatctttgtaagaggaacaggagtaaaccctgaaaatttcggtaaaaattaagaagcagcggagtggcatggttagcgtcactgcatgcaaattgtcctgtggcttgctgctttgtttgttgttattgtttgtttttcatcagactgtgggctcttggggatgctcctctgtgcgctgtttgctgtggaattcccaggagggacggtcatcgtttgttgactgcaagaatgaacgaatgctacgagagtctggggagctgggccttgaaggatgggcatttgttgggcaggctgaatgcaatgacagttgttcaagctgatggggagcgtggcaggagaggaggaggtggagcctgcttggagcataataacggcttcattgagacagaattgtaggctttagatgggtacaattcactcatgtaaagcctacaattcagtggttttagtatactcacagagttgtgcagccacactacaaccaattttaaaacattttaatcgccccaaaaggaagccttgtactcctcagctatcacccccaagcccccaacttcctcccagcccttggcaaccaccaatctgctttctatctctatggatctgcctattctagacatttcatgtaaacaggatagtgcagtatgtggcctttggtaaccgccttctttcactcagtgtcatgatctgttcttccctgccgcggcgagcgtcagtactcccttcctttccgctgctgagtgacactctgcgatgtggacagagaccagagcatcttgaatgctcactcgagccaggcaccaggatgcctaaagcaaagctgttggagtcagactttgacctaattgagttggggttccaggaagatcaatctgatcatgggacaaaacgaaacagtcagtgcctggaggcagaggccccgctgagtctttcttgggcttcttggaagaaggccacaaaggtcaggacgaggaacagccggagaagtgtgactgcatgcatgtcaaggagaactcatcagcaggacctcctgctgtgtgtgtgtgagatggggcagggagacggatctggcacttctggcctggaaaactgggcctggggtgaggattgtgtggtggctgatgggaaggggagaaataggcgtttccacctgtgccttgcctttcagagtgttggcaggcacagagttcagttggctgctggactgtgcaagggggacgtgggagacaagggatcccacagaatccatctttatggaatctacctttcagagagagcagatccacgtgaaagccaggctctcgggagcagtagagcatctgtgatggaccctaggtgagtggcttgcccaggaggaaaggacatgggccaggatgatccaggagggctttctgagagggaggagccaagctctccgtgaaggatggatgtgccgagcatcagcagaggagggaagagaatattccagacatgtcaggcaaatagcaagcacagggtgatatggtttcgctgtgtccccacccaaatctcatcttgaattgtaactcccataattcccacttgttgtgggagggactcagtgggaggtaatagaaccatggggacgggtctttcccatgctgttctcgtgatagtgaataagtctcacaaaatctgatggttttataaagggcagttcccctgcacatgatttcttgcctgctgccatgtaagacatgccttctcttctcctttgcctttcaccatgattgtgaggcctccctagccatgtggaactgtgagtcccttaaacctctttcctttataaattatccagtctcgggtctgtctttattagcagcgtcagaacagactaatacacaggggcactggatgggggagaaggtcgtgtgggtcgggtcctgctgttggaagttgcaacctgcggaggacatcggagaataagctgggcaggctgggtgccatcaacagatgccgatgcccagcacaacagtaactacagctcttgccgcatacttctgttcactcggtgccagtggggttatgttggagccaagtactgggcaaagcttttttttttttttaatttgagaaggagtcttgctctgttgctctgtcacccaggctggagtgcagtggcgcagtctcggctcactgcaacctccacctcccaggttcaagaaattctccagcctcagcctcccgagtagctgggactacacgtgcgtgccaccacacctggctaattttttgtatttttagtacagacgaggtttcaccatgtcagccaggatggtatcgatttcctgaccttgggatccactcgcctcggcctcccaaagtgctgggattacaggcgtgagccactgcgcccagcctggactaagcttttttaagcatatcatgtcatttactcttcacagcagcccactgggtagattgggtgattattacagctttagaggtatggaaaccaaggtttagagagattgagtgcttagcctaagtcacgtatctaaaaagtgctgaacctgggttttaaaaaattttcctttgagtgtaaacaagccagtagtatgtggtatttatacacaacagagtaccattcagccataaaaaagagtgagatcctgttatttgcaacagcatgaatggaactggaggtcattatgttaagtgaaataaaccagacacagaaagacagtcttcacatgttctcacttctttgtgggatctaacaatcaaaacagttaaacacgtggaggtagagggtagaaggatggttaccagaggccaggaagggtagtgggggtgtggtggtggtcagggcgctggagattggctaatgggttaaaaaaaatagttataatagaatgaataagaccctagtattcgatagcataacagggtggctagagtcaataataacttaattgtacatttgaaaataacaaaaaaagtataattcgattgttttaacacaaaagataaatgcttgaggggatggattcctcattctccgtgatgtgattattatgcactgcatggctgtatcaaaacatcttatgtaccccataaatgtatacaccaggccaggcacggtggctcacgcctgttatcccagcactttgggaggttgaggtgggtggatcacccgagggcaggagtttgagaccagcctggccaacctggtgaaactctgtctctattaaaaatgcaaaaattagctgggcgtggtggcaggtgcctataatcccagctactcgagaggctgaggcaggagagtcacttgaacccaggagtcggaggttgcagtgagctgagattgcgccactgcactccagcctgggcaacagagcgagactccatctaaaaaaaatacatatatatagttaatattatatttttatattttatatattatagatatatatatatctacaatgcacctgcaaaaattaaaaattaaagtcagtaataatgaccgcatgttttagacaggatggatgtattctattggtgagtctaggaagcatctagagatgacatttcaactcaacaaacattaattgctcggtgtttgggatacagagctgagcaggacaccctggacctggaggtactggatgagcatagaagagacaaccatccctgtctgtctccacacccgtcagtaaatgcttgtgtggtggatgcatcgtgaacaggcaggtattagcctggggagctcgctctcccttgcacctggctgagtgggcatctgaacaaagacacagaggagacaggctgaggtgaggttcagtaccccttagtgagttgttggtgtggctggaggagggagtgcggaggacagcaggggaaggaaaacgagagggaagctaggatgtggctgaaagacattggggagagctggaggggtggaccaggcctggcagggcagccccatccctgcccccttggaggaagtttcctgaactctcccagctcctgcacagggtctccggcacaggggggcttcctaggtgctgctccctctcccactctgcaggcagctgccgcctcctccaactcctgggcctattttgcccagtcagggccattcaattctgcatcaaggtgctaaatgggtctccagcagctccagagaaagatccatttaaaccgtgtgcatatggggaggagtctctgggaagagcagcccttgttggattcctgcattttgcagccttctggaactgagcagcttttagaatttcaagccacaatttgtattcaaatgaaggtcatttgaaaggtgtaacatagtaaacagccattatttcattttgatggtggcactaaaattatagtgttggttgaattattttagtgtaggaccattaccatctccctaaaacacttagaggcgttcttagaacgctgctaccatcctaaaattagaagaaaactaaaaatcatgaagctgagctggtggtggtgtagctgggggagaggacccccagtgcttgggacactgtcgcctcatggtggcgtagctgggggagaggacccccggcacccgggacactgtcctctcatggtggtgtagctgggggagaggacccccggcgtgtgcaacactgtcccctcatctagctttcctggctctccacagctgtttgagggctcagcccactatgtgcgcatgaagacgggggagtctcagtgctgtgaattgtgggacatagaaaaacgcacccccatcccacctgttcctctgttattcaagtccttaaaatctcactattgagaccttacccccatgagcttttctttcagagagaagcacccttggagggcgtgcctcttactgacagcccctccaggagcacttactggagaagctgtgagtcctttgctcacctgcagctgtgctgaagtctcgcctgttgggggcctacaagtcggggtggagtcgagggcaggtgctgtcttgcctgatgggcccttaccattctgctaccattggacatccagaatcctctgtctccctccttaggcccggggctcctctctctggccagccaaggatggaagtggctggtattaggtgggctggaggggtgggatcccctttagggactctgcactgcattgaagtagcaccgggagtcacgagcccgtggagtgacagacccagagagacttacagatcttcattcttcatggggcagatctggaaattgaggccctagagggacgtgacttctgttaggttatacagtgatttggtttgtctgtgtccccacccaaatctcatcttgaattgtagctcccataattcccatgtgtcttgggagggacttggtaggaggtaatcaagtcatggcaggggtgggtctttcctgtgctcttctcatgatagtgactaagtctcaggagatctaatggttttgaaaaggggagttcccctgcacacacactcctttgcttgccaccatgcgagatgtgactttgcttctcctttgccttccgccatgatcatgaggcctccccagccatgtggaactgtgagtccattaaacctcttttctttataaattactcagtcttgggtatgtctttattagcagtgtgagaacagactaatacacacagcaagtcacagaggatacgagattgagcctagagccttgggcttcctttgctgtcactgggtgtgtggttccctcatcggaaacccttggagtcagttctgttacagaattcagaactctctggattccagaggagtaactgagggtacgtgctggcacagtctcggtggctctgagaacagcccccaatgagcaaacgcactgatatttctgcagtaagacgtaaatacaccaagtgggaccaataagggcaatagatgatgtcagttcagattaaatgtggccactaaaaggtgccaagttgaagaaaaagacattggattcctggaacttttaggatttcagaatttccaataaaggatgtggccatttctaatagtagcacgtgctccttgaagaaaagctgaaaaattcaaaaagtactttagaagatggtaattgccccacatttaatcaatttacagatttttacttatgtatttttacatagcagaatttcttactctgtacaattttgcactctaattctcattattattttatttatttttttgaggcagggtctcactctgaaacccaggccggagtgcagtagtgtgatcatggctcaccgcagccttaacctcctgggctcaagtgatcctcccatctcagccttctgagtagctgggaccataggcatgcaccactacacatggctaatttttaatttttttgtggagacaagttctccctattatgttgcctagggtggtcttaaactcctggattcaagtgatcctcctacctcagcttcccaaagtgctggaattacaggcatgagccaccatgcctggcctattattatttctgagacagaatcttgctctgttgccaggctggagtgcagtggtgcaatcacagcttgctgcagtgctgactcctgggctcaagtgatctttgtgcctcagccttccaagtagctaggataacaggtgcacaccaccatgccccactaatttttaaattgttttgtagaggcagagtcttgctatgttgcccaggcctctcttaaactcctgggctccagtgatcctcctgcctcagcctcccaaagtgctgggattacaggcataatgtatttttttgacatttaatacatgatgtatttttaattgcattagataataaatgtttttctatgtttttaaagaaacatttggatggctgcacagtgttaggaagcgggccttcttgactctcagcctggtgcttttctccctagagcacatgctgcttctccagctagttacactgtaaacccacagagcactccctgagtgttctctggtaggtgcgccgatggccagtgtctgggagatcccctaggagtcatcccagaagcctcctagagcagcaatggggagaacagtctttagggctggagatgatggacagagctcccaagctgtgcccaggaagtgacatttccctctcccatgctggccacaggcaattgggaatcccatcaacttggaaatgagggcagatcctggagaggcacctctcattgcctgtgacatggagagcgggaggaggggccagagtgggggccttcagcaggctccttatgggggtgggtggcacagcccttggaacaagtgtttcctgcctgaatttcaccctcgggaggcccttagctacttcttaagtgtcccaagtacttgtctcatgatctagcgcccttccccaaagtcacaggcagcatggccccgggttctggctccctgtccccacgcagttggcagagcatggctttaagctcctcagtgctgcctaggaccccctcctggctgcctcccccttcactccacagggatcctcgctcagccctctgtgcgtagtggctctggttgaaggtgctggccgtagaggggtggggaggggtggggagcaggagcgatcctgcctcagtggcccaaactcatagggcttggtggggaccaggccaatgcaggacaattgggcctggtttgtgggcctccttgtcactctcccatgaaggagtgagtagggtggagggaggattattgggctaggagactctggagtcctttctggagcggggagcctctgaggctgacccatgtaaacttaccttgatgattcatcctccaaaactctggggattgggaacagtcaccaggacttacagaacattccagattgtggctcctgtgtgctgtctttatcctgtgttactctcccctcaggcagattgtccaaatgtaaattccagaaagaatctaagagtatgtgcggggaaccttacattcctggaaactcattctatcttggtgccatggtcttagaaaatatattcattttcagaaagagctagtgtctatgtcctgtggagccccctctacttctacctgccttccctccactacgttccagctatactggctgcctttcagctccagacgctccaacagtcagggctgtggcacctactctccctcttcttccccttcctcatcactcttactaagtctcagtttaaatctcaaccccctaaacctacaggcacccctgtcataatctgttgtcatactatatgcttttcctttgtaatacttatcacaatttgtctttatatattcatgttaatttcttttgtattatttcatatttatcttcttcacaaagcttcatggaggcaagttctataactaatttgtttacttcagtagcccagtagctggtacagagcaggcactcaataattggatctattatttgatggaaggatggatgaatgggtgagtggatggttgaatgtatgggtagggggatgggtgggtggatagagggttgggtgggtagatggatggttggatggataggtggatagatggttgatggatggatggatagattaatgcatacataggtggatgaatgggtgggtgatagatgaatgggtgggtggatagaggcttggatagatgaatgggtggattgatgattgggtgggtgggtaaatgggtggatgggtgggtggatcgagggttgggggtggataaatggttgggtggatgagtggatagatggatggatggatggagggatgggtggttgggcagatggatggattaatgaatggatagatggataaatgggtgggtggatgggtggatagatggatgggtgggtgggtgaatagatgggttggtagatgagtggatagaaggtagatgggttggtagatgagtggatagaaggtagatgggttggtaggtgagtggatagagggatgggtgggttgatgggtgggtggaaggctgggtgggcggatggcaacatcaagtactttgggaggccggggacttctgcattgtaaaagtgcataaaggggtttctttcttttcatggagaaaatttctattctgaaaatggcagcacattgcctgttgcaaagccaacactttgggaggctgaggtgggcagatcacttggggttaggagtttgagaccagcctggccaacatgatgaaccccgtctctaacagaaatacaaaaattagccaggtgtggggtggtgcggggctgaaatcccagctagtcaggaggctaagacaggggaatcacttgaacctgggaggcggaggttgcagtgagccgagatggcgccactgcaccctgcctgggtaacacagtgagactccatcttaaaaaagaaaatactcacaaaaaacaacaaagaaatgtctcctgggtgagtaggcttcaggcaggacctgggccagtggccggatggccattgactctctctgcacgttttccctctctgtacatctgcatcgtctttcctcagctgccgatggctgggttctgctcctcagtccatctgccagacaccgagttcagacgcgtcaggtcagctacctgaagaggcgactttcagggcctcaaatccaatgccaaattcctggggacgacagtctggagtaatctattaccagggcgctggggtcacacattcggactgtgggaggaccctgcttcccagagaaaggggtcgttgtatctgccacaccagttttacgtagactgcctatgggtctgacttccagttttggctgaagttctcacatcccgtttgatgactgcctggccagatgcctgttaggtcccaggcctggaagcccacaccgattacaaggctgtcccctaagctacaagcccgggaaacctgcccatttggagctgtgagtgtagggggcgtggggctgacttgcagagccaggccaggctggctgtaggaagagaactgcagctgtagctacgggggcccctcagtaaaggcgtcctgggtttgcccaagagagctgctccctgggcctgtcagatgcccactgtgaatgggaggagctggcatctgagtctgacagatgatctctgctcctctccacagcctggctttgcaagaggcaatgtgctgccattttcagaatagaaattttctccacgaaaagaagaaacccctttatgcacttttacaatgcagaatctaatttaggtttcaataagggaaggaaccattatatcaccctacttcagtgctttttgtcattacgttatattttttaaaatactttcatcggggacccgatatacacttacaatctctctgcatttattttcttttaagaacacatataataaaactcaaagttaatagcacgaaaataatttctacaataacagttgtagcaaatcttcgaattgccagggtgaaggtggctagacagagtgaggcaattacgtctattattagcagtgcacggggaggattgatgtacagtgggctgtgtgtgagcagaagccttcagacgtgaactacattttaatagtgaaattctcatagattataacttccttcattaacattttcacacatcgctgactaacaaatgaggagagaggccttctgcactcatagatttattatgcttgggatgctctctgcacctctgtgtatgggcaggagcttcgtcttctaacctctgactaccggcgattaactctttccggccctacctgtttccttcaggcacggaagaacattctggaaatactggctttgcactttaagacttttacaaggtggttcctcgggacagcccccactggctgctccctgccgtctttctgtgcctttcccctgttgccctgcaggtgggtatcagaggacggagggtctgggggaatgagtcaggccagatttgggctccatccgtctgctgccatgtctctcaccaggagaagcagaatctgatccctgctcaggtacttgagttgctaagtggggcgaggcagctctgagcatcaaaggatggttgtttgacacaattattagatctcctattagcaagaggagtgaagtggtcttctgtcccctgcgaggcaggggataccacccaagatgtgacagagggagttttggggagggctcactgggcagagaaggggaagtgggctttgccgtcaggatccaggtgaactgactttccaggtgcagagccttgtcctaggagaggatgaacgatttacaaaggagtcggatgccagtgcccgccctggagggatttgaggttaaggtgggaaaatcttgaggaagggacagtgtttttaggtgatttgtcaaccatcgtccatggttgtacctgcactgtgaggcgagtgctggggcttgcagagaaatgccatcttctggtcaccccattaacccggggaggcttcctggaaaattctgtgagtactggggctccaagatggtggttcctggtggttgtctgtacctggtaccaagtgggttagaagggtgctgtggacgtgagttaatgcagggagcaaacctcccaggtttggagctgggcgttgagtttccagcccatccttcctgatgacgcactcctgctggtttcttttggggacacaaagccttggtgacttaggacccaatattctacaagtttgctcttgggcatatcttgtggtgtttattgggcccccaatggcatatgagaccccctagggccaggttccccagcccctccgcccccacttcccatgctcatttgtgtgtctctgagttagggtattttggtaaactcttcaacaagattgaaattgaacccaggggttttcagtcctgtctgcatattgtcatcactgggtaacttttaaaaactaatgccagggcccaccctcagagactgttttgttttttttttttgagacagagtctcactctgtcacccaggctggagtgcagtggcgcaatcttagctcactgcaacctctgcctcccaggttcaagcgattcttctgcctcagcctcccaagtagctgggactacaggcatgtgccaccatgcccggctgattattttgtatttttagtagagacggagtttcaccatgttggccaggctggtctcgaactcctgacctgaggtgatctgcccgccttggcctcccaaagtgttgggattacaggcgtgagccatcacgcccggccaaagactcttttaaatggtctgggtggggctctggcattgctattatttaagagctcccaaatgattctagtgtccagtccaggttgaggaccaccaaaaccatttggcaggtgatctggcctttaggtgaattagctggaaggaagaagttctgaccggaacaaacagtgaggctgtgggcagatggggatgcatttataaaaccccttactttttctttctgtcttttgcaacctgtagatactcgttgctattggatgcaatgtgggaggcacaggactaaatcctgtaggtcgttgaggaaagggccgctttgcttttggtcccgggaatccaggttccccttcttccccatcactccttccttccccctccatccccagcctgtgctgtgtggtgcccaccccagcctcatggtccccaggtgggcatcatccgcagcaagagccggcgtctgtcatctttgatctcctcctgtaactctgtagggcttagccagctctgcttgactccagcaccagaccagcagcaggagctgctctgcttcccatccctcttccctgggaacattatcccttaaataaaatcaatagacctgggacatgcttggaatctagaagctaatctttcctaagttccgttttcgtgtcagagttctcctagtggccaccattggctgtgcagtgatgggatgtgggaatgaatccatggggacccccagtgcagtctggggaggtggtgcgggtgcgctgggtgattctgctgggagaagggccgtgacgctccgaaagctggtgctgggcttccttccactgcacagggctccatcctgcatcccggcaccccaccaagtgttagggagtgcgggaggcagacctaatgaaaacccggtttcattttgcataatcaggcactattgaaacgagcctttcagtgctgcttgctgcaaattaacaatctgacttatatacaataaaaacccgagtattgtacaaagtgatacttcttaggtagtggatacacagatggaaattcatttaatgaactacaagtccctgaatggattctaaacttcttgtaattaccctggaaagaaccctagtagaagcagaaaaaagccttttggattcccccccaccccctacccctgcgccacggcagttggctttctccatccttcaggttgctttgtcggaaatgagcatcattctgtgaagagtacttggagtcccgtccaacgggttgggccgcatgtggatgagcaaacctcattccccctctccaggttctgaaaacagtgtgatttgtaaaggctttggtgctgaaccaaatgcatcttaaatggtatcgtaaagagtttaacccatcaccccagcatcagccagtgaacagtctggctggctgcccgagggactggggagacctgctctttgtagcactggactgactgagtctagactgagccaatccgaggcagagactcaaccctgctcctggtagttttctttgaaagatggtgtcccaatggggaggccttcagaagagttccactaggccaggagtcactttcccctttgataaggcaggaggggcaggggacatgacagggcagaagttccttgggaaaaccagagcagagccaggttccagccctcaggtgagccatctcccacctccaccaccacagcctgatgcaggagccatctgggacctgcctcttccaaggagacagttccatggaagggggttagggacggatgtggcatccacaaggagtgccacactcgataagtatcccaacctgttccatatttattatgggcaacaatttgactaacggagaatttagattaataacattcaggccagagaagtaatttcctttgagaaagcgatttacatgcgctctgccagagagagccgtggccgctctcttgtcatgtcagctcaaataatgaagttgaaaataacatggaaggttaataggtccaacttatctctttagaactgaaaaggaagatttacagtgtggaggctgttttgcatatttccagtgggaattgaaagttttttttccccaaacaagatttatgagaactcaccgttcaaggtatctgctctgttattgctcctaagtgaggcagtaaacctcttcatttgggtggatgccccgggctttaaagatagctgtcttcccccacgtcactggcaggggtgtactggaatgctggcatgggggtgctacctcgggaagagtttaactttgaaaggagagtcaactgcttctgactctaggaggtcacatcctttgtttgctaatgactagagagaggattaaacatttccattacctagacctttcaaaacatttcttggatttattttgccattatttactgaccttggggggtgagtcctgggctggaggaatagagggaaagggagctgggtcagagcaaggagaatgggggagtggggcagcaacatgacctctgcattccaggcaacaagtgggtctttcaggctctcacttgcttcttaactggcttccctggaaagctcacccaagcccttctgctaacatctcactggccaacttcatctgcagacgggctgggaggggcaatcttttgctcagcactttcctgcccgtaatgaaattggagtgtgttatttaggaagaatgggagagtggatattggtaggtcaccagcagtctttagctcaagtgtttagttcatttattttcaatctttcttgttttctgttaaatgcaaactataaattgtcctttaaatactgctttagctgtgtctcacaattttttttctttctcccaaacattatactgaaaaatttcaaacgtaaagaagagttgaattagatatgatatatccatcactttaacaatttgctatatttgctttatcccatattcatccatgtatcaattcatcaatccatcttggtttgatatatttcacagtaaatcacagctaacagtacatgtcgcctctaaatatttcagcatgcatattatgaactgtttatttactttttaaggtaaaattcctacagtgaaacacacaatcttaagtgtgccgtgcgatgagttttgacagatgtgtctacccatgtaacccaaacttctataaagacacagaacatttctatcatcccaaaagggttcctctggtctcttcttagtcaatgctctcctacccccaggcaaccaatgttttgattattttcaccattagttatttttgcctattctagaactttatgaattcatataacatgtactttctctctctctgtctctctctctctctctctctatatatatatatatttatatatatatgtgtgtgtgtgttttaatctcaatagctttttgggggtacaagtggtttcaagtggttttggttacatggattaatttggtgaaggctgagatttcagtgcactggtgaccggaggagtgtatattgtacctaatacgtagctttaaacatgtcctcttttaggcaaggcttccttcattcagcatgttttttgagattcatctgtgttgttgcaagtatcagtagtttgtatcagtagtttttttttcctttttattgagagtagtattccattgtatgaatgtaccatagtttgtttatccattcattcatggacatctggtaggtttccagtttttggctattatgaataaaactgctgtgaatattttgtacaagtcttttttggggatgtgtgtttttatttcttttgggtaaatgcctaggaaagaattgttgggtgctgtgttttcttttttttaaaagaaactgctggatgtttttttcccctaaagtggttgtaccatttccaccagcaatgtatgaggattccagttgctctccatactcaccaacatttagtgctgtgactcttaatttcagccattctgatgggtgaacagtgggatctcattgtggtttccacttgcattccctgatgactaatggtattttccatgtgtttattagtcatccatatatctccctttgtgacatatctgctccaatcttttgtccattaaacatcgtggatttcccttttgttagtgggggcttgtagtttatatattctggatacagttctttgttagctatatgtttcacaaatattttctcttagaatgtggcctgcttattcatttttatttttatttatttgtttatccattcattcatttattttgagacagagtcttgctctgttgcccagggtggagtgcagtggagtgatctcggtttactgcagtctccccttcctgggttgaagcgattctccggcctcagccttctgagtagctgggattacaggtgaccaccaccatacctggctatttttttttgtatttttagtagagatgtggttttgccatgttggccaggttggtctcaaactcctggcctcaagtgatccgcctgcctcggcctcccaaagtgctgggattacaggcgtgagccactgtgcccggcttttgtttattgttataatggtgtttctttatgaccagaattttacattttgctgaaatatattttttatgatttatttatttatttttgagctagtcttactctgtcacccaggctggagtgcagtgatgcagttatgcctcactgcagccctgacacctggggctcaagcaatcctctcacctcagcctcccgaatagctggaactacaggtgcacaccaccaggccggctaatttttgtatttatttttgtagcaacgtggtcttgccatgttgcctaggctcgacttgaactcctgggctcaagtgatctacctgcctcagcctcccaaagtgctgggattacaggcataagccactgtgcccagcctgaagtttatcacttttttccctttctgattatttctttccatgccttctctaagaaatctttgcttattgtgaagatattctcctatgttttcttctagaagccttataatgctagcttttacatgcaggtctgttgctcatccattttcacactgctagaaagaaatacctgagactgggtaatttatcaagaaaagaggtttaattggttcatggttctgcaggctgtacaggaattgtggctggggatgcctcaggaaactttcaattatggcaggagggaaagcaggcacgtcttacatggccagagcaggaggaagaaagtgaagtgggaagtgccacatacttttaaacaatcagatcttgtgagaactcacctgctatcatgagagcagcaagggggaaatgcgttgccatgatccaatcacctcccaccaggcccctcctgcaacactggggattacaatttggcatgatatttgggtggagacacaaatcccaaccatgtcaccatctcagattaacttttatgtatggtgtaaggtaggagacaacattgttattttccatagtgatgtctagttgttcagcaccatttgttaaaaaaagactttcttttccccattggattgctttggcacctttgtctaaacattaattaaccacataagggtggatctattttggtttctattcttttccactaatctatttgtctgtccttataccagtacctcactgtcttgattattggagctttataataaatcttgatgtcagttctccaactttactttttcaaaatgatttgactatcttacctctttgacattttcatataaatttagaatcagcttgtcaatttctattaaaaaaacctgcaggtattttcattaggatagtgttatagattatttggagagaactgtcatctttaaaatactgagtcttccagtccataaaggtggtatatctcttatttaggtcttctttaatttccttcagcaatgtttttagttttcagtgtggagattttgcacatcttttcctgaatttattcctaggcattttatgattttttttttagacaccattactaaaatccccaattgagataataggtctatttctctctttatttctgtcaatttttgcttcttgtcttttgaggctctgttattaggcacatgcacaattatgattgtaatgcctccctgattaattgcctcatttttcactatgaaatgtctctacttctggtaaactgtttgtcttgaagtctacgctacatagccatttccagccttctgatgtttgtggtttacatggtgtatgtttttttatctattgctttctttgtctttctatttaaaatgtgtttcttgtagacagcctatagtttggtcttgctttttcctacattctgacaatctctgtttttaaactggagtgtttagtctatttatatttaatataattattgatatgtttggatttaggcctaccatgtcgacatatattttctgtttatctcacttgtttttaattgctctttgggttaattgaatgtattaaaaataattttaatttgttcatgcctctttgcatgttttgaattttttggtggttgcactagggaatgtaatgtatattcttaacttttcacaatctacatgtagttaatatttgtatcactttatgtaaattataagaatcttgcaactatattgtttatatcttaatttcttcatgctatacttgttatatgtattatatctatatatgctataagccccatagtgtattttttctttttttgctttaaacagccacatgtgttttatgacagtaggagaagaaaatggtatcttttataatcatactttggaagatctttgtttcttcctgaaatcagagttcccatttgtatcattttcctttggtgtgaagaatttcatttaactttatttcatagggaagatttgctggtggtgaattttcttatattttatttttcttaacatgtcttcattttgccttacttaatggtggatttttcactgggtgtagaattctgagtggacagtgtgtttttctctcagcacattaaaggtgctgttctcttccttctggcctcttgtttttgataaggtgttctttagcatttgtgttattccctgcggaacgtgtcctttatttctggctcccttcagaattctccctttatctttggggttattcactttgaccatgatgtgcctaggtattatttgttttgttttgttcattttgtttgaacttcttttttttttgagacaaggtctggctctatcacccagactagagttcagtggcacaatctcggctcacagcaacctccacctcccaggctcaaacgatcctctcccctcagcctcctgaatagctgggactacaggcgtgcaccaccatgcctaactaaattttgtattttctgtagagacagagtttcgccatgttggtcaggctggtctaaaactcctgggcacaagtgatcctcccgccttggcctctcaaagtgctggggattatagacatgagccattgcacccggcccgagcttcttgattctgaaaatctatgcctttcaacaaatttgggaaaattttggccattatttcttcaaattgttattctgccatattctcattgtcttcttctgggacttcaattatatggatatttgacctcatgtttttgtttttttaaaaaaataaatcaccaaggcttgttcatgtttttcaaactctttttttttccagatagatcagtatttatcggtgccagcactattgacattttgggccagtcattatttgttgcatgtgggaactcacttgagcacatttactttagatcctttaaaatcttttttttcttttcttttttttttttttttttttttttgagatggagtctcactctgtcgccaggctggagtagtgcagtgacatgatcttggctcactgcaacctccgcctcctgggttcaagcgattcttttgcctcagcctccccagtaactgagactacagacctgcgccaccacgcccagctaatttttgtatttttagtagagacgaggcttcaccattttggccaggattgtctcaatctcttgacctcgtgatccgcctgccttggcctcccaaagtgctgggattacaggcgtgagccaccgcacctggcctaaaatctttgtcttccaatttcaacatcgttttaaaatacaaatcattattattcaagtatggtgtgactaacagatcgggagatgattgcttttgaaaagaaagcttgttacaattccaagaggaaggggtactgcctgctacgggggcacatgggagagcaccaggagtggtcagaggtggagggagcaaggagaagtatggatcagagcctttgctgtggtttctgtgagaagggcaaggccaggccaggcaacttagacaggcataagactggctagttcaaacaattttggtgggctctgagcgaaggggctgtctcttgctgcctggtacctggccctggggcaagtagggcaggggaacagtggtatgagtgagagctcaccaagggaggcgggtgtggcgtgggcttcagaatggttggtttgcacatgaaaggggcattccttggcaaggcatttgctatctgcaggaattgtctaaccctgggaagtgcggtcctttctagagttagcaaagccccaagacgtcaaaacatcagaataaacagacatcttcatacaaaaatttgtgtcatctcagagtccattgattgattgccttttctcttgagtatgagttgcatttttctgctcatatatcttgtaatttgggactggattctggaccttgtgaatgatacgttgcagagacttgggattctgttacgctattcagaataatattgagtttttgttttagcagatacttcgctgagttcaaactataaactctgtcttgtctctgctgcagcagaaatctctgtccaggtgtttaggccttaggtgggctgcttacagtctattccatgcaaacataattcagagatcagctggagattgaggcagtttatgcacagactttggtgttctccctctgtggctctttccttttagggagttcccctttcattttctagctgctgtggttaacccaagctctcctctgattctacaaaaagtaagacttcagttttctatctgagtattagctgctctgtgacactgactggggcctgcctcaggcaaaaagctatttaaaaaaaaaagaaagaaagaaagaaagaaagaaaaaaagtcacaaaccctcagaaacttacccagtcttattcccttctttctactgtccaaatcccacccatttctgcctgcctttggtctctctctattgtcctctgattaaaaaatatatatattttaaatgttggaaggttggtccaacaagagctacttctccatgattgaaagtggaattctatgtctcatgaattttgacacatagtgattttcctgtgttctaagtgttcaaaaatttcccttacgattttttcctttaacaagtatcactgggatgtcttttcgcttccagatgtgtcggtttgcaagcgaaccttttgttggtaattgtaagcattcttatgttacagtcttacgtgtggttcctaggacgatgattctttggcattcaccgaagcttcccttgtggctcagtgcatgtttaatttttttgtgaatgttctacacgtactcaaaaaggatgtgcattctctgttggacgaattttccgtgtatttattagttaaaccctaataaattccttcatctttgttttttgctttgtgtgtgtgtgtgtgcgagccatcagtttgtgaggggatgcgttaaagtctccaaccaaacctactgatttatctatttctttttgcagccctgtcagatgttactctgcattttttgaggccaaattccgaggtgcatatcttttcaggatcatgacatcttcttgtgttagttcctttcggaagcatgtcgcgtctctccctatcttacctgtcctttggctcttcgggcagcctctcaatttcaggtttttacacatctctctaattctgggaaattcttggttattagttcttcatacagattcctccattcatgtttctgtcctcctgggtctcctgtgacatggatgttgacaggtcgtcttctgttttccatatttcctttcttttctttctttttttttttttttttgagacagagtttcgcttttgttgcccaggctggagtgcagtggctcgatcttggctcactgcaacctccacctcccgggttcaagcgattctcctgccttagcctctggagtagctgggattacaggcgtgcaccaccacgcctggctagttttttgtatttttagtagggacggggtttcaccatggccaggctggtcttgaactcctgacctcaggtgatccgccctccttggcctcccagtgtgctgggattaaaggtgtgagccaccgtgcccagcctcctttcatttattacaaattttttttccatctctttatcttttttttgatgcattctggtaagctccctgttgtgatcttaacctcactaaattattctttggctgtgtactgagtgcctttttttgttttgttttgagatggagtctcgctctgtcacccaggctggagcgcagtggcacggtcttggttcactgcaacctctgccttctgggttcaagtgattctcctacctcagcctcccgagtagctgggactacaggtgcgtgccgccacatccagctaatttttttttgtatttttagtagagacagagtttcaacatgttggccaggctggtctgacctcaggtgatccgcccatctctgagcgctttcttctaggaataagatagaataagtctgcacctccagcaggcttcttcccctcatctgagtccagagggagccctggagctctgcgtgctctccgcacatgccatgccactccctctgcgtcacatgtccctctgccaccaagatctgcttttatccctgtgctcctcagtcaccagagggagcccagactcccaagcctgtccccagggagacctgccctcaaggtttctttgagaatccactccccatgcactttgccttctccatagcaccgtctggtgcaccttgcgtttcgtctctcttgccaaacgtaagagccacggaggcagcactttttgtctcttttgtcctgtaacatatccctggcatcttgctgtggcgtctgacatgcggtggatgctcaataaatatttgcaaaattaatcaataattatactgtagttttattttacctatcatgtttcttttcataaagctaccttttattggacatctatgttcaaaagcagtgttaggatctttacatttatgacattatttaaatattcatttattcatttctttctaccttttttgtattgtaaaatacacataacataaaatttaccattttaaactttttttagtgcacagttcaatggcattaagtacattctcacttttgtgcagccatcatagtctccagaagtttttcattttcccaaactgaaactctgtgcccacaaaacaaagcaattatgtttctatagccagcgtttccagtggcttcttcctatgactgcctcttcccactctgtgttcccagtgtcttccctgatctctttgaggatatctgcttattttgaattcttgttctggtttgcctcttaattctgcttcctgatataaacatagggtttgtctttgtgttacgttgttcttgcactgagataaagaaatgcctgagactgggtaatttataaagaaaaggggttgaattggctcatggtttggcaggctgtacaagcatggtgctcatcacttggcttctggagaggcctcggggagcatttatttatttatttatgagacagagtctcactctgttgcccaggctggagtgcggtggtgccatcttggctcactgcaacctctgcctgtcaggctcgggtgatcctcctatctcagtctcccaagtagttgggaatacaggtgcatgccagcatgcctggctaatttttgtgtttttgtagagacggggctttcccatgttgcctaggctggtctcgaactactgggctcgagtgatctgcctaccccagcctcccaaagtgctaggattataccgtacccggccgggtcttttttcttagagcggttgtactccttggatgtttggttatttttccctgtgagccatagctgccttggagggtcatacaggtctaggccaggggcagggcctgcaccctcacttgtgctctttctggtgagttctagagaattgggggtggggagtgaggagaatacgttggtgataaaatctggtcttgatcattccctgatttcagtctgctttttcctccctgtagtgccctggccaacctgaccctgacaggttcttttctgagagctgccagcctctattgcaagtcccccaaccaaggggtggagaaagagaatcgagtgttcaggggccaccctgctgccaggttccactgtgatagactgtctgcgttgtctgggccctggtaccagctggtgctgggtgaggggctggtgcttctgctcttctgtggtcctcgctctagggacaggatgggagatgtgtgtccagggcaagatggagtggggagctgggccaccgaaagctggcttccttgcagcctgctcaccctggagctggcgcctctttcacttcccggtcctgcagccccctgcgtggggaggacccactcatgcttgtcttccccaggaacttctcaccatttctacccaagactttcctcttgtttgggggcatctctaaaatatggggaaccagcccctgcgtcagccactgtcttgctagctacctttgtcttttgaaggccacagggcaggggagtaggtttaaaatggctctgcttaggatgggaagttgaagaggcaggacaggagcgaggtggggagcatgtcttatggagcggggcctggaaaacaagcagtggaacagtctggctgtctccccacagcctgtggagcaggtcagcttatggggctcctatcctgagagggagcaggtgccttggcccgtggaagtccaaggttctgcatgatgtggcctctcttggctctgactttgggtgcttctgacttgtttaccacatatgtttcctttcaggttcattcttccacattcccacccttacctgttgacctcccccaattcctgctcatctttttgtctaatgagcttctggtgacttctaatgggcaccttatgttttaaagtggtcagatttgtttcagagagagagactttgtgggaagccacagacatgtttttatagaatcccagtgtctttgagcagaaaggggctttagaggtgacaggtcccattgctctcagattatcttatatttgactcactaattactcatttaagaaacccagttcccacaccgataggaaaaaccctaccctttctttcagttgtcacttacatatttataattgtcgttatatttttaatttctttagttttaaggccatgagtatcggagtaatggtgatgggagaaaatttgctggggagttcttaatcatcgtgaaaatcccatgttttcaaagcacttctcaccacttcaaaaccaccaactctctaaactccattttcagagcacttctcaccatttcataatcaccaactctataaactccaggaggataggagtttgtctttgtgttcactgctgtctctccaggtcccaggacaatgctctctacgtatttgtcaagtgaacaaatgacaccgttagtaaccctacctctgaatcccatctcttagctccaccctgcacttgaatattttcagagctgaggagctcaccactttgcacgctgacctgctatttctgcaatagtataaatggtcagcaagttcttgtttctgctgagtgtaaattattcaccttgaatatacattatcagtcctgcttctgtcccctggaaccacagagaattccatgaattcatctcatccatgagggcgtttctgatattgacgacagccagtgtggtctccctaggatgtctccaacaagcacatgtcccggatttcacgtcttcttcaaaggatgctggtcttcaccacctttgtcatccttttgggagtgagcccttgtttacagcactgattttatatgtggtaatgacaactaaacactgcatcaccaacgtggcttctgatcagagcagagaggaacggctgtgccaccttccttcttcttgacattatccttgattaatgcaaccaagctaatgccttctgcgtttgcacttaattacaaccctttttctttctttcttcttcttcttcttctttttttttttttttttgagacggattctccctctgtcgcccaggctggagtgcaatggcgctatctcagctcactgcaacctccgcctcccaggttcaagcaattctcctgcctcagcatcctgagtagctgagattacaggcgcctaccaccacgcctggataaatttttgtatttttagtagagatggggtttcaccatgttggtcaggctggtctcgaactccagaccttgtgatccacctgcctcagcctctcaagtgctgagattacaagtgttagccaccgcacccggactaaaacccttttccaaatagattctcccctgttctgtaccccaatcaggagtaaaaaccccatgttttgaaccgaggtgcagtgtcctatacttgcccccagcactgtgggatacgggagtcaggagacccacctgcattacagactggtgatggtgatcacataaaacagcgcagtgggaaagtgctttgaaagccatgaagaagtctaaggctgcctattattgctgtgtagctggtttattctatcataaacccattgaggtctgtttaaattgtgtgttggcccaccagaatatcagcatccttctcagtgttgttattcacggggtctaataagaatactttctatgacttcatttaagccattgatagaaatgaccgacaagacagggctgagggcaaaggccgtggcacatacttgtggggtgacttggatctatcatatcgctccatcctttgctagttcagttactcaaccgacagtgcatctccttgattgtactaccatctagcccatgtgccttcatcaaatttacagggataacatgatggcctttgctggctgccttgctgaaatccagaggcactgccgtctatggaaatgcaggttctatcaaaagagggaacgtgccggtttgccatgactcactcttgacgatgctgaacaggctcctggaggccacagcttctccctaagcgctccccaaacctgtaatggccagcatttcagcacagaggacagcgcaaagaagccatgaggactccttgaaggaacatggtaaagagcatggtaaattgctgtgctcggactcagggtttctgaaccttggcactattcacattctggtctgggcaattctttattttaagacttgtcctgtgcattgcagggtgtttagctgcatgcctggcctgtgcgcaccagatgccaggagcaccccttgctcagttgtgacaacaagaaatgtttctaggcattgccaatctgggggcaaaattgcccctggttgcaaaccactggtctaactaaaggagaaggggccagaaatatttagaacagtgatacctgccccaccaccactaccgcagtttctgggtgtgccttcagaataacatagatttgttatatctgaattgcattttgcagaggttagtatggaaatggatttgtatgctttgattctgctctgtcaatgtagagtaatgtggcccagaatcatgtttggtggcagcaggggtgccaggcagggaatgatccctgtagcatagatggctatgttagtagatggtccacgtgagaacacgtggaattcgacacgtcggcttagggaggtgctgatggaatcccagcacttaccagtacatgcctagagcgagggagctcctggactttattattatggtctggagcagcaaaactaaaaaagataatctctcctgggtgtctggttttaaggaatcactcatgcaggtaggttggtgatcatgggaggccacagaggtactttgttcagaagttattgtttccattagaaagagtaatgattttcatataccagcaagaaaaaacccatgttatcataggccagggatgagaataacaggaaatctccaagtttacggaagtatctggtttatgccctaggaggtaataggagttgtgagaggtgggtcaaggcctgccaacacatgtcagacaagagattattcatcattgttatttttgttttgaaaattaactccccgaaagggtcaggttgtgctgtgcctctcgaaggtgtaattccactttaaactgtaagctgttctgagatgatttcagcacaagaacgcgtttggttatggaacatgatttccccagctttccttgaaataaaaaattgcccaacatgcttaggaaatgggaattatggtggacacaatattattttctaggtggatcaccttataaacgaaagttccgtcatccagttaatggtgaaaaattgtctatttgaagagagaataattgccaaggagcagggaggccagtgttattgttttttcttttcttttttttccctcaaaaacagggctttgatatccattgcatttcaattgcatttagacttttgcatgaggcagctaggatcccagccaaagaacctgggtctggaacctgaaagtgggttatgaagaggaggcagctgctctgggttggcttctggaaggttgagctggggcttggccaatcagctgggcagagctcaggtagtcccattttattgctagaatgttctcataatcccacggagccttcagaactatgtgttctgcttgctttttttctttctaatttcaagtctgtttgttgtgaaataaagcatatatacaaaaaagtctactaaatggaaatatgccgatccatgaatgaaagtatgaaaaccacttaattcaagattatatcatgccagcacctcagaagatccccttcatccttatcccccatcctcctcaaagacaaccactatcctgatttccaacattatactttttcaattttttcaatgtttcctatttttaaattgtatttatttatttattgatttggagatggagtctctttctgtcacccaggctagagtgcaatggcacgatctcagctcactgtaacttctgcctcccaggttcaaacaattctcatgcctcagcctcctgaatagctgggattacaggcacatgccatcacacccggctaatttttttttgtgtttttagtagagacggggtttcactatgttggccaggctggtctcaaactcctgacctcaagtgatctgcctgccttggccttccaaagtgctgggattacaggtatgaaccaccatgtccggcctcaaagttttttagtttgaaaaagttgtaaacctacagagaagctgcaagatgattacaatgccacctgtctacccttcacctaggtggaccaactgtgactatttgccacatctacttgatctcacctgggaaattcttagccacccaccttggaagctggcttttgggccatcaagtgacactctggccggttttccagacaggcactccatttgctaaaatccagctggttctgagtggccatgcaaagactcctggtaaaatgaggagggctacatccctttggaacctcccaggagtccaggttcagttctttgggaaaaatagtttatcaatccatctgtgaattcatgtattaatttctccccctgcctttccctcccttccttctgccttctttttcttcttgcttttccctttcaagaaatactttctgatcactgtgggcctctgtggcaggtgctgaggatgtgctcgtgggtgagatgggcctgtctttgccttcaccatctatcttctgggtatgggggaaagcttgattaatatctaggcaatgacaaaaagtggtacacaaggaagtatgggatacaaagggaatacataggtatttcctacgtacgtaggtattccctccagtctaggatggcttgggaaggcttcctcgagggagggaccccagtccagaaggacacaaagaagagaaaaggggaaaagttgtttctggctagagctactttgagtcctgtgtacttgagtaccaaatggatgcggcactgaaacacatacagccatttgcagaatccaagtggctcaacagggtctggaggggtggcccctcagtggagggattgctgccccagatctggctgtacggagttggtgtgggatagaccagggcagggtctgttggcggattttggtgttggaagaacagagaggacagggaaggtagcattgggtgtggagcatttggaaggatggagaagcagggtggggtctgtgccagtcacagtgtctctgggtttagctagatgtggaggaaaatgggaagggcttcgtagacctgcccatagtatttgggtttggaaattttccagatttaattctagtctttccctgggcaatgggatatcttcagattctcccaactctatccttaaaatcctggatggtaagatctggtaggcagagagatttttaagaatagagtttacttttccccattaaaaactaatatatgcttattacggaaaatttataaagtacataaaagcagaaagaagaaaataagaggtggtattttactggattgtggattagtcctagaaattctatggaatggtgggtggccagatttattccattcattgtttatttgatgggaaaaaaacccaagcagcccaaccctgtactgttttcagaatcaccccaaggcctgggttcagaatattagcttgttaattatcaggaaaatgatagagctgagaagaaattcacccatctctaaggccagctggagaacccagttgaggtgggctgagatggaaatgaccttctccaaagcactgagccccatgaatcatccctggggcacctattagctgtgagctccattcatccttcccggaggactgtccccacctgaccggtcacagctcaccccaacccagagcctctgagggctggagcctctctccatctgagccctaagcttccttttccccttgttcccacactaacattctatgatttcccccttaacctcttcatgacatcaaccagtggagaccttgtatgatttctagagttctttttttcccggttggaggacttacttatttactctggttgacattctgctttctttcaggaaggatttgtgagagcctagcacaaaattcactttcttaacaagaatgtcagatggtagtaaaaaaaaaaaaaaaaaataagaatttttggatacggtattaataatgttacggaatgggctttcagtttggccacaggtgtcctggtagtcagggccaaggggatggatgatggctcgtggttgtttggtgggcaccatgctacctctgagaagagaggtgctctgctgctggctgcggcaaggaactgatcacataggatctcacgtggggagcatcgaccaggagaggggtccacattgtcacagcagcttggagcgtggaagcacacatataatcatcacttaactaaagctgaggccagatagaggagacttggaagtgagggacccgaaaatgggaacccttgctaaggacacaggcagctgtacgccagagcctgtgggccaccccgaggaagtgacccctatgagccagccttgtggggcaacagaatgtcacacccaggtccttccctcgcctcgagaaccccaagcgaattcccacttcccacaggaagtagttcagacccttgggatacctggcgtggtcctcctgaccggggctcagtttacctcctgcttcagcccttactcgcctcctccaatcccaaactcctcccatcctcaggtgacctggtgcttgacccagactgccgaggggtggccgggccctgtcagtgctgcggaggtgagctccttctgaaaggaccccctgtggggctcccggggcgtcgcttctgcctcttccagtgctttccgaccctgtgcttttctaccgacttctgggccgggtcatccactcctccagaagagaggccagggagcattccatcagccccacctctccagaggcccggcacacagtaggcactcaatggttgtaaactgtatccacctacaaagcccctagagcttgtgagacccgggaaacagcgttccatacaattgagtgacagagccctgcgtggaaagggaggcccgtgttggtgccctgtcctcatccagtgggaggggaggagagacctggaaggaagatgggagtcccaccccagcctgcgtgtttctctgggaaacaggtttcaagtgcagggaggtggtggagggctgacttcatggccagcactgtcctgggcaccgtgggtcgtggaagggaggtggagctcggttttccgtctgggcctcaggtggactcagaggaggttcttagagaaccatacagggcatatcaggtaagcacgggtacacaatgcagagaaacagtgcttgctgcaattagagaaagcagagaaataggagctggagtggtcactaaaggcacgaacggccttgacggtggagtggggagaggcagacacattgccggcacaaagagcatgctggatgacaggtttcgtggcttgtttgttgctttaattgatgtggacaggggattccaggtaggagaatccaggcaggctaggaaggagcttggctctgtgtggggcatgagaagacgtgctggtcttagcggaaggtccccagaggaggggaggctcaggggccggcaaggtggctgagcctcgagcaccctccacagagcaccgtgccaggggcctggggcgcatgttgtaacctggctgtctacactagatgaatagaactttcacaggttagtggcttcatcttgattgtttaaatttcataaggcgttgggaccccttacgagtagctctgaaagggaatggattgctaataaatgcaaactgtaaaatattcatttgagatgattattttatattattgcataagtgcaaaatgaatgaactttctgcttacttatggtggaatccacaaccatctgagctatttagtgaatgaaatatttaacctaatttctatgccttaagtgacctaaggataaatgttatggtttaatgttttagtgttagagaaggaactaagggaaataaacagacttcgaggcctcctgctggcttccaatggggaaggagcatctcctgggccaggagtccttgggagcctccagcatcttcccgcccctcacggagggtcagcggccatgcccagccatgctgccaggacctggggagagcagtaccctcagccctcactctcaggagctcagggctggggaggggacagcaggggccttggccatgtcccttccctttctgggccccgtttactcctcagaacaaggcaggctcggaccaggaactcctggggctgtcagctccaatgtggcagagttgtgagtgctggaggctgctgggaggtttctggggggctaggactaggatggctgccaggacttgagggtggaggcagggacagagattccccagaggcggcatcgtgggtgggaaggcaggaaacccgggtctgtgtcctcctggggcagtgtggttccaggacccaggtccagctcagtggccaaggaaagcccttgcctgcctgggcctctctgtgctgcagtgtccctgtccggccccctcttcacttttgcatctgatgcatctgcactgccagggctgccaggcctgttttgctgccaggtgccctgtgttgccgtagcccttgaagaaggaccaccgcagcctcagaaaggggcaagcatcacactgcggcatcacggacacctgcagctccaggaagctcgggggcgagtgtgagccctgctgcttctgtcccccagagccccggtccgggctgcactcccaaccttgcctcccagcttgacgtgcactgctgatgagttggtccgtgcagagcctctaaggcagcttggacatggggagctgtgggtttggtcctgctttgtgcccagggctctgggttcaggtagccagtgctgagccctctgtcactgcagcatggggctgctttccctgcggtcctcgtgcttgggctctagcttggtccaaaaggctttcctcagggagctccccatttgagctctgggccttggcagggattggagcaccatcccttggaggtgttggcgctgtccaggtgccggccagtgtggaaggagctggctgctgaggatttaccagccccttttggttaccaggctcaggcacttgccaggggttggttggtttgtttcttctggatttggatttgtccccaggacagacgtccttgggtcttaccaggaaccatggcctgcaggacactgctgcgaggagggcttcctggagcttggggaagcttcagtccagagaagacagaggacttgactgagctcatggtcagggagtgtcagaacgaggaccaggaccccagggccggctcctgggccgccccctcactcggcgtccagtgctcaggcctctgggctctctctggcccttgcttggttgagctcagctgtgctcagtgactttgggccacgggctgtggcgtcacatcctccagagccttctctggtcactcccaggtcatgtcagtcctgaggatgccaggagacgctttctgaacacagtctgcgtccttccttattttttgttatcttggctgtttgacaaatagactttggaggtggaaagacctgagttcaaatctcggacccactactgaccagctgggtgacgtttcattatccataacatagagaagatactgagagtccatgagacaccacacagaaggctcatagcatggggcctggcaccgaataggtgctgtttacgtgatagcttgtatggttggctctccacacccaccctcactgccacccccagccccagccttcctttgtgcccgtttctgagtagtaagatttcttactaacagtttcttgtactcagcttccccatcaccttccttccatttcagcagaaccctctggagtggagcaagcgatgggaaatgctcttatcaggcacctgggacctaagcaggtgccctaaccagcagcagctgagcactgagccctgggaacacctgtgcccaggtgcaggtgctggtgagggtggctgccgctgtccagccctgatctctggggcaaatgaatgttccaaccccaaacatccccacagcggtcccgacagacgcctactggtttggcaagcactgtcgtgcgtgggagctctgcttactggcttctgtcttggcatggtctctgcagaaggaagccactgcagacttggtggctggtcttcgcattgggttgaagggtgattcagtgttccagtttggattgtaactgctttattttttaattgtttttttgagacagagtctcgctcttttcgccgagactggagggcaatgctgtgatctcggctcactgcaacctctgcctcttgggttcaaatgatgctgggattacatgcatgagctactgtgccctgcctggattgtaactactttaaaaaacccttccaatgctcctcagtgcccctagaataagcttctagaccctcagccctgccggcatgcccattcccatctttctagcgccctctgagacccttcgccctcctatccactctgaagatgcggaggacctaccttgaccttccccccatgccatgaacatggcgggggggccctctcctcattccagacccagctctggcatcactcttctagaggtggtcccagagcatccgtgtcaaaaatccccgtcccagttcccagcttcatccctgtctacttccttcatgacgtttatcacagtttctagctattttattatttgttcctttcctttttggtccacgtcccccactacagtgtaacctctacaaggcgagaaactctgcccacctgtcactggtgtgtccgcagtgccagctcagaggctggcaggcagagccgctcattaatatatgctggctgtgaccttgccattcccagtagttccgatacctccaaattccgagattacaaacatcccactcttcaaataccacatccaacatgtctctccgccccactcctccaatttcccctgatgcccctgagactacaagcccccagtgctcagggggccccttcccaatcctcagactttctggccctgtctcagttcatcatgctcactgggggaaaccacaatgctggggaaacccagcccttgccttgccccttgtccatacctgtgcagccggagagacacctgcgggtgtgctgatgtcacggttcaagtttttaacctcatgtgggcccatgatactgcccggtcaggtgctggtggtccccgtccacgcttcccattctccaaggtgactcttaagtaccttcaccctctctcaagcccccaacactcctcccgccctctctcttagctgttgaccttgccaggtagagataattgaaggagaacttcctccagctcctcctgccagatctgccactttctttctggtccctgtgaggccctggctctgtccactgctgctcttggtcctgcctcctgggtttctggcaccggtctttctctcctccctggatcttcccgtcagcatacaaacatgccacgatttctcccatcttaaagaccctctctagacctctccctcctccaagccaggccccctcctctctttctcatttgcaggcagactcttggagagccgtccacagggctgagtgctgtgggcgcttctcagtcctcgcccttgcctgtcggcagcctgtgacgtggctgattgcccctctctgtgacgcacttccttcccttcgtgccacctcacactggcttcctttcctctcaccactggggctgccctttctcttcctcagtttccccccactctgaattctgtcttgctcctgggctctgtccttggattccctgtctgccacttgtgtgcagactcacatctctaaatgtagcttcccgccatgtgcctgcgggctggacttcccgtctgagctcccaactcaccgtccagctgcttctcgggaacctccacttgtctcgggtatagaacctgagtgtctgtaatctctccccacatctgatctggctgctgcttcccagtaatgccaacttcatcctgctagtgtcttgggccaaaagccttgggatcatccctgagtcccctctctcgtctccacacgtccagaccttcaacaaaccctgtggccgtgacttcaaaacacactcgtccctcattgccttgtgccgcacctcctccgtgccagcacttctcgctggggaagttgcagacccttctaccattctccaggccctgcctttgcccttcttctttttttttttttttttttttttgagatagagtctcgccagcctgttgctcaggctggagtgcagtggcacggtgttatctcactgcaacctctgcctcccaggttcgagattctcatgccttagcctcctgagtagggattacagaagtgtaccaccatgcccggctaatttttgtatttttagtacagatggggtttcgccatgttgaccaggctggtcttgaactcctggtctcaagtgatccacccacttcagtctctcaaagtgctgggattacaggcgtgagccaccacacctggcccctttgtccttcttgagtcttttctcaacccggaagccagagccattctgctaagatcaggcctggccgtcctcagtgcttaggtaagcagagtgtggctcagctgtgcactgttcctggctgcaggtggcagaggtggagtcagggatggagccaggagttgaactttggagtgctggactcaccgcccccctggtgtggacaagcccctctgtgatctgctggttctacattgtgttcttggtgaggagggcaaggatacttttgcaattctcaacttctgggagctggcggaacttcccttcctgtcttgcctccactcctcaaggcctcaaactatcccataatgctcggcttccttgtgactcctcttcttcaaccccaacgacaagcagccagctgagagcctcctccaaagtcagagacaaggagcttggcagtggacctgctgccagaggcaaggccgtgatcttggaacatggaagcccagcacatttgcttgtcctaaaaatacagttcttaaaatagaccagtccatgtgggagatagggaacctgtcgagtgcggttctgaagggcttgctctgccaaggggaccggctggctggggcagcgcctgggcagggctgtgtgcctcagagggtgccctcagccgtggcagaagccacagcctgggtttggggtaccctgtctggctcttgttcttcaaaccccatccagaggcaggccggtctcttacctgctcgatgtctgcacatagggaaacctgagttgaagccgagccttgggttaggccctgcaaaagctgcaaacaacagtttgtgtttggggtgtgaggctataaacagcccaggagtcctgagggggttggagagttggtcaaccgtgaacaagctggagactggctccttcttcctggggatcccagcgcccactacaaaggtgaactcctttttgctccctgccccagcctgccccattagacagggcatggtgaggcgaatggctgcagggactgaggcctttctgtaactaaagcccagcccaagtatagggagcaatggccgagcttctgttttaaggcagcaaaacagcgtgcgagcttggtcccttaacacggagtctggaattgtttctcataacccaacgcttggcttggtttcaaaaaggaagcctctcctctcgggtatcatgaccaggctcctcgtaagaggtgggactcagccgagggggccagtctagaggttacacattctgagctacctttcggggtctgtggaccctctcagaccctgcagcatgtcgggggccgggtgggggagcgggtggtggcatcagtgggtttctgatgaatgcctggagttgtttgtataattggggctctgtgtgtctttttttggaggaagagcttctttcacattccctgactcaaaaaccacaagctaaatgatctgtacattgtcctccaactctgagagcctctgatcctattattccaagtcaagaaattttgaaaattacaggatagaattctttctcagaacagatgctagggatttgtaagtttccattccctgtgctgccctggtttgctggatggacggatgtcttggaattttcaagacctccagtcctcaaagaggttcttctcacctgctgtcctggtgagctgcatgggcctccctccatggtgactgtgttgttggaccgagtgggatcagttgagtgggaggcgctaatgaccggatttcctacgttgtcccctgctcccctgactctattcctcactgagccagacagactcaccgcttccagtgtctgtggcatgttcccactgtccaccctcacggttcacattttctggaatgttctgctcttccccctgtccaggtcctgtgtgtcttcagggtctggtcagatgtcttccggtgaggctgcagctaaacttagcctgcccagcctgcctctcctctgaatgcacatagtgttgacatttttttcagtttaaaaaattttattttaaaaatgatcttacagttaaattgacgtttttggggctgtgccgttccatgacttttaacccatgttagcactgccacaagtaagggacagggcagctccaccacatcctgcagtgtattcgtctgttttcgcattgctataaagaactacctgagactgggcaatttatatagaaaaaaggtttaattggctcacatttctgcaggctgtacaggaagcgtggctggggaggcctcaggaaacttaggatcgtggcggaaggcaaaggggaagcaggcatgtcctgcatggctgaggaggcctcaggaaacttacaatcatggcagaaggcgaaggggaagcaggcatgtcctgcatggctggagcaggaggaagagggtgaagggacaggtgctgcacaccttcaaacagccggatctcctgagaactcactatcatgagaacagcaagagggaatcctcccctatgattcagtcacctcccccaggctcttcctccaacattggggattacagtttgacatgagatttgggtgggacacagagccaaaccatgtcatgcagccacaccctgccccatcctaaccccccgaaatcactcatctctgctctgccaccatgggttggtctttttgagaatgtcagatgcaggctggcttctttccctcagcctgacacccgtgagagccgtctgagttggtgtatgtgtcaacagttggttcctttcagtggctgggtacgcgtcctgtcttatccacatgttctcttggtgaattttgcctcattgtgtgcatgtcctatgtcactagatgcagggaggcaagggcagcatgtggttcatttttataacctttcaaatgctctgcaaacagtaggtgctcagctgtcgaatgggtgaatgaatggaccacaatgggtaacaggaaggggaaattaattttacagaattttgtatttcctatatcctaaaaaatctccagtaaacataacccttaatttcctgaattaaaaatgattcatgctgggcgtggtggctcatgcctgtaatcccagcacttggggaagccaaggcaggtagatcacttgaggtcagggattcaagaccagcctggctaacatggggaaaccccatctctaccaacaatacaaaaaattagccttgcgtggtggcagacacctgtaatcccagctacatgggaggctgagacaggagaatcacttgaacccaggaggttggaggttgcagtgagctgagattgcaccactgcactccagcctgagtgacagagcgagcctgtctcaaaagaagaaaaaaaaaaggaaaagaaaaaaaagattcattgcctctctgtattctgttagtagccgagacaggagaaaaagcaatcaaggtaacctaataacagggatttccttctccagactccctccctgcctactcacctttctgtctctttttctggtaagtatttccctggccatgtcctgggacctgtacacaggtgcccacttcttacaccccaccactgggagtcttcgacagctctcacacagaagaggaatactgtggtcctggaagttgctaggtaggccccgagtcccagttgtttcatttctcaggacctcctggtgctacagaagaatgaaacaggccccagactggaagttgccacacatgccttgtgatgctggctctgatgggccttgctgtgtgatcttgcttaagttgcttcccctttctggtctttattttcattaccttattttgtacccattgattaaaagatgaatctgaaagagatggtttctgtagtctcttcaagctctgaaacaatatgattttgtgaactcacatactcatacagacataaacacaaggaggatttgctaatgaacttcttcgttctttgctaaatataaatgccttgcttgtgaccacagaggttcaggtgctccgtcagcgagtatttaagtacctactatgtgtaggtttcaaacttgaggctttaagtgtttgtaggaaatggaaacactgtctgatgtctttctagtctttaaatgaggagtggagaggtaaggaagaggtgcgtgttatcatggccctgtctcatttgtatgcatcagtcctctttttcttctgcttcctttcctgggatcgccacattcttgttggtgtcttacagacaaacctgttcaggactgaatgaccaagtgccccagaaacatgggttggtgtgggtggtgcccaagcctgacccctgcctgttttctcatacacggttcacgttgcccccagcagaagtggagagtaaggggctcactggctatttctccaaaatgcgttggttggtgtggaattgggtacaacctggtactttctgtgagtgttgagggcctgctcctccaggccatgggccatgccttccaaggttttttgtttttttttttctgagacatggtttcactgtcacccaggctgtagcacagtggtgcgatcttggctcgctgcagccttgacctccaagggctcaagccatcctcccgcctcagcctcctgggtacctgggaccacaggtgtgcggcaccacgcctggctaatgccagggctttttaacagatggtctcaggagtctcctttgtggaggttcaggtcactctggggatggatggagcgggggcttaggactcctctctcgactcctgggtcagaaagtgactccatcaaacaggcatttttatggtctcaaatgggtttaacaagaaagaagtcatggaggcagtgaatgaagacacagatagtgagggacacggacctactggtggctcgcagtgcttatgatgtaggggttgaatgtcttttgtctccagcaggcttgccttgaggagagacaccattttgccatcatctttacccccagaaagaacaggtggggagatttgtgtaggactctttttccccatatggagaactctatggccattttacaaacattccccatccttccaaatcctctctcccgcttctccttgccaagtttacactgccaattatactagactagcaacaaggagcttggagagaagggctgcttttagagatgccattccaagtgccaacaaggtgttctcgataaccggaatcagcaccgctctccttcctgtcatgtagccctggtaaccacagagcatgtttatgctcggggagtctatttcccgttgttggggtcggaaccattcctggagtcatttcttggttttaatgctcatcctttccctttccagccattaaagcttctggcctagaaaagcctgtctggctagcctgacctggtgctccgtttctgttatctctgatcagcagcggggagggcactgtggacagaaacatgttagagaaggcccgtctgcagaggggcccgaagagacccgaggacaccctcctggctgcagggtgcctgttccttccctggttctgtgcacctccatcctggcaagagggccttggtgggcggggtggatgcccgcatgcctttggtgctaccatgacaaggtggccctggcccgggagtggagcggtgcctgggttccgcgaaatgcctcagagccatgactttctgcttctcacagcttctttaactcagtctcttagtcttcccctgaactcgcggacactcgggttctctgaccagcatgttaagggttgggctgggcagcctctgcaaaggtcttctttactgtcaacttgaacagtttccataaggttgtgtcggggacacctagaaataggttcctttgaacaacagtatgctcgttgactaccaagaccttccaaaagagtgagagattgggttggggatgggatttcaggctgtgtgtgtaaattcagcatgatcctccatgtggagaggagacacactggtgagggcagctcctggtggtggggcaggggtcacaaagctctgaaatgaacagtgaagtcgtggaggggccctttagcagaacccaggattggggcaccagcgaccctttccttcccagggggaaagtggttcactgccagaaatgctttagaatcgttagaggacaggagatcagctacacagatgatgaaactgaaagccagggtctgtttgttctgctgctgagcaaacttggtaaaaatgttcatcgagatggaaaacaagaacacagacacactgtgagccttttgacctttgcctttgacccggaaatgtgactgtttcctggagaaagtgagttcacctgtgtccctgtgcctgtgcctgccacagccccgcccagctccccggcacctgctccgactccagctctcatggaagcagtgttttgcgatgaagtcttggaagccaacagctctcctttctcctctttcccatgtgtggtgtttgtgattccagaaataagttgggctccaccctcagagtggcaagcattgatggtttctcattcaggggctcactggggattgcctgaagccaatgctggcatggctgggctgcctgtttctccaggagggccgtgatggcacatttgtgtcaatattacctgcagaagaactttccatcttttataacaggcaattctgttcaggagtatgaattggagccaattagggctaaaagtagattccaaaatatatacagttatatggcatattacgatgttttggtcaacaactgattgcatataccacagtggtcccataagatgctaacgctatatttttactatatcttttctatgtttagatatgtttagatacacacatacttaccatgtgtaacagttgcctacagtattcagtatagcaacatgctgcacaggtttgtagcccaggagccataggctggatgagtctagcctgggagggtaggaggctatcccctctaggtttgtgtaagtatgcactttgtgtaagtacactatgatgttcacacaatgacaagatcgcctaatgacacatttctcagaatgtgtccttgtcattatgggacgcaggactgtataggcaacaaacagataaattgacaaatgatttctgaccaccccctactgtaggctgagggctcatgcccctctgagggctcctgtaggaggctctcctgcctctgattcagtgctgggggcagagggggctgcaaattgtgggcttagccttgagctgcgatatggggcaagatgatgacatggggaaggaccatgatcagagacagagctggagagggaccagggctgaccccaatgccacaggaagtggctggagttgttctaccctggagggaccggagctggggcttactctcaccagggtgttgtacagaggcaggtgatcccctgattgtccccactgggccaccaggcagccctcacctgtccttgggctagaagagcacttcttctccatcccaggcttaggcagtgcttgtgcatcctgcaggggtgtgggccaccccggcctcggtgcaccctgcttttgaccattcttcgtgctggaggcgaggagtgagtctggggacctgcccgggggctccatggctgacacagctggccatacaactgcaggtgtcagagatgttttgagaaactcccttcagggcaatcaagcccttgccaagtggaatcactctgcatttacatgggtggcttctgaacgtggccgtgatgaattgtgctccggcagggcctcggcagtgaaaaatggggcggtgcgatggagtaggaaggtgcggggtctctgctgggctggagcctgcacctgaaccgggagtctggagccactggaaacagtgggtgcctccaccagccccgggggaatgcacagatgtgccctcatcgctcagcttctctctttgtctgtctgctcccttcatgtgcatcgtctttttctgattttccctctgtctctccaggctgaaatgcagcatcaaacacacgctctcctgctttcttgctttgtctctcttacacttctcttcccttctttcttattcgatttttaaattataatcaaaaccactggacagtgagcacgggcaggagggacattggatgagggtggatgtgtcactgtcttgattgcggtgacagtttcccaggcatgcgcatgtgtcaaaacttagtgttgcacacctcaaatatgtgcagttccttgtgtgtcagctgtaccttaataaagctatatttaaaatcccccactcattttgagtaggaaagcaatgagaagatgtttttgaatatttaacttttagaaaagcctgtattctgcttccctgtaaagtagagggagacagagacccagcagggggcatttctttctggggtttgagcactggaagatcattattaacagtgcaacagccaccgccgttcagtgagtggtttattcggtaggacaagcctatgcaacagcccttgcatttgtcccagagactcagggagggtaagcaaagtgacctgcccaaggccacgcagctggtcaggggcaaagctctgcttcccagcaggtctcccgagcgtgactcccctccagtactagttgtgggatgggacagatgcacctgggagtggctggcagagagtgtgttggcaattgtttagcacttacccttgagatttagtttgagattgaagaaaagatggtctctgcttctctggctcacaggcagtcacccccttcctttcctccctcagccacttatgcattcccagcagggtacctttgatgctgggggaaggactctttatgatcccttccctccagactttggctggctggctgttgaggtgagtggaaaggccacaggatgactctgccgtgggtattgggtgggccagtggtaggggctagctgtgcaatcaagaggctatgaggagtgaggtttcctcttggattggccttctaattagtctaggatgacataaagaagcctctcttttaaaaaaaggcaaatttggtcagttcttggtttccagggttttggaatgtccaggcaaaattgccttggcaccttctgaaatcctagagaggtagtgtagcccacttgctggggctgacttctgttgccagcgcctcacctccatctgattgcagggtattggttggccatatgcttcagggatttgaaggagggttacctatgtctagggcttaacgtgttcttggagaatattgggcaagagtatgattccctgagtctgggggaaggaggagctccagtggaacttccagtcaagatgccaactatgcatatgtgggaatctctgttctctcactctaaacccatagaaatgttggattagttataatagcaacaaaaacatagctgaattcaaaggtgaggttgggagatttccaggtgccggaagccaggatgaaatttagagtgcaagtcgagtggccttactggagtttccacagtaaaccccttaagggctgaggtttcacaggccccagggagctggaaccaagtttcttgtacaaaactgggaacaagaagggactgtcttttctgtcatcaaaaaatagaaaaattcttcccattggctcaggaacacggtataccccagtcccccaagccgtagcttctaagagtttccttcaagaacgagggataccaagcctaagctgtatatagatatgagaccaaatcctgcactatcaatgtgggcagaaactccgagctgagaacctaacataaaatttggtcccgaattagtggtacccttaaagctgtgtcagatgtaagcgtaaaacttgttatgggggatgattcctcaacacaaggcacacatgagattcccaggggaaaaactgggggactcccaatgtagataagcccttaggcaaaaattacaaagcagactagcaaattgaccaccacgggagataatccacaaatgctgtgaaaggagaatttatgtttcagaaactatagacaacagagcaatctgagaaggctgttagatagatcagatatgtgtaaaatgtttgaagagacaagaaataaaatccataagacttgaataggagataatgggatgaaacaagtggttttttttaaaaaaagaatcagttattctagaaataaaacatgtaataattgcaatgaaaacaaaacaagatgccaaaacccttctaatagatggggataaacaaaagaatagacatatttgctaaagaatgagttagttaaggccaggtgtggtggctcacgcctgtaatcctagcactttgggaggctgaggtgggcagatcacttgaggtcaggagtttgagaccagcctgaccaacatggtgaaaccctgtctctactaaaaattcaaaaattagccgggcatggtggcaggcgcctgtaatcccagctactcaggaggctgaggcaggagaattgcttgaatctggcggggtggagcttgcagtgagccaagattgcgccacggcactgcagcctgggggacagagcgagactctgtctcaaaaaaaaaaaaaaaaagaaagaaagaaagaaagaaacaaatagttaagcataagatggtcctgatgagatccaccgaactgtggtttagggaagtaaaggcggaaaatgtgcacatgaaggtccagcacatatctaatgggcatctcagaggagaagacagagacaacaggagggaggcatgcttgaaagcaatacggctggaggaataaagacagacgtaagccttcctactgaaaatgaacatggaattgcaggtggaataaataaaagcaaaaatccatgtgtgggcacatcagggtgaaactactgaacaccagagataaagagataccttaaaaaaaccaccaggaaaacagcgacagtgagacctcattagtttgggtaaatataaaatggggaaaatgcaagataggggctggcctgctgtctgtattttagtatgtcttcctaaaggaataaatagggtaaataggatacttttggttcttcagtctgcaatcagtctgcactagcagtgtgatgctggcctttaagaacaaaagcatctgtgtgtatctgttccagtgtttttgaagttattgttcacccgatgtgtttctagggccgtgtctgctccatcgacacctttctgggatgaaccttcaaacatgggctgtgggcctgggatcccctcgacaggtgctgccaagaatgaaaatgtgatctttgcagggtgcttacctcctattaataaggaaaaaagcaaactaaattagtcttgggaagtaaagtgccatatgaatcagctttcctcactccgaaaataacttgctaagaatttatgatcccctaagttctgctgattttttatattgtttactttcctctccaaaatatcaaataattcacaggtggtatgtatggtggctgtatggataatttgaaatgagaaatggacagcaagagaaatttccttctagggggtcagtgctggggtgactccctaagactaatggtgctggattaataacctggggctgcttcagtattcatggcttgttccctctgaaggctgggatatttcccacttttatgtcctgcacaaaactgtaaagcaaagatggtttcattgcagctatgtgcgtaatgagatgcgcaagagctgctcttgcccattaatcagcgtttgggggaggcttctggaagcctgacctattgccgcggtagctgatctgaatgcaatgatttttcccctgtgggagccgaggctgcaggacctgagagctggctctggcagcctgggggccctggccatgaagttgtactgcagagaggaagggtggtcccatcatcagggcgcacaggcaaatggctggggtttctcagatgaaaaggctgcagggccttggaaggaaccataggatatatggtttgcaagagaccacctatttctggggtccatctcgccagcccctctggccttactggggtgggggaggtagaggagggtggatgtagctacattcaacagggatttgagtgcaactctgtgccaggcactgggccagatgccggggagagaaagctgaataattcagacattccctctcccattaaggtgctctcaagggtgtggggggaggcaaactgctgatttcaatgaactagactggcgaggtgggagagatgtgagcagcacacaggtgactactacttaccagctttggggatggagtgggggaagaggggcattgtggtttgagaaggcttccgggagaagtaatgtctgagctaaatctaaggagtaattaatatttggccaagagtctgggtaaaattgctcatgcctgtaatctcaacacttcgggaggctgaggtgagcagattgcttgagcctaggagttagagaccagcctgggcaacaacatggcaagaccctgtctctacagaaaatacaaaagttagctgagtgtgatggcggatgcctgtggtcccaggtacttgggaggctgaggcaggaggattgcttgagcccggaagatggaggctgcagtgagttgtgattgtaccactgcactcaaacctgggcaacagagcgagaccctgccttaaaaaaaaaaaaaagaaacaaaaagatttggccaagagcaggagagcaggcccatgaaggtggaagtgagatgtttatcccagcaagggacctgcaagggatgaagctggtggcagcacaaagagcgaggcgtgaggcaggcagcagtgaggcctgcggagcctgggtagtggattgctgctcaggccctgtgagaattctgacttcatcatgatattcctatatgtccagggggggagtcatccgtggcacggcctcatgtgtgattcagaatgtattgtgggagtggcagccccggtgggagaagggaaatgactcaggagagcaggtctggatttcctgctacctgtggctccccttgccagaattctgatataaactaagactataagattagtttcaaaaggttttagagaccttcatgggggctttccaataacaggaagataaggaccgtgaggaacatttctctaactttagacccagaaactaagggctgggaggatgggtggctgcttttttttttttttttttttgagacggaatctttcaccaggctggagtgcagtggcgcgatctcagctcactgcaaccgccgcctcccaggttcaagcgattcttgtgcctcagcctcccaagtagctgggactacaagcacgtgccaccacatccagctaatttttctatttttagtagagacgggatttcatatgttggccaggatggtctcgatcccctgacctcatgatccacccacctcggcctcccaaagtggtgggattacagacatgagccactgtgtccggccagtagctgtttttaccttttccggcatgacctttttctggctactttaatgttccttcccaaaaatgtcttatctttatggtggtggcttttcttgagacgtggcagagtcaggcctgggctggactccttccctgggattcatgtgaaccatggttgaagtctgtgcttcagggctcctccatccttcttagatggcttgagaagagggtgggaaaacagttgaagaagggtcagtgatacaacgttatctttctcgcctctggagataaagtagaaaaaaaagaaatgtcttcggtttgtatttggatacacacatcactcactagctgctgagatccatgatagcatcatgaatatcagcattaaaaggctgctttgaggatcaatagcaatgcttgcactgcatttaaatatctgcaattaaggtcgaagcctgaaaacacgactcctgggaggcccacgagacctgggggaagggacaagttgaaccttagttatatatttcaatgacctagagatcaatatatgccagatcacattttctttcttatctgttctttaaatctcaatcttcacttgggtccacattttcagggtactccatcagcttggtgtttttggtggcagatgcggtgacgccctggctggtagtgtttgaacctggcctaaaggacatctgagtgagagttcaaaagacggaagcatggcggggatatctgtgctgatacacagagggggaaaattggcacgacccctcatgcaaagctgaaaaatgtgggatagatttagtctgacagtgggcgtggagggagattctagcaagtctttaatgtgggatgcagccatctgtcttccagagttatgaaggttgggcatggatacaaagacccttagactttttatttgttcccttcagtagtaatgcttagatgttcttttactgccaaccagagatattatttctttttctttttcttttctttttttttttttgagacggagcttcactctgttgcccaggctggagtgcaatggtgcaatcttggctcactgcaacctctgcctcccaggttcaagcaattctgctgcctcagcctcccgagtagctgggactacaggcatgtgccaccatgcctagctaacttttgtatttttagtagagacggggtttcaccatgttggtcaggctggtctcgaactcctgaattcaggggatccacccacctcagcctcccaaagtgctgggattacaggcgtgtgccactgcctgaaatattctttagtatatttctccctgacacttttctgggcccaagtttatggcagaaactaagccaaggagaaaaagaaagagctgtcaggcatttcattgtcttaattgcggagcacagatattagtgtcagtgagtctctgcgtggtagagctggtggtcagagtggacctaaagccagaaatcacagcatgagccaatgaaactgctgaatatactcagcctcttggtttctccaacttctgaggctgtctctagcacaggtgtcttcatgaggtccctggttgccctctgaaactatgatttgatttcctgcatgttctccttcttgctgccgtccatgaatccgagacctgctttcatggttatcctttctcctgatgtttctctgatcatcataactcttggctgccatgccccactctggcctccctggagcactgtccattcacatgcccaacctgttgaacagaggatccttggtattattgtgagtcattttctgaccccacagccctgctttagagtatttctttttgcctgtcctttgcacgtgctcagtaagtgtttggactgtcagaggtaggtggataggcaaaaatctctgcactcatggtgtttatattctaatggagcagagagacaatacgcaaattgtatattgtacaaaaatgcgacatgttgtcagataagtactaagaaggaaaatatagcagagtaaaaagacagagagtgatatggcacaatttcagagacatttgaaagtggaaagtgttattgatttggaatgaggtctagattcaaatcctgattcccttaccctctaggacaactaacttaacccctatgagcctcagtttccttatccgtaatatgtaaatcatgtttattctttagggttgttagagggtaacaaggattatagtttgagtatggtgcctgaatatgggcgtaatgcatgtgagccttcattgctcttatgagcaccattatttttgtcactataaaatcaagggctcggctgggcacgctggctcacgcctgtaatcccagcactttgggaggctgaggcgggtggatcacaaggtcaggagatcgagaccatcctggttaacacagtgaaaccccgtctctactaaatatacaaaaaaattagctgggcgtggtggcgggtgcctgtagtcccagctacttgggaggctgaggcaggagaatggtgcgaacccaggaggcagagcttgcagtgagctgagatcagtgcctgggtgacagagtgagactctgtctcaaaaaaaaaaaaaaaaaaaaaaaaaatcaagggctctactggtcagctgcattgaacaggctattctttagcttggaatcttccagtgagtttgcaaatatcaagaaatctctctctctctctctcttttttgcatagactatgagcaactcaacttctctagaacaatgtttcttgaactttttggtctcaggacctctcttacactcctaaaagttattgaggaacccaaagagcttctgctcatgaattacagctatactatttactgcattagaaattaaaactgagaaattattaaaatatgcaaacttattaaaattacagtaataaactcattttatgttaacataaataacatattgtttaatgaaaaataactatactttccaaaaacaaaacaaaatttagtgagaagggtaatgtttaacatttttgcaaatttctttaatgtttggcttaatgaaagacaattggattctcatatctgcttctgccttcagtctgttttggtatgttgaaacaaatgaagaaatttagctttacacagatgcataattagaaaaggaagtagtattttaatagccatttcagagaattgtgaatatttctctttgttactatatcaaaaccctacaagcggtactttcttagatgttagttgcagcgcagaatctgatatatgctgtccgcagaagcccaccttaaataaaaagacaaaaatagtatatttttttgtatacagttacattaaaatccattggcctatccttttttcaaggggatatattttaatgtggatcttggaaagatcttttatcctggcattttgtcacagcagttgttttgaaaatattggttccctgagttatgcagatcttccacatgttgacacgttttattatacaataacccccaccccaaaatggctttgttattatcagtaccaaagtcctcagaaaagtctttacattttgcaagttgtcaagttcacaatggtgagcacaagtttttcccaattctaattcttacttaaaaactcacattttatcattggcaacaaatatggtcagttgaagtgatagtctgcccaatacctgtctgttattattaataatttctaatttaattccattgtagtcagagaatatactgataaatgaattcctttttttgtgaattcatttaattcttttaaatttattgagacatattatggctcagaatatatgttggtaaacattctgtgtgcatgtgaaaagaatgtgtatattgctgttagaatgttctacaaatgtcaactaggtcaagttggttgatggtgttgttcaagtcttctacatccttaatgtttttttttttttgagatggatccttgctctgttgcccaggctggagtgcagtggtgcaatctcggcacactgcaagctccgcctcccgggttcacgccattctcctgcctcagcctcccgagtagctgggactacaggcgctcgccaccatgcccagctaattttttttttttttttttttttttttagtagagacagggtttcaccgttgttagccaggatggtcttgatctcctgacctcgtgatccacctgccttggcctcccaaagtgctgggattccttaatgttttatgtttacttgttttattgattattaagggagggatacggaaatctctaattacagttgtagatttgtctatttcttcttgtatttctatcagtttttgcttcatatatgttgaagctctgttgtttcataaacatttgtgactgttatgtcctcatgactaattaacttctctataattaacttctctattatgaaatgactctttttatctgtagtagtattttttgttctgaaatctgctttttgtgatattaacatagccattgcaaatttctttttattagtgttgcaatggtatatcttcttccattcttttagttttaacttatttttgtcttttcatttaaagtgggcttctgtagataacatatagtttggtcttgctgtttaatgcagtcttgcagtctctgtcttttttttcttgagacagactctcactctgtcacccaggctggagtgcagtggtgcaatcttggttcactgcaacctccgcctcccgggttcaagtgattcccctgcctgagcctccagagtagctgggactacaggcgcgtgccaccatgcccagctaatttttttgtattttttagtagagacggggtttcactgtgttagccaggatggtgttgatctcctgaccttgtgatctgcccaccttggcctcctgaagtgctgggattataggcatgagtcaccacgcccagccaatctctgtcttttatttgaagtagttagaccacttatatttaatgcaattatcaatatggttaagtttctatttgttttctgtttccccatctgttgtttgtcccccttttctcttatttatttatttatttatttatttttgagatggagtcctgctctgttgcctgggctgaagtgcagtggcatgatcttggctcactgcaacctgtatctcctgggttcaagaaattttcctccctcagcctcctgagtagctggtattacaggcacccaccaccatgtctagctaatttttgcatttttagtagagacagggtttcaccatttgaccaggctggccttgaactcctgatctcaagaaatccacctgcctcggcctcccagagtgctgggattataggcgtgagccactgcacccggccccttttctctttttctgccttcttttggattaactgaacatttttttatcattccattttatctcttttgttggctggcttatctataaatctttgttattttactgcttgttttagagtttttagcgtccatctttgacttatcatagtccactttcaggtgatgttataccacttcatgtatagtataagaaccttattatagtataatttcatttcttcctccccatctttttttaaattcttctcataccttttacttatagatttgttataaaccctgtgatttattattttgctttaagtagttgtttatctttttaatagatttaaggaataaaaagtctttatatatacccacatctctaccatttccagtgctcttcatttctttgtgtagatccagatttccatctgctatttttttcccttctgcctgaatgagttgctttaatatttcttgtagtgcatgtctgctggtcatgaattctttcagtttttgtatctataaaaaagtatttcacttttgtttttgaaagatattttcaatggataaagaattctaggttgatagtttttgttttttctcttagcactttaaagaagtttctctatgtcttctggcttgctagcataatttctgatgagaagtctgcagttattcatatctttgtttttctctgtacaatgcatccatttcctgtggctgcttttaggattttttctttatcactggagttaatcaagatgattatgatgtgccgtggtgtagttttcttatgtttctggtgcttggggctcgttgagctacttggatatgtggatttatagttttatcaaatttggaaaattttggctgttagtttttctatttgtttctgtcccatcttctgcatagggaacttttacatatattagactgcttaaagttgttgcagatactctattcagttttttctttttcctgtttcatttcctgtctttcagttcactaatattttctttagtggtgtctaattgtctgttaattacacccagtgtgtttttcacctcagactgcatcttaggttttcactgcagtttgcatctttagaagttttacttggatctgtttaattctcccatatctctttttaatgtttaatcttcatacccactaattttatcagtgtataatttctggtttggttgtgattgatttttcttcttattatgaatcatattttcctgcttctttgtatgcctgggaattttgtctttgattccagacattatgaatttatcatattgggtactgtgtacatgtttattcttgtaaatattcttttttttttttttttttttttgatacagagtctcactctgttgcccaggctggagtgctgtggcggtgatctcggctcactgcaacctccgcctcccgggttcaagcgattctcctgcctcagcctcctgagtagctgggatcacaggtgtatgccaccatgtctggctaatttttgtattttcagtagagacggggttttaccatgttggccaggctggtctcaaacgcctgaccccaagtgatccaccccctttggcctcccaaagtgctgggattacaggcatgagccaccgtgcccagcctattcttataaatattcttgagcattgttctggaatgtggttacattatttggaattagtttaaccctttcacatttcgcttttatgcttttttaggtgggtacagaacatcattgagttcagggctgattttttttacccactactgaggtaaaactctactgagtactctcccctatgccccatatattatgaagattttactcttgttagcggaaacaggcactatttctggtccaagtgtgagtgacagtgattgttgttttgtttatttgtttgtttgagacagagtctcgctctgttgcccaggctggagtgcagtggtgcgatcttggctcactgcaacctccacctcccaggtttgagcaattctctgcctcagcctcccaagtagctgggattacaggtgcccaccaccacagccagttaatttttgtatttttagcagagggggctttcaccatcttggccgggctggtcttgaacacctgaccttgtgatccacccgcctcggcctcccaaagtgttgagattaccggcgtgagccacgtgcccagccgattgttgtttttaatcctgttaaaaggtgttacaaggcctgagatagtttcctcatacacgtgcactgatccatgtctatttgactacttgaagcagcctctgcacagctctggagttctctgtgtgtctttttccaacactctgccctgtgacctctggctgccttggccttcttacattcttagttccttctcaactcaggaagattgctcgacttaggatgccctcctgtgccatggtttggaaactctatagcaagaaagctggggcagtcccggggctgacctcgccgttcttcactcccagatgtctgatatctagagaactgatgtttcataaatgttgtcgttttttagttattttaagcaggagaggacctctagtccttcttactccatcttggccagaggcagaagccctgccaaatacctgcatctaaagaaccatagttttaaaaaaaatcagttgttttttttaaaataaaaattggcattccatgaaaaaagttgctcatttagcttgtaactcagtcacacaaatgcttttcttcaagacaaccatcatactttagattgcagcagaagtgttttaaaagcacattagaagtgatggtaaagaccacagttacttttgcaccaacctaaagaataaaagctgtcatttttggctggaggcggtggctcatacctgtaattccagcactttgggaggctgaggcaggtggatcacctgaggtcaggagtttgagaccacctcatcaacatggtaaaaccccatctctactaaatgcaaaaaataagccgggtgtggtggcacgcgcctgtaatctcagctacttgggaggctgaggcaggagaatcatttgaacctggaaggcagaggttgcagtgagccgagattgcgccattgcactccagcctgggcaacaagagcgaaactcggtctcaaaaaaaaaaaaatcttattttgattgcttcattaaggaattctaaagtaaaactggcaaagcgtgtgtgcatgtgtgtgtgtttttctgtaagcacatggcaatgaagaatatgtgattaccagtacagttggttgctactaccttgatttgtggtgaggccccagcagttttacccacggttgcttttgctccagcagtgcaaatgccaatacagtgaaaaaggcaaatcaattcttggtgttttacaaaaatggttctgacctctctgtctcccaaaaggatctcttaaggatgcccgaagggtctgcagaccatatttggagaactgctactctacagacagccttgtatctgtgtacagagacatgagcaagaatgttctgtgttaacaacgtttacactaatagaaattcggaaacaatttaaagttcatcagtagtagaaggggcaaataaattgcagtattcttatataatgaaatagtatatagcagttgaaatgaataagctaaggctgtgtgtatatatgtataaagatcaaaattcagtggggaaaaaaacaagttgcaaaaagaaatgtacagcacggtaccatttatataagcttaaaacgtaaaaaatatttgttgtttatggacgcctacgtatatagtaaataaaaactaaatggaagatagcagctgcctctgagagggagggaggagaatgagatgggcaggtacagagtagctgcagttatatctgtaattcttttttatttctaaaaaataaattggaggatatctagtgaatttttatgacagaaaatacgattggttggcacgcaggtttttattagattatcctctataggttttggaaagcttgaagtcttccataatcatcatcatcatcactgagaaatagagaagaagagagaatgtgtgaacacatgatggattctcagttctacgtgaaaactgctaaatgaatactagttggcgagcccaccacgattattatcatagtgctaacagctgccattatggagagggtgcgatcagccagggacctcacctagtttcatattcagctttattatcacctatgaagtaggacttacgatcctaattccacaacagagacgactagcattcagaaaggttaagttacatgctgatgtcatgcagtgagtcagttatgaagtcatgattggaaactaggccttttgggttcaaggtttgtgctttttccattccgctaacatctgaggtgattggcttgttatctgaagttactctgtttttatttctctttcagctcttcttccaaacctattttcgggcatagtttgttacgtttctgctaagcgagttggctctatcaattacagtatttttgttgccacagcaacaataatgcagccatattattaggtatcactactgttttgttctgctgtgagcttcagccaggcaggtgccctgctatttgcagaggtctctcttcgtggctgtggctttcttgtcttcggggttaattgcgtggaggctgtgtttcagtgaggccttggaagttcggggctggtactacagcctgctataggaagacttcttcatcggttttataatgggatcatttataatgtcttagatagtaaaacaaaagaaccttttgagtttgttgatgataatatcctacggacacatcaagcattgtctaaagatttacttgaactaattgagtagatgatggaaagagagacgatacacttgctcatttgtttagttctttctacttgcagctgtctgataaagaaaaacggaggtagaatgcttgagattgcatgaatgcttctgggaggatgggttgggatttacagagtttaaaaacagaagtttgagagtttcataggcatgtttacctgccagcatcactgcagaaccaggaggggtgcgtgaggcagagaggcaggcggaggagcagggagaggatcccacttgaggtggcacgttggcctttccctgtgctccggctggaatcaacgaggcatttgttccctgcccagccccaatctgtgctgctttctctctctgctgggttcttcgcattgggctttatgctacttcgaaaaatggacagtgttttcgttaagttttagataaatttaaaaacaggccgggcgcggtggctcacgcctgtaatcccagcactttggaaggccgaggcaggcggatcatgaggtcaggagatcgagactatcctggctaacacggtgaaaccctgtctctactaaaaatataaaaactagccgggcatggtggcaggtgcctgtaatcctagctactcaggaggctgaggcagtagaatggcatgaacccgggaggcggagcttgcagtgagccaagatcgcaccactgcactccagcctgggcaacagagcgagactccatatcaaaaaaaaaaaaatgcagctttgggaaacagtaactgacacacactgttactaggaatatatatattggtttgatctttattttttttttttttgccatattttaaacacaatggttaaaattactggcttcggagtgaaattgctattttccagctgtaagaccttgggcaagttacttaacctctcgaggcctcagtttcctcaactataaaatgaggctacgttagtgcctacttaatgaagttctcgtgaggagtttacaatacatgaaaagtgcttacaggagtgtctgcacagagtaaatgtgcagtgggtgttgctgttattattatatattaaaagtcaaagtgttgattttctttaagtcaaattcatatttagaaatttttcctataaaaatgtgatcatgagcattcaaaggcatatttacatgcatattcattgtggcattgtttgtcattgcaaagtaacctaaatgtccaccagtggggacatcatggtgcacccataaaatggaatcttgtgtagtggttaaaaaggatacagagatcaatgccatatattaagtgaaaaaattagtttttctgccatttcaatttaaagatttcaaacgtatttcaaaaatataacaaaattgaaagagttttgcaatgaaacccataaacccaccaagtagcgcctgtggctagcatttcattttacctgccttatcaatattcacccttctgttttcatccatccatcttgatattttgattcatttcaggaaggttgtacacatcaatacactttctcccaaatatttcaacaggtaggaatatcattcattagagttcacagtttgttcatatttcttttgaaacattagtttttataacaatacagatattgtatgtacccatttatataaataacaaaggctgggcgtggtggctcacgcctgtaatcccagcactttgggaggccgaggtgggcagatcacttgaggtcaggagttcgagaccagtatggccaacatggtgaaaccctgtctctaccaaaaatacaaaaattagccggtcatagtggcaggcgcctgtaatcccagctactcaggagactgaggcaggagaattgtttcaacctgggaggtggaggttgcagtgagccgagatcctgccactgcactccagcctgggtgacagagcaagactctgtctcaaaaataaaaaataaaataaaataaataaataacaaagatgtttctatatgccaagggtcatagcaaaccacttctggtggtaatttgctggaacagggttactgagcaatgtgacttttactttatgctttatatacttctgtgtgaattacgccatttaatatactgttggagtgtggcgtcatggctgccaccttcccacttttcttcctcctcctcctcctcccttcttttttactatcatcatcatcaaacctagttatacaaagctttgcttcccttgcaaagctacaaaatgcccaggcaacccttgtaattcttgaagcacaggggacagaaatggagcattctttggattagagagacttgtgttgtccttaattaagtctggggtcctttctgataccttggtttgaggactctgaattaaaattaatagcgcttcctttcacatctgaaccattgtccaagagcctccctcattttagtgagatattgaaaaacaaatggagatatttggaagacgtgtaggtatgtggggcgatttatctcaaggggcgttctattctgtgaaatgctcgaagctaattggcatgtggctaatgggaatcgctttaaagtctgaaaccaaagttctaaaaggcagaaagatgaggcgcttagatttgttgcaattaggtatccaagcacctaaacccacttgataattttctcttcatttctgtgggctgtggagtgtgggaggaaaatgggtaacctataggggagtgggagtgtgagtacagacttacatataatttactttcctggaaagatatagacaagtcatttcaattgccttttttctgggggcgtgtaccctacagattctgcttggagttggttggagtccattagaagtggcaaaacatttttttttttttatggaggaattcaggaacttttagagctttgcagtgcatattttaaaatatgttaagtgctatcagaaggcttggatacttcaatcttctttaaataaatggattttacaattgcaaagtggcgacttttctttttttgggtggcaactcaccacagccccacctttcaagtgaaattttagacacgctaactgtgatttttttttttttttggcttttagcattttggaataaagtcgaaagtttcaaaagctgccagcatatttcaatttaatctgctgctgtgttgtctcttgatagcgtaatgccagggctacagagatgttttcacgatgtaaataatttgtgtactgtaagttgtctaaacacggcatgcgtgtgatccggtgcaatcagattgcttggatatggctttacgtgacggactgtaatggttgcttcggagtcattagagcctagtatgtaaataatccacattttaaaattgtcttaaatgtgcttagacaatggatgaatgcctcctctggattcattaattccatcaagaattcacagttcacagcacctgaaggcatcagcctgcttcttcccaaatgagctcttggcactgtcagcttgcccgtctcccaggtgtacccgtaagcagggagtcaggggtcatcttttcaccttgacatgtgcaaggtcatgaccacagccaggtacaatacagaataaaaccctgacctaggactttctgccttggccatggatctccctctttttttttttttttttaaagacagagtctcactctgcggtccaggctggcgtgtgcaatggcgcgatcttggctcactgcagcctctgcctccctggttgaagcgattcccctgcctcagcctctcgagtagctgggaccacagatgtgcaccaccatacccagctaatctttgtttttagtagagactgggtttcaccatgttggccaggatggtctcgatctcttgacctcatgatctgcccgcctcagcctcccaaagtgctgggattacaggcatgagccatggtgcctggccctccctctgttttttaagacaggtgcgtgtgggcgcaggaggcggagggcccttatgctgccctggcattttggaggagcagggaaatgagataaagctgcaaaatgactccctaaaagttggccccaagccagtgcgggcgacggtgtcagccacccttggttcattttctacacgaggccccacacggccccggagctggagcttctaccgaagggttgccctctgtccccttctcggcttcctctgcagaggggctcagagccagtccagtcagacctgcgaggcctgggctgtggctgctgtggctttgccagcatctattgtctaagagggctggggaagctcactgtttgaaacacacacacacaacagaacataaatcagaggcagaatcttttaacatttacagttttaagtgaaattcctgttgagagtctcttaagctagatttatatctgattttgcattgaactgtgtcgttatgtggggctgagaaactcttacgaaattaagcataatgcgaaaacatgctgaaaagacagttctgtagaaatgtgaaacattattatgttatagaatattggagtgaagaaatacgcataaaggcacaattaccatggacattttccttttaatgatccttgtacaatccttggcagaaaggtttgctgacgtctcctcgtagataaaggaaaattgagacgatattgatattctacatccgttttgaattccaaagaatatcaggagagcgaaccagtctgtcttcatattcaaaacagcaaggcctagactatctcgataccttgggaggatctgtcattagtgtttggggatttgactgaagcctccacactatggacagaccaagtggtggcaataatgtgtgcaggggttaacgtctgaatgctctgatctggaagcttctagaagctcctagaatgggttgaggttgttggatgcttgtccctggagagtttttagggtttaaagcatctgtctagaatgtcttgagagtgtccttggggatagggtgatagaggtgcttgcttgtgctaaggtttgttccaggataccctgttcagctttgttttccacaggagaattcccctcctccagcctctgacttctgctgccctggcttagggctaaggggatattgatcatggcccctgggattttatctttcctttcagtctccagaatgactcccaaagcagatgctgcttctcttgcctcctcgtcccccttccctgggctgccctggcaccatagcctgggtacccagtgtaccatggagtgtgggcagaaacgctgtttcttcctcttgttcctggccgaccttcttctcttggctgggacttgtgattccagtggggggaaaggagcccagtttccctgcctctccctgttcagccctggagcagctggagcagggctggtggtggcgctgagatcgcaagccttccagaaacccttcctccccctgagctcatggcaggtcccctggcagggggaaagcttttgctaaaaacctccctgagcccgtgccctctaagcctggcattgagatgccaccagctggtcgggggagggggagcagcagccgagatgccgccccaggttggagcgcggaggcctttcgcatttgctctggaagcatcatctgagaagccctagcgggttttgctcagggtcaggtgacagccagtctcctcccttcagtagggctggcagcagctcccgactcacagttccttctcttctgctcttctcagaacctcttaaaggacctctaggcgtttgttacctagagttgcttgaaattaagctatttaattctaatttggctgtgcaatatctgattcttgaccaccagaggtcactgtaataaggtagaaagcaggtgtttctgagagtcttcaatgtgtggttgcctcaagaaaacaaaatgaaatcaaccaaaccaccccccaagtttcttcactggcctgggtgtgctgcagtgtgctctggggcatggacacgcagccccagctttctcacttgtggaaggtctgcccagctgtggagcctggcaggacgggacaggtggccacttagggaacatttgactgccaaggccgctggcacaggcctctgggcaggcttgctttcataggatggtgggtgcatcggggcctcactcagaggcaggggccctcctctttcccccaccctacgctcaccctgagctgcattctcaaagtccatttctggcagcaacctggggttagattttcttaggttaattaggcttgtctgccttacctttctgtgtgtgcacttgagtgtgtgcatgtctctgtgtgtgtgtgtgtgcacgtgcctgctccgtcaggtggggtcagtaatagtgctgtccacctacagctatttggtgttaaaaggagatggtgcatgatgtcgggtgcttaaaagcacagggcttgttttccagctagtgtccgggaaatgtgagccatcaaaattctcatccagaggctcggcggaaaacatttaccccgttgcagaatggcttcgactctttctcagacccacccttcctgtcctctttggttggtcatcttccttatatggtgacgtttttcagtagaacgtaagaaacgcctgcctttattagcagtggctcctgaaggttggttccagggaagctgttttcgtcttcggtgggtggctcacgggagaacattagggccttgggggtgcagtttggcaggctttgcatttagcaaatactcgggccctcaggctagagcttttgtgagactgctcacgcactggtttctcttccagctctaaatccccgagttgccggaacacagagaaattagagatgcatgtgatctccgcagggggccaggcagccaggggagagggtggttctggatgcaggagctcacattcctcactgggaacatttggaggatataggtctaggggagggtgactgtattacctggatcctccagagggccattagggctgccagcggaggtcaggagcagtgatctacgggagatgctgccgccatccccttcagtgggaatttctcctggatgtctctgcagaaggcacgtgggtgtcacatatgcacacacatgcatgcacagcgcatggctggggctgcagagcaggcgccccagtgtcatggaccctgtggccacagctgctgggcctgttcacacacggttgggactggccaagggtctcacccagactagacgggaatgggggagacccagagagacgcagagcagtgccgctggggaccccggggactcagagcagtgccgctggggaccctggggactcacagcagtactgctggggacgccgaggacgcagagccgtgccactggggaccccgggaaagcagggcagtgccactgggacccagatcatgcccctctgcatgtaaccgatggcacaaacaccaggccttcagcagggccataagcatctgaggctaggaaggcacatgcgtgattagcagatgggtgatggggcctctagcgggcagattctgtggtggcgctgaaacaggagacgtcctctccgaccttggagacctggcatttggagcctgaatgagccagagacaggaagcctgtccctcccctctctgggcgaccttccgaggaggcatcagctcttcccttgctttggggagggaacttaccctgcgtgcagtcctcctgcccccctgcctggcgcatctttccccctcacgtcctctcccccactccctcctcttcccgcctgtggttttctttcccattcctgtctgccagcagtgcctcctctccccattaacatcccgccattttgattaaaaaaaaaaatcccccaaaataaaaactcatacttgtttctatgggcttcctatgtttctttggaagcagcctcttcataaacccagtgaataaatctcttcaattgttgagactcctgtaagagagtctggtgaagtatagcttgtacctgaacactgcgcaaatgagtctatcctgtttttaatcatgggccagaactaagctaatgttttatgtgcttctcttttaaaatcctcctaaggaccccgagaagccagcactaatatcatccccacgttttagacgcaaagcagttcaaagtgtttaaaagataacttggtggtggtcacccagcgaaaggtggcagaacccaaaagcttgctccttatccactgtgacttggcctccagggatgagaccaacctctcctggaagggcattgctgttgctagccacacctgcccgtctggccccctcctgctgtagttggaagcatctttcctgttcattctgtcctcagctgaaatagcaaacagctggtcaccatccggcaccaaatacccccaatacctgagactgcatgtctgactagtcattaatttgtaccccccagcaggccaacctcaaactctttaaactttatatatatctacatttgaaagattatttttattccattagagccgttacatccttattgtagatgcccttagcaagaagggtttctggaaggggaggccctagaaggtgactatcggtactgaatcctggttcttttgattccagatatgaaattggcttttagagcacattgtgctgattaagcccaaataacaccacatgagtagattttaaaagtctcctcttgaagacgtcctctagcatctgttgttggattgtgtggctgatacgggcttggagttaagcacatccttcctcgatactagttctctctttccattaaaaaatgcaaatgcagaggcctcgaatgtgcccgatttagatgttttgatatggaaaggtaatgttaataagggcatttggcagtgatgcactgaagaaaataaaacagacgcatggtttaggttctgctgttccttcccaaactgcttttccaggcatccaaaacccagctcttctgaaagggcctgggattctccagtgggtgccttggttgggaggggaccccttcatgagaatctccctcttctctgacctctctcagtagaagtgcacagaaagtctgatctcagatctgcctctgcatattaatagcaatattatgtttaaattgaaaatttcatttttcctgcctggtgtgcaggcaaataattgagacctaatttactttatttaataagctagtagccaatgtagttaagcccacactgataaaaacttggagggcatttgttgacaacctcccacatttttctggctggcttggttggacctggaacagcaggaggccaggataccagagcctcccaagtcccagagaactcccaaagggtctcccagctgccggaggcttccagagggagggagtgccacatgggagctgtccgtggttcttgtggctgaaattggcagggctccatggtgctcactggcaagggctgcagcagcctggggctgccgtctgtgttccatcccggatgcagctgatgtgctcactctgcagacatttcttagtgcctaactctgctggccaggtgaacaaggccctgtttttcccttgaagatctcatggttcagtgggagagacagtgggagagaggagaaagtgactaactccacttaggaatgtgtgtggtttaggggcaagagtgtgagttttggactcatgttcttaaatgctgacctcaataaatatgtttaaattctttgagccttgatttttcttatctgtaaaaatgcaagtacagatagtagagcttttcttccagcttgttaaaaggagaaactataaaacctaatgtgaaatgctgccatggagcagtgaccatcacaactgctgccggagtagacatgggagatagccttagcactgagagttgatatttctgtttttcctcctgggtgcccatggtggaactcttcctccctgccccctttgaagttaggagtggttgtacaactgactttggctcatgcagggtgagcagaagtgacatgtgtggtttgctatgtgcccttctcctgactcagtaatcagggctgcttgtgctgaggtggaggctccagcagcctggatccctgagtgactacatggagtggagtctcctcccccacaacatgcaggggatgtgtggtgtgaacaagtggctttttgttgaagccactgaactgttagggtcaattgttattgttactgcagtataacatcttgtcctgactaaaggttcaggaggatagattttctcccttcggtgagaaggagggtactccacagacaaggttacacttcagcacagtcttaaatcaggactctgcattctctagatgcaggaggggataagggaattccagatggaggaactggcacacgcaggacctgaaggataaggtctctggctgtcaagtagatttacatttctccattgtccctcctctcttccgcttacctttctttctctcttctccattcctgtccccacccttcttcagcttcctccctttcattctcttttcttgccaggtgtcctgaggctctgagtgaccctagaagttgccctttaactggccagtgtctccaaagtggttgcatgtctcgaagctctttgcggcctcatttcctcctgctcattggttggctttggctttctctctctctctctctcttttttttttttttttggaggttactaggattagagattgaagctgataagtgcagcttctccacttggtgggtggtgatggtggtggagcgtcatccgagcaggggatatgcctggatgtcatccacccaggctgaatgccttcccagcaacagagctctgtgacttggggtgggttctgtataaaccctgaagcttctatcaccaggtgactttttctagtattcattgacaaagaagagattttaggacatctctcaccctaccccctagctgattccctgtttagccagttggtgaagtctaggctgagtcattctgagagcagaggaagcccttggtcataatggtgcagcctgtctggccaggcgaggggaggggggtggtcatggaggatttcagcggggagggtggaggcttcctggacttgtggggatcaagattttctcttttgctggctggctggccctagagctgtgctttattaagatcatttgaatattatggctttaggaacagaacctattaataattgtgacaaggagaaattgtagagcgtggaaaaaaggggaaaaagagtcactccaaggtaaaataaaccaccacaattggaaagtccaggtaactaccagagtgagacaaatactacctagagagtcacagtgggagccatttgaaaaacaaagtacaattaaaagtttaatttttgatggaattagtaaattaaaagtttcaggaatgggtcttctcaggagaggggagcgtctgctgttggctttggtgtggctacgccagctgggccctaatctcagcctttgcccggagagattctgcagcacctgccgagtgagcagtcatcccatttgagctctgtaagagatccagcgttcctctgggagtgtcctgagcacgcccaccaccacctgtccctgagccttcccttgcaacagtcttgccttcctttcattctcttctcagctggtcttgagtccgaagtgagcggcttcctttgtcgcttgggagctgcagcttgcaccgcactcaggtgtaaggacctgcaggtgtgtgcagacacagtctgtgtgttcctcagaaggaatgaccacttgaagcagagctttgtgacgaggccttccccaagtgcatctgagaacgttcacaggacttctgagactctaagatgagccgtcaacctgtgttgcaaatctcctccagctttaggaattagtttaaaattaaacttacagacaggccaaatctccccagactcaggccgacttaggaaagtacaatgcgtggcttcattttaacaagtagttccctgatacggtacatgaggaaaatgctgctgaacgtcagctagttaacttgaggacccagcatcagccattctccggactgcgagctcagcttgtttcaagtctgggggttcatgtacgaactacaggctggttctggggtctcagcctaagctgaagatccggcggggaccaatatggacaaagcatagaggaaactgcccagtcagaaaggcagtgagccagaagccaagatgttccttaggaacacccagggagggggcagcgtcaaggccagggggtgcagggcctgccagctcacctgtctcccaccttcacgtacatcctctattctgggaaagtgtgatcgatcctgctatgcatattgttgcattccatcttcattttgtgtctcttgattgttggggttttttgtttgtttgtttttttgttttgagatggagtctcgctctgttgcccaggctggagtatagtggcacaatctctactaactgcaacctctgcctcccgggtgcaagcgattcttctgactcagcctcctgagtagctgggattataggggcccaccaccacacccagctaatttttgtatttttactagagatgaggtttcatcatggtggctaggctggtctcgaactcttgacctcaggtggatccacccgccttggcctcccaaagtgctgggatcccaaagtgcaagagattacatgcctggctctcttggttttaaagaaacagcagctattaagttcagatgcttttctaagtgtttattcatcccatgacttagtgtgtgtcaggcactgtcctggacactaggatgtggtggttaaagcagcccagagtctctgccttcaaggagctgatgttctggtgggaggagggcatcgggggatcctcagtgaggagtaaatgtcacgagcccagtgggaaagtgaaggagggaatggggtccagcgggggaagggaatcccagggacatctgggcaaagacgttcccaggaggggactgcaagcgcggtgtccttggggcgggattgcactgggagtgtttgaaggtcagccgggagactgcgaggcaggagctggtggagagaggacgtggaaggaggtgaggccggggaagtgaccggcagggccacggaggactcaggcggctgttcccggcctgcaccctggtcctccatggtggtgaagggctgggggtaggaccacagcctccttgtcttgccttcctggggagatggggcaggaagagagtctgtagataataagctgcctgcaccctgagctactccagagacggcatctgtctgctccggggccagggcggagaagcctgaagctgagtccctggggtgcagggcccacactctggctgctcattgccactctgggtcccgaccgggtgtgggttcagatgaagactctcaaacaggccttggctgcatcaaacacatcgcgggggtgtggagtctagggctgaagtcacggggtagacttcagacttctgcaaacgtcacctggcagtgcccagttgagatatctgtctcggcagtaccaggctatttgaacatgtctttgtaggtttatcaccaaggtagaagagttcattgtctatttcttaggtgagggactccaatttgtggaggcaatggtgggggtagggtgggtggaggagagagtatggtggggaggggaaggagccccagggggccttggcctccacgagtttctagtccttgtcagggtgaggcaggcggagaagaggggactctgggaaggagaaatgggaacatcacactggggtatttatgggagccgtgcacaggagcgctggccattcgtcttgaggccccactgcagggagcagcgctggaagcccggccctctgtactgtgtgttcccaggcacagggagaatgactgtgctgcctctttccggggtgtaatttgagtttgcatgtggaacgaggccctggcccctaagtcagcccctttatgttttggtcgtgattggtgaggcgctgcggcaaggtgcccacgtccctctggtgatctggagacacggtgaacaatgtcgacattgaatatgttgccaggagtgcttagcggaaggttgatacagcacctcgggtctgaacgttctctcccagtgcttatgagctgaaaatctcagaattgaggcaggcaatttctgagttcattcagaacgcagtgagctgtttgggagatggccacgtgcagaggcagacggcagctgacgcaggcttctccggtgacacagtgaccgttcagccccaagagaaggcagtagggagattacctaccgctactgcagactccttcccaggcagacacttccagacccactcttcgctacatcctggagctgcgtggggtgggcaggtggggctgcacggacggagacctctggttcctcttggccctttggcctcccgctacccagcgctgtgagtggggtcttccagtgggtcctgattgccaggtcttgagctgcttcaggtgcccccagcctgggtgtccgaggttgctgatgcacttgggggctcagttgctgttggtgctttgatagactgtcccttctgaggaaacatccctgccaggacagactcatccctgtttgccaggacagactcatccctgtttgccaggacagactcaggaccagcctgtgacagaggctgctccctctggattgtattcattcgaataggtggtcccgttaaacccaagatggtgctctgtggtgtcccagtctacccttgcccctggactccagttcctgtagggctctgtacgccccctctcctgaccctcccaccccagctcctggaacattctgtgtttccttgggaacctgctgcacttagcaaagccccctctccgcagcctcccccttcttccgctcaggggctctggctctgccgtggggacactgctgcccttcagccctttcaagtggaggctgtgttctcctctcggcctgagtgttactgggccttggcatggggcgggggggtgggtatccttggtccccagggccacttctagttcactgtccccccttgtccttgagtctgcatcttcggctgcttcacgccccactgctgcttgtggggccacccttgggccctggggccattcttttttgctccctgatggtcgctggcgggttcttgtccagccctctcctgtgttgtggtgtttcgtgtcgttctctccgacgacaccttggtttctcagttcctgggctttctcccctctaaagacctccttgttcagcgactcatccctaggccctgggtctgttctctgtggcttcctgctttaccatctcaggttccagaagcccattcagactacctggccttctctgcccactcctcccagtgtctacagtccagccacgcctcaacaccagaatccagggaccctcggtgtctttgtgctgccccagccattcctggtctcacaccctccccgactcagctcagattccacaggtccctcctcgcccacgtgccttctgcatcgggcccctttcccctcgctcacatgaccaggtgcgtggctcgtccagctctactcatacctggttctcctcttgggctgtgcccacacccgcccagtacctggttctcctcctgagctgtgcccacacctgcccagcagcctgactggccttcagttcccagcaccagcatcaagtgcccccttggctctgtctgattctcctccgtgctgtccctcgaccctcctccgtgctgtcaatccatccctgtctggctctctggtctcttgggccgggccgtcccctcttatccctcctccaccctgctcccctccccgcactcctcgcagctgctgacctgctttccatcgcccagagcagaggagacaggggcagtcagaacaacactgacactgccctggcttccccctgccagcctcgcccggccactctgctgagggaatgggaaagagcggacacagccatgcaggggaggagggagctcgtgggggcggctggagggatggaccctcatgctccttgccaagggcaactcttcactcatgaacttgaccctgtccctttggccagttccaagtgtttgccgccgcagcgtcccttccctctcctgcggtggcagcttcttttccttccttcctggttctttcccatcagtgtctgcgtatgctcccatcgcgactcacttccctccagttctgtttctagtttttccttcacagcagagcttcatcgaagctctatgcccaccatcattagttccgctgtcttctcgcggcgaggtgtgatgcgggagcgtggcagccccctctctggtctcctgcatcactcctgcctctgcgcccttgctctagaaccttctccacgtggccacccaagaggccttgttagaatgagcgtcagatcatggcacgtctttgctcaaagcctttcagggcccccttctcactcaggatagatgctgaagtcctcactgtgacaggatctgcacccccacccgccagggcccctctgagcccatccccttccccttcctccctcactccactctggggacacaggcatcttggccacttctcgaagcagggcctttgcccttgctggtcttgcctgcaatgcccttccccaggtatctgcctggctccctctcactcccatagaaaggaatttttaggttttactgtgtccccagcgcccatagcagggcctgggacctggtggttggttgctcagcatgtctctgtgaatgaatgagtgaatgaatgctgcgtggaatctggagtcttcctggtgggagacagcccttaaagcagtatccctggcgctgtctcctcctctgttagccttacccatcctggcctgcccttgcccattttggggacttgctgctcctgctgcctctgctgcacatgtgtcctgggctggggggtccctgtgggtaaccctgtcaccacttagcacagaccatcgtcctcactgccagcccagcctctgacttaattaccactggaacttgggttgcacaaacaggggtcccctgggcctgcccacttgatttcctgctgggagaccagcaggggctgttcttaccctaagtttagctgggatgtggggagtggtggcttccctgctggcccatggacaactctccttggggacagctcatgtcctcccccacaaggaaggaaggagaagagaggccaggccgcctctgcatgtctgggtttctatgacgagaagcagcctcctgggtctttctgagcttgagaagcactgatgggtgaattcaggcttcattcctgctggtgcacatcatgcacatcttcgcctttttttgattctctatttttctctttcatttttgcatggctcagtggaagcagctaatgggggttcagcagcaagttctctcctcttaaagatgggctgagcctgacctgcagttgcttgaacaactggacaagccctggtggggctgtgcatgccggtggtgagggggtcgtacaggagagttttcagaagggatgcctcctggcagagagcgactgaggggaacaggcagtagcgtgaccttggagtcgggctgtgccacacttgagttacacggacaccacttccggctctgtgacccgggagagcagcctctggccttcagtgttctcatctgcagtatgggatggtatatgagtccactctcgcactgctttaaagaaataccctagactggtaatttataaatacaagaagtttaattggctcacagtttggcaggctggacaggaagcatagtgccggcatctgctcagcttctggggaggcctcaggaaacttacaatcatagcagaagatgaaggggaagtaggctggtcttccgtggctggggcaggagcaagagagagagtggggaggtgccacacactttaaacaaccagatcttgcgaaactcactcgctgtcacaagagcagcaccgaggggatgccactaacccattcacgagaaccctacccccatgatccagtcacctcctaccagaccccacctctaacaccagggataacaatttgacatgaaatttgggtggagacacagatccaaaccatatcagatagtaatagcacctagcttgttcagttgttaggagattaatgagaatgtgtgaccagcacatagtattaactggtagctcttactaaattaaggaaagccccagaattaagaaccagagccttccctttacagcagtgttgagcatctgtgcacagcacctccaagtcctgggttggtttggctctacctctcagtggctccagcctgacttagcatccctgagtccccagttcttcctgcaaggaaagggggctgtcctcaggaacagatgaaagaacacacaaaagagactccctgaactctaacacacaatacacgtgttagactgttgttacctattcttattgatttcatcagcaagcattcactgtgtcccttctgtgccggatgccatgggaagtgacagtggcctggatggagacctggcctcgaggtgggtcacctgagtgtcctgtgataccttcacctgggtggcttggcccttatcaggaggctgcggcagcatcacagtgggaggccctctgtctcccgccagtgggccccagtccgtttgctcactattttctatcccggagtttacctgcccaggcacactgggggcccaggccacgttctcccctccctgccatgagtcttgatgaagtacttcagggctcagcaaattttggtcagaggtgcccttctgcagagccctctgagttacagcgagtcccctgccccttcctctgcacaaggagggctggtcagaggtacccctctggggagtcctctgagttacagcgagtcacctgccccttcctctgcacaaggagggctgtgtcttcctctcacctgaagatcctgtgccttttgctcttctctgcacgactcatgtggggcctgggattctcactacactcgatatgggtgggagatgaacttataatcagaaggacacagagctggtccccggggccagaggctaggagtgacagctcaggtgatgtgggttacacagctttaggctcagtcctcatctggagtcagccaagaaaatcgcatttcacacacatgcacagttttatggcctcttttgatgtttccttggtggttttgaatatttaaatttatattttcaataatttatttttaacccctcaagtaactgaacctgccacgagaagatgcagcccccaggtgggaagggggctcatgagctgacccatcaggctgaggccttgtgggatcacctgagaggcgttttggagtaatttcctctccatctctttttattttaaaaaataaaaaatgtactctgttaaaacagtgacataagacaaatggtacagaatgccagctgtgaggattcattgatggatgaatttaacccatgtttatggagtgtcatgtctttggtgctgggaaaaacagagagggtgacttagtctccctcctcaagggaggagctcagagtcaggggatggggaggcagacccccgagggactcccagagcccacccttggaaaggagagatgagttggtggtggggggtgggtgccaggagccttgggagatggggcctgcactgctgggaaagtaccgaagcttgtgatctttcaaaggagttttgacaggtgaccagacacagatagatggtgtctttccctcccaaagctataggggccatgagagccgatcgtctcatctctgggtggttccgctgggacacccctcagaagactcttggttatgaaccccagtgtcagcatcccccgcactcatggttcactggttcttccctagaccatgacctcttctcctcctgtctgcatggcatagggccaggcacttcccacctgcatggcttagggccaggcccttctctcgggtggggaggaaagtgagagagaccgagcccctggccctctgctcttctccaccaggcctgagatgggggtctgggctcctttctatgtgtttgcaatccaaggtccttttgggaattcacctgtttggaagatgaatcctatctccagttttgcctttgggtttctcagcttggagacacatgtgcgcggcgagctcccgtcccggttcccctgggtcctgcagtgtgcacaggagcagccctgggatggatctttcgaagcacctgcgtcgcagccagaacagggtttttaaaaaatcaactatacaggtatttaagcagggactagggtggattttatggccctccgtgtggcaggcagcaggcttggctgattctcagggcggcggggtggcccttgctgcagttcaagtcacagtctgttgcggctgcattccatttttcccagagaaaaggccaaatgtcaggggcctcctaggtgcctgggaagatgtccagctgcccaatggactagtctgaccccgacaggctgagagcctgtcatcgggctggaggcatccaggtgaagtggtccacggagctggcatttcgtttacacttatgtgaggcctttctttgagcctcttagacagttagtcctgacaacatctgggttgaaatacagatgaggttgtggcatagcaagtcccctggcccagatatagtcacggtttgctgttgatccagttaggagacctccgctttggccatacagccttcccttctgagctgggatggtccaccaacttttggagccacagctggtaaggagacttcctatctgaggatgcccccttctctggacccccagatcctgacaccaagccaggccaggccaggccattttggtgttgcagaatgtgtggtggggagtaagagcaaatttctgttccagaggcagggaggggacacagagcacaatcctggctgatattccctggggtaatgtccaggcaggacggagaccggccccttcctctctttcccctcacaccagatggctatggccctgccagacattggggctgtgggctgctcaggaccctttccccagcaccccgcatcacgacgcatctagaatgtccaggacacgattctcctgcggactccgatggccacccccattccccctggggctgagagagttccttgccgtgcagatttgttttacactcaggatgtattccttggtcagagatgggagacggttttctcatttctgtctctttttaagagaaaaagtggaaaaagacatccaagcactttgttcgtggaccactttcctgcctgtggagtcgtcacctggcatccttgcttctgggctggtagaaaccagacgcaactcattgctctgagttggtgcgactgcttgaaaggccggggcaggtgctgatgtagtttcttggtgcagagtgatgcccagtagatgtccatggaatgaatgaataagcaaagaatgaacaagtgatgtttaatgagtagggaggagggggtgcctctgtggggtgttggagttccaggcacagaatccactgaaggccgggctcccctttgtcagaggtgacgtctggatgggcagatttgccaaagttctagggtctgaacatagaggccaggacttattaaaatctgctcctttccttaaactagcacattctagctgttatcctggtgccatagaaggatgaaaaatatttctgagaaatcagacaacttccagtgactaaagctagtctaaagaatggtgtacacacacacatacacacacacacatacacacacacactctctctctctttctttcctgttgggtgttttcaggccatttctgtggctctgtaggccaaattctagactctagtgaaaaacccacagacctgagttcgtgggctggcaagctacacgtttggctcatctgaggtcctggagggtgcaacgtctgggccaccatccgggttcctgggctctcctttccatcctcaccaggctccttgggatcccccagtgccttcctttcccatcccaggctgctgctgctcctctcattcccagatgtttctatctctctagacaggtttgggagaaggacttctttgaagttcctgcttccttactgacctcagagactcaagaatggttcattaaaataattttgtcaaggaggtggtgggtggaagaggtgggggtaacaaatctggggaagttagaggagtttaagaaatcttggcggggcatggtggctcacgcctataatctcagcactttgggaggccaaggcaggaggatcacttgatcccagaagtttgaggccagcctggacgatataccgggaccccatctctacaaaagatttttaaaaattagctgggcacaacgatgcacacctgtagtcccagctacttgggaggctggggcaggaggatcgcttgagcacaggaggtcgaggctgcagtgaactatgatcatgccactgcactccagcctgggcgacacagcaagaccctgtctcaaaacaaaacaaaaaaaatgaacaaaagcttatgatatgatcaccgtcgtggtacccttgtttcttaagccttgttcgaaggatgacctcttttcttcttaggggaactttgtactatttatgcctgaagcaatcagggaatcaggtgtgttgaaaatagaatagaaatggtggtatttattgaactttttattgtgttgggcacttatgcttagtgctttaaagatataataggatctaaatctcacaaaatgctgagaatcagatgctgttattacccttgtttagagaggagcaatctaaggctcagaccacacggcagatgtgctgaggaacccaggtttcagcccaagtcaccaaccccagcctgggcagccgccacagctgcccctagaccaggccccagatcccttgggacttctggcgtaacttttatgtgcataacctacaggcctgtgagtcttaagtgggtaatttgcatgatggggaccttaagactggcaaaatcctttcctagggggtggtatgagtatgctgtggctgccataacaaagcaccacaaacaggacgtaaacagcagaaaccaactgactcacagccctggagcccagaagtctaagctcaagacatcaatagggttgggctctcccgaggcctctctccttggcctgcagacggtgtcttcttgccctgtcctcacatggcgtttccgctgtgcacacggctccctgatgtctctctgtgtcctcatctcctcttcttgtgaggacaccagtcatattggatcagggcccacactgatagcctcattttaacttagtcacctctttaaagactgccgtctccaaatccagtcacatgccgagatgctgggagttagggcttcaacatacacattttgcgggggacacagttcagtctgtgacagttcagtcatttgcttcacataggcggggtccccttagggtggttgcttttctgcctgtacacgtgtcttagaccccttgggaaaagcacaagcccagagctgccagtgcaggcgcccctgaggtgctcacggccctgcggcttcctgtcccttgactttttgccccacctggagcagcagacattctcttccgattgcggaaagttttgaggcctcttgtataacataagacaaggcttctgcattgaaattgttcaagaattgggttccaatttcccaggagcacggaaagcgttgccaggaaagcggagttgctggcgatttatgtcggtttttctgacataacgaagatttccctttgtttttttggaaccgactggagcgtgcttgccaaaagagcggcctcaggaggagcagatcattttctcttgttcttcctccttctttttttattccctctcaatttattttcaggtcagagcttcatgaggtcgctgaagctgtgaaatctgacagactcaccatctgagcaaacagactgtccaggaacaggttttatttggctcgctgaggagatgtgacagtctgggaaaatcctcggtctctgtattttgtctttgcccaaaagagtttggttcggtttgacaaatgttaaccaagctcccccctccacgccaggggcgatgccaggcactgagacccggtcctgcccggagcagagcagagccgctcacccttgaggggtgccctgtacaactccacaaatacgtgtccaccgtcctgctggtcgccagcgcgcacagttgctaatccgttgaaatacctctgtggctgctggcgagcgggtgtcacccgagcttccagtgcccatgctgcgctggcctgcatcattctgagtagcggcgtctgtgccagaccagttgttaaacattctgaatgtcacacctggtggagggtgtgtggatgagaggggctcggttgagtaccaagtgttggggaaggccttttggagaggtcaagaccaggccagattttgagcaggagctcagcagacaggccagggaggaacaggcagatattcactgtcagcggcggaaaccagctgtgcaaaggccctgaggcagggagagcagggtgggtttggtggggtggtggcggcagaggagggggtggggtggcggggagaaggggcagtgccagggtggagagagaggctggagtaggggcagtggcagcagagcagggggtggcgctggcagaggagggagctgggaagaagagcaggactcccttggggctggtgtttggtgccaaaggccatgaagagtgagcagagggctttaatttgacggtgtatgaggtcctattatattaaattttatttttttgagaccgagttttgttctttcatccaggctggagtgaagtggcacgattttggctcactgcaacctccgcctaccgggttcaagtgattctcctgcctcagcctcccgagtagctgggattataggcgcccgccaccacgcacggctaatttttgtatttttagtagagacggggttttgccatgttgaccaggctggtctcgaactcctgacctcaggcgatccacccgccatggcctcccaaagtgctgggattacagacgtgagtcaccgcccccggcggtcccattatatttttaaagtatatatattgatttatattccacctttgtctagaatgggtttagattcctgagacatagataatattgtgtcatgagttatatatttagggtaaattataaggaaacatagattacagtcagctaatgtaaaagtttttagtgtaaaaagtgagcaagaagaagatagaatgaggcaggatcaaaacacagaatgagtgacagggaatgggctgcccagcccgggggtgagtctcgagcggccggtgccaagaaggttgcacaatggctgggcgccggggagaggtgtggagaaaggggctgagggcttacacggacaggcacaggctccaccgagcagccgcgctaaggagctgtggggtggggagccgtgggcccgggtgtgggggctgcagaagacggagggttgcagggcgttcgtttactgccgtctgcctcagccatgaagtcccataaattgggtggctttacccaacagaaatgcaccctctcatagttcccgaggcccgacctccaagtccaggtaccggcagggccaggcttccgctggggctccaggcggatccttcctcgcccctcctagcgtctgctattcactgcctgcagctgcttcactcccgtccctgctccatcttcacgcggcctcccccaacctgtgcgtctctgttttcacgtggccttcttgcagagacgtcaatcacattggattggggcccatcctactccgttatgacttcatcttaactagatgacatcgcaaagctcctatttccaaataagggcacatgcgtgggtacaggggttaggacttcaacatatctttttggggaacacggattcatttttctcacttccctaacaaaatataaactgcaggaggcagaaaacgtcgccgacttactcaccattgtgttcccagcatctctggcaggatgctgatcggataaccagtgcccgaaaaaatgtggttgttgaatttgctcccactttcttcaccccctaacatcaggtcaaatccggcctagaattcctagtggaaagacagggacgactcttccgcaacacctctcagacccgtcagtgtgctgaggcgcagcttcccagagggaggtgtcatctgcagcgctttgcttacccgtttgaccacgacaccaccgcacctccctgccctttatcttagcagggcatctctggagagaatgttccacggagcacacctcgggaaacactagtttagctgcattgcagattggaggcaggggcagactaccttctagacagaactttccaactcttgaaagatttcttctgaagaattatggctatatctcctcccctgtagcctcccctgctctgccctctgcttttggtcttaaagctattttagatctgaaataccttccctggacctaccatttgcatttggacttagattattagacattttcttcttataaaaatcagcaagttgtacctacaaagtgggagcaaattcaacaaccacactttttcaggcactggttgtgcgattagcatcctgccagggatgctgggaacacagtggtgaataagttggggacattttctgcctcctgaagttcatattttgttgggggagagagaaaaataaattcatgtactagtctgctcaggctgctgtaacaaaataccatagactgggtggctttaacagaagacattgatttctaacagttctggaggctgggaagtccaagattaaggcactggcagattcgattcctgatgatggctctggcctggctgccaggtggctgccttctcatatggtgggagcctttgccttcaccttctcctcctcctcctcctccttcttctcctccttctctccttccctcctcctccttcttcttctcctcctcctccttctcttcttccctcctcctcctcttccttcttcttctcctcctcctcctcttctttctcccctttcctcctgctcctcctcctgctccttcctcttgttcttgttcttttcttcctcttgttctctctctctcactctctccctccctccctctctccttatgaagccattaatataatcatgaggacacctaccttcatgacttgtctcatattaattagcttctgaagatctcacctccaaataccatagcattgggggttggggcttcaacctattaattttggggaaatacaattcagtccatagcagtcagtaaatagataaagcgaatttccctggtgggaagtgctgcagaggaagaagtgctgggaggagggtgatggttggggagggagggggtagtccctgaggaggcagcagtttaagctgagatgggaaggaagagaggaaggtggccagtggagggccaggaaaggaggattttgggtgaagagaacggctacagcaaacagatgggaaagactgaagcatgtcccgggactgaaggaagtgggggctggagtccagagattgcagagcatgctggtactggagggtgggggaggtggcaggagtcccattcggggcatggtgggggctgtaggaggacagaggagtccatggatgtattctgaggtcctgttggtctaggagctggttgggtgactcctgctgccatctaggcaagacatggcagccacttagatgaggatctgggaggggagaagaagagaagaggacagcttggggatgtccctcagagttagaaccaacagagtttgtaggttttcagcttcagtacctaggtcaccagcagtgtcatctaccgagaaggcaaagcctggggaaaaacaggtttgaggaggcaaataaaaaaatctctgttgcacacgttacatgtgggatgctctttatacagccaaatggggaggccacataggctagcagatcctgggccaggagctcccagaaggacctaggcttgagacctgagtttgtaagtcatcaacaacatctggcagggctcaggcacttagagggcaggggaaggaggaggagatggtgatggggcagaggagaagggggaaccagttgttgcaggaagatggacagcccatgaggtttcccagagggcctggccactgagaagctgagataagagaatggcgtcattggatttggtgacctagaggttcagagtggccagcgggaagttttgtagtgaatatagaggagacgaaaaagaatggggatgggaatggaggaaggagagagggctggaggaagaaaggaagagaaactaattttgactgggcaactatgcagaagaaagcccgctttaggagtgaggtcctggaggaggggacaggagatgggatccagggcgcagctggagggattctacctggagcaggtgggggtgcttatttcatggccataggagggaagagagaggagacagctgcaccttgttggagtccatgtcagctgattggaagaatccagaaaagggagatgggtccgtggataggtggaagccctaggtcaaaatatctgactgcagaaaagaccagtcagggaaataatgatttttctttcaacctggtaaaatagttttcttctgtcaaagagcaagtggcctttaaggcatgtttatctattcccttacattgtgaaagagtaaagcagtcttaagactgggtgtgaaatggagaagaacgcagcactggcttaaacttgactgtgccattggcgcttgctggcagcagctgagcctcaggcaccctgagcaagcacaaggcggagaaatgagacctgctggtgcttacaccagaactgactggcaactgggaggggctgagcctgggatctggggccacttgagcttgacctcatacctgtttatgtcctaattgcttgcttccagttcagcccctcttctctgagaccatcctctccgaggggtcttttctctctggccctttgatgctctacaaatcgtctcctttctagtggttccctcttcttctcccagggcaacagcatcacaggggcatccctggctcctggggctgtagctgttggccttggcccatgcttagggccttcccaccctcagtgtctcatctcaggtgggctggctatgcaccaccccgggatctacagtgtgggacaaggcacacacacttttgattgataaacagggtgtgtcatttaaagaagttgagacagatttttctggtccctggtcaacactgacttagaaagatctaagaaaatctatagatcagattttactgctttcaagataaacgtgcttacattttcgacacagagcatcagtaacctctgaaaatgaaatgcttcccctctttcccatgttctggatggatttggtagaacttgcatcaggctgcaaagtgcatgaagttgaagctgactccttgcttaaagagaaaaccttaaatattaaatgtccatttgtctgttaagtaaacagttgcattctttcagaagtcctgatgctaacaacatctgcgacacgggacggtcagcttcccaaatggctgtgttagccccatgttcagggcctggacttttcctgaataataggtaaagccaagggaaggaaagttttacttcctttctgggctaaattgtcatctgggaagcatcataggctcagtttagaggaacatggcattgtcctttacccaggtgactgtatttgctattttacattggcttgattagatcaaggcaggacatttgttatcgctgactctcagcctggaagcagcatctaatatgtaagcagttgactcctgctggatgggcacataaactgggtgtcatgttattaagatgtggtgaaaggtagacaccttccctgtgcttggaatgccccagtccccacacggggcacccccttacccatagcactgtctcatcagaagttggctggagtgttgggaattggaagggcagggaggttgttggtagggctggtaaatctatggcatggaaaaggtggaagagttatctctgcttcctagggacgaaggcctctcccggggctgggaagttcctgtcccttgtactcagggtctctcttccctggacagtgctagacaaataggactcctttaactccttaggaagttccctgtctttaagcattgtctttctttaaacaggcttcaatgcaaccaattaggttcttacttgctgaattcttcttcttcttcttctgcttctctgagatctgagggggatttgaatgatcttgactctgttcccaaccagcctcttggtttaattccaggattcattcattcaacaaatatttgagtatctgctgcatgctgggaaccatgttccttgcaaggcatacggcaaagaacaaggtagataagttcctcgcatttattgtgtgtctatttgtctattttaacccagaacatcttctgagaggatcagttttaccaggcaagggcaacttttgatggtttccccaatagcattcccgtcttatttcttgccgacaggaccttgactgtgttcaggtgtcagtggccaaattcttggggagatgccagggccctctccagtcccaggggataaacctagatccgtctaagcccatcatggtcagtgattggtttaggggcggcctgtaactcagttattgccagtgagatggctaggcacttctaggacaatttcctggctcttaaaaaagggtgtatgatttctgtcttctggactttggaaaatgtgatggttatgggaggccgctatggtcaccttgcagccatgtgggtccagcccaaggtcatagcatggttgagccgagagaaggaacccagctgacatcaaccctacctccagacttcttgtgacatgagatggtacattttccttcttctttaaggtaatttaggttggattttctgtaattttgcagcccaaaatatcctacttgaaagcaaaagacatctgccctcgtattcatgcagcggtgtggtcgctttagcctttctccaggctcattgtgttgtgctcagttttgtacacaagtacgttcttttctaaatggcaagacgcttaagatgcttggatttcctcttccaccgcctctctccagcacagcactgagcttaatatcttgtatgtcgtgggatatcaataaacgcttattgagttgaatttgagttttacggacatgagtttaaatttggtgactacccacgggcttctgagaaattattgaaagccaatctatggcccaaagagaggacggcctgatcaaggcatgtgctgttgggccaggcagaccacgatggggatgaacgtgccctgtgtgaggtgccagagaaaatccatcatgcatcccgagctctgttttttattgaaaaatccatttataaataatctggacaaataaagtaaaaggcactttattgggattcagaaaaattcatggctactgaacatccggccaattcagctcccagctcccaattagcctgccagggcctctctcagtggcaggggccctgccagccactcgaaaggctgccctgggactatgagtcattttcttatttcttagcatgctgggcgtgaaaatcttctttctctttcttattacatgctagcacttaccgggtgctttggccaagcagatatatcagcatgtttttgtgcagataattgacagtggagcaggaagacactctcctctaagttgctccctctctttgttcactcgcttgctcgagaacccagggacggtgggaggaatggccaagctggacgcaggcctggcctccgcagagctggcgagcaggaaaggcaagtttcagacacctcctgccatgcccttgaccctgctgggcccccggtatcctaggagtgttttcccatttccggccatgtctttattttatgattgttcccttaacccaaaggcaactgggaaagattgtcatccttcaccacgaagaggccgttgtcatttagtgagtacctactgcatgccacatgctatgcagaaggtggttgttgcttcgtctcacctagccctcccagagaccctccaaggacaaatatgagactcagagatgttaactgacttgcccagggtcacacagcttgtaagtggtggaaccagaattagaaaatgcaattcctttttttggagcctcacctccttccatcgggatcacagtgatcatattttccaaactgaaaatgggatgcagggggcctggcacggggcaacggggcaatcagtagttgctgggagaataaacacacgaattgagccaagggtcagccaacgggacaggtcttttgtcagcggaccgtttgggccatctggtcccagggaccacagggtctgtctgcctctccgtagggtgggctgtgggtagtggggtgcccgtgaggggagaggaacaagagagcctggacagcaggctctgggggtgctgtggcctctgagagtggagtgggaacaggggactggcagaggagctggtagcgagggcttgtgtgtggctgctaactggatccatttgccaaatcagcaaagtttggagctgagactccagacttaccctgggcctaacttgggaaaatattacgcagtacaaaataaaattaaacagtattaaccacaggcccaaattgcacctatattttaaaaagcattgtgcagctgagacttataaagcccggcaccagcgtgaggccatcttggttaatgagagctctgcgcctgctactccttgccgcggcctctggttcacgtcctctcgccctcctccgctggggatgtgcggggcctccggtgagccgcagctccctcggaaggatgcaccctttgctctctggagcaggacgggcttttctgagaggcggggcccgaagtgtccggagccgccagcctcaggggctgcactggcctctcctttcctctgcccacacagagaacagcagcatcagatgggggcgggctcaaaagggcttcataggcgccccgacatcgcagctacggaggggccagaaaggaggcgtggatattgtactgcactttctggactttcacgggaattcatgaaggagcctgaatatgcagcagccacatctgggtttatttcagcttggacactaattcatgttgggtcccgtagtaaatcatttttcattcagttacttgtttttcctcacttgaaaaatgggcgtgatactggtggtcgctgttgtcttcccgcagcgatagaatgaggctctgcagtgatttcttttccttccaaagtcgaaagctcctctggctttgcacaaccttttgagcacgaccttctctctcatcacggtgatgcctgttgccccctagtggtcaccagcaaagggagtggttgagccgacgatcccaggttgcaactcagacccaggcctggccctgaacccaggtcttcctgctggttccgaggcatctctgggcagggtgggttatagggaggggaccagagagggagtcctcccagtcgcctccaccaggcagccctccagcttgtcaaactgtcgccagcagtgttttctcagcatggagattgtgtgtgagtgttaagtctagaaaaatcactcaggcaaggcaaagacttgctttggtgcaggggactggaaagcagatgtgctttttctggctctgaacactgaggggaagtgagctttggaagagaggcgctgacttggtgtgtgttttggggcaagaggaagtttaaagagggacagtctgagcttgctctttgcaggggcttgcttggaggcccacaggctggctgagcatgagagagagtgtgccagtcagagcccgcagactgatggcttgcttaggagtatggactggagcgagcctccccctcctcctcctctcctcaaacaaggtcatcagtgacaaatgcacaggagatggtaaaggtggattggggaggatttggacgtgtttcttctgaccttgatggggccatgtcccctctatttgtaatcttgagctagaacaactgacaaatggcctgataggtgacaaaagcaaacaatagactcacttgaaagatacagtgaatagaatttaattgaattttttttggtacagacattgatttcaccctgtaagatgtatggagtaaatcattaggggaattaatatacattaaaatgtagtttattatcatgaaacttttattgtgcttgtagttgtgtttttaattattattttaatgactttctatatttcaaatcgtgataaatctattttttaaaaataaacggactatagttttacaaggtgatgtgtagtgcagagctgttgatgaatattgctccttcattaatgagaaccaacagattagaaagactaaaaatggaccgatttacgcactttttaaaaagccaattaatatctaaccattaaacacaaatgttatagattagtctcactatcttatctactctctgggctcctattggatcattcagagattgactctttaaaccaagtaagtgaaggaggctctaaaagtggaaatgcctgggaccaattaaaacaaaggatttgggccataatgtgctgaaaatacccgtgtcctcctgcctggggggccattatccaaatgagcaaagaggacggaggtgtttgtccaagctgtctttgagggatgaagcagaggttggctctgctggtaggatcagggttttgggtgatttccccagtggtgaagatggactcgtactggcttttctgcattgcatctcctgagccttcttggaatcaagggcaaatgcttgttctgtgctttgtggggctttgtgggtaccccgctctacatggaaatcagccctatgaccactctcaatgctgacctatcccagctgagctgaacgacacgtggttttactgtcatggcaatatgtcctcagttttccaattcaaacatcttatttcagatacttggttccattagccacatgggggcttataccatcttcctccctggctgtgtgctggttggctatttctgacttttgaggttgtcaggcaacatgtctgggcagccagaggcaggggagtatggatgcgaggtgtgtgggctccggaggcacgcatcccaaatctgaaacctggcaccagcatttattgtgcgaccttgaacagatttacttgctcattcattcatttatccattcatttcttcattcaatatttatgaaatctgggtgctgttctagggattggagatatagcagtgatcaaaatggagaaaaatctctgcattccagtgaggactagagaaaggcattcaacaaatagtatagcaagatgcagagtacactgcagaacgtcaggcaggactatcgactgtggagaaaaaagaaagtggggtggagggccaggcagtgtgtcaggggatgttgctatttcacagggtggttagggaggccttacccagaagggaccatttgagctgtgacccagaggaagtgagggagtgaaccgagtaggattctgagggaagagtttcttctaggcacaagggatgcaggtgcagaagccctggggcaggagcctgctgtctgttcagggagtagcaaggggactgtgtggctgagtggaaggagtagatcagaggaatcctggggccagatcatgcaggacagataggtcattgggaggaccttggctttgagtctgggtgagatgggcactcctttaaagggtccccctgactagtgtgaagaagcaagagtgtaggcagggagatccaaaaggcagatgcagtcatctagatgggaggaggtgctggtagcttgaaccaaggcggcagcaattaagatgggagaagtgttggattttggccatattttgaaggtagagtgaacagatttgcttctaatgtttccaaaggaaaggggacaaggatcagtctcagatgtctggccagagtcactggcagggtggtgctgtcatctactgaggtggggggaagctacagaaagaaggggtgtgagtgtgggtgtgatggtaggttcatgtgtgaagcatgtaaagtttaagatcctagaagatatttggatggaattgtttaataggcagctggatataggagcctggagttcagagggagaagtttaggctgaaaacataaattttggggtagtcagtgcagagatgacgtttaaagttctgagtctgggtgagatgactggggagggagtggagatggtgaacaaggcccaggggagatttggggcaatctgatgtttagaggacagggggatgaggaagaaccagcaaaggaaactgagaagcaacagccagagaaagcagaaggtcaagagagagtgagcttgttagaggctaagtgaagatgacgtttcaatgaggagagagggttatcaaaagatgctggtagggcaagtaaaattaagattaagaatttgccatgggctttggcaatgtggaaatcattgatgaccttgacaacagttgtcttgatggaatagtggaggtaaaaatctgataggaatgggcttgggagagaatggaaggagagaacttggaggcaggcaatataaacactctgcaaaggaagtttgctttgaaggggagtataaggatggaatagtaacgtttcttaactcttaaaattctatttcctgatctgtaaaatggagacaaagacaacacctctatcacagagttaccaggaagattaaatgagatgttattggaaactcagtgctcaacacatagtaagggcttaaaaggtttgctggtactgactgctgcctgtctgattgaggagtgggcaggaggatctgccctggtgtttctgtgtcctgggtttttgaaggtaatctctgttactttaccctcctggggttggaagtcaatcacaagtttgggtaaattccccattttggcagttgtgaaatgacagaaagatcagaaagtcagaaatcccacactcctgctaagtggtggcttatctgtatggctgtgcaaatgaagcacgctgcttccctcattcctgtattcagttttattgcttgtcttgcaaaatggcacatttcaagattaaagccattttgactttgagttactgtctttgaagtataggatttcctaattataaaaacacatactaattgtagaaaaataggaaaatagaagaaaatatgcagaaaagaaatttatctaaggcctcctacccaaatccaactgctgttaatgttttagtgaatttgcttccaatacttttatgaactctttaaaaacatatttgagataatactgttatatagtgttgtatcttgctttttctcctcaatgttgttagtgtaagcattaagttcttcattaatgtttttaatggctatgtgccagggaatctttacattttccatctcaacttatatccaagtgaaatggtaggaatagttaacccttttatagcattcactggattccaggccctgttttaagtactttacataaattagctcatttaattctcataactaccttctcacataggaacgatcattattcccagtttacagttagagcctttaacacacattaaagcctttcattgggtgtgaggaccaaggatgaagggacagacaccctttagcagacagtgttgccttccatgtgagggctctggtgagctggcatgcagtcatgttcttcttgaaacccctgtggagctggaagtagagctggagacatgcctcctacttcaacttttcaggaaaaatatccaaacagttttggtaactgttaagtgaaaacaataacaacctattcccagctctcccttcacaatctctttgtggttcttattctgtatttctcttgatttacatcttgtgttctctcctaccgctgattcttggtcacaactttggtcataattcctgcaaaaagtggtcgggagtcttcagtgtccaagggtagaaagaagaaactgggccctagagcaatggtttgccaaagctatgtccttagcaagtcgtcagaaatgttagttcatgttataacccagaacacatatacatatattcatttatgatgataatatctggacagaagtttcaggaaacaatgttacctatggtgcactttgatactttccactccactccgttccatttgattaaaacaataccaatttccactttaaattggtttcaggactcactggttaccacaaactgcagaagtcaaattgctgccctggagcacagcgttggttcagcaccaaggacagcagcccatcgctcccttcccggccctgtgctcttccttccctgctgtcacattttggttccttattctgacttctccagcctgtgttgacctggctcttctttgacttcccgtggtgcactttcaatctcagtgattttttttttttttttttgagacggagtcttgctctgtcatccaggctggagtgcagtggcactctctctgcttactgaaacctccacctccggagttcaagtgattcttgtgcctcagccttccgagtagttgggattacaggtgtgtgccaccacgcccggctaatttttgtatttttagtagagacggggtttcgtcatgttggccaggctggtcttgaactcctgatctcaggcgatccacacacctcggcctcccaaagtgctgggattataggtgtaaaccaccacgcccggcccaatctcagtgattttagaccctaacttaggtgcctggtcttcgtagatcataagcttattggagagaagacctaggttttcactatggcttatgttccctttaatgcttgacccagatctccagggaattagtggaactttaaagatgaggataaggataatgcatcagggttcctctcctgggagtgttgctggctgcagatctgctgggactgactttgtagactgtcatcacgttggacaagaagggcctcgttttattggaacctctttctttttcacaggactggaaaaaaaatttagtcctcctcctcttgctattgctctgttgtaaccctttgaaaagcaagctccctttttatggctttgacattattgcatcgctgaatcacaaggttttcaggaagatatatttgattgtgttttttccctgcagcccatgctgctcttcaggtgacacaatatgagcttttgcgctccttatctttcatcttactccttgataacattaacgagcaagagaagaggaataagatatctcttcttttctttctaataaaatctgaggttctaaggatagggcccatctggttaaagggaagactgatatagacttatcagtggtcagtttttttgacacatccaccaattttagtttgaactaagtcctcacgtggacccaggctcatgtctttgggaatggggcactggcgtgattgattaataatatgtgagtgttggagcccagtcccattctgctttcccaagcagtggcaacatagcagcgggtcttctgagtcatgtgtcagctaggagggctgtgttcatgcatatgttaaggtcttctgagaccgacctctactcctcttcaaagcagggtagaacaattacctctgtaaaattcatgaattctcctcctgtttactcttcaattccaaatgctcaaagctgggttgcttgtttgtcatgtgggattcatgatcacaggtgttagcaaataaaggtggtgactaatctgaacttgtcttatgaaggcaggttatgaaattcaaacactattgaaatccaaacacctttcatctattaatggccaccagtggcctataatcaagtcacactctgttagctacacaattaccttgtttgtttgaagtgtgaattaaggatttgaggcatttgctaatgaatcttacttgctccctactttggctgaaatccctgtgttttccaaatgcaggcagttctggaatttaaggaaaggttttttttttttttttttttggatcctattttctccctgtatgaaagaagcttctgttttgcttttgcacagatggaaagaagcaggctctcacaccctcctttcccactggactctgccttgatttcattctcagttttgtaactcgtggaaagtgcctccccgttgctgcagttctaatggctctctctgcttgagtgttgtaccccttgtatgggagcagaggggagtggtggagtctccccgtttgccagcctcctttgattctctctttgtgactcttctctggaacgagtttcttttgtagataatgggattccattatgggtgttagggcttctctggagctgtcagctgtgagggaagataggaggttttgatcaatggtttctgcttgtatcttggatgtgttaattttaagatggctggcttctgtttttattagttttattgggtttgtgttgggggaagggttaggatgagcatcggtgtttttctgcaaggaaacgtggttgctcggagttaggtggctctgctgtacttggaggctggaagggcctggagcgaggcaaaatgcccacttctgctgtgttcctgtaggcaccagagctgttgtctgctaccatgaaagccttttctgacttctttgaatgacttacgacccatttccaaagggctgtattggttaatgttctaaagcagaggtgttagtggagcttttcagcattgtgggtggggttatttatgggtgggaagagcttgcgtgcacacacacacacacacatacacacactctgatataaattcctgatttatttagccatggattcagaatttatctcaaagggacgtggctacacaaagaccaagtggatgcagcatatttttgcatagcttatcccttgtccttagttcttaatgggagttggcagtgtgtggctgtcagtgacactttctacgcacatagaatcctgccaaggttgaagaagaagccaaattcttgcaacactacttctgttttatattcaggtttatatcactgttctggaaggacttataacaacaatctgtgctcttttaggctcttctgattcttgaactgaaccttcagatcagcaagtctgcatcttcatctgggggtagaggtgaaggagggttggtgttaaggaaggcagaatcggtattgagtcgtcttcagacactctctctccctctcactttttgttatttgagaaaatctgtatctctacgggcttacgatagcctgtctctgagacaacaatgacaccctcaaagttttaaccctgtttctttaggctggctatgtccttcattgaaagattgctgacctctcaaagaataaaataaaagtctaaaaatttatgatgagacttttgccactggctgtgatggaataactaggactagattcatcctcttgctacaaacaatgataaaactggataaaacctgtgaaataaatattttcagctattagatgatcgtcagagtaggactgtggttgctaagagaagactgtaaaccatacaatcactttgtatttctgcatggaggcatttcaagactgtatcttcagggaggtattccaagaagagtacagtgatcttgttgagctgaggagacagatatcagagtttggagaggttgatacatctagaatttgcagggcagaatatcatacaggagaaggcctggcaaagaaagtgctctagaaacttttatggctctcctgggatgttctgttgactactaaaccattgatgagtgaggtgaaaccccacaaaactggacaaagtgcacataggggctataaaattcacagagctcatacaggactcggaggtatttgcattctgaccagcccgactggggagctgtccttgaatatttgggacattcagtagagactccggaaggaagaagcaataatagtagggtaacaacatttctggagtaaaacgtgctgtagacccacctttacagagattaaaaataagccttgagagggtcaggctgatccacaagtaacttaaataactgccagagtaaagcctaaagcctaatgctctttagttaaagatataattgctgacagttttccaaacttgacaaaagctataaactcactgacctgagaagctcaacacaccccaagcaaggtaaatacaaagaaaccacagaatggcacacacagtatgatcagatttcttcaaattagtgataaagattttttttttcttttttaaagacagaatctcactctgtcatccaggctggagtgcagtggtcagtcttggctcactgcaacctccacctcccaggttcaagcgattcttgtgcctcagcctcccaagtagctggaattacaggcacacaccatcacgcctggctaattttttttttttttaagtagaaatgggtttcaccatgttggccaggttggtctcaaactcctaacctcaagcgatcctcccacctcggcctcccaaagtgctggaattacaggcatgagccacagtgcccagcaagaaaaaatcttaaactcagctagaagaggggaaaaagacaaattatagacaaagataagaatttttgcagacttctcatcagaaatcatgcaagctagaagacaatggaatgggatctcttgagtgccgaaagggggaacagtctgtcagtgtaaaattccgtatagagtaaattatccttacatggtcctggaaattgttttacatcttgaatatggtgatagatacataatacatttatgtgttaacatctactggactttacatttaaaatggggtacattttattgtatgtaaattatatctccatgatgctgattgaaaataggttttaatccctgaaatatgggataacacaattgtagtaaatgaagtaatacctatagattcatggcacacattagaggaaactgaggcacagagctatcatgtgacttcccccaaatcatacaaccaaagggagatggattaactttttctattctaaaagaaatgtttttttaatctctcaaaataggtggattcaggtcttctcacaaactaaaaggtaggacatatattcctccagtgcctttcaaactatgatctggctggcatctaggaaacttgctataaagacctcaatacggcaatttgatatctcctcccaaatacatgctgcttctctttcaggtattttttcattctccctctaccttttagtgtgttttctaggattacacatcagtgagattgtaaacatcttcagcactgtggatttattattattattattatttgagacagagttttgctctgtcactcaggctggagtgtaatggcacgatcttggctcactgcaacctctgccttccaggttcaagcgattctcctgcctcagcctcccaaatagctgggattacaggtgaccaccaccatgccaggctaatttttgtatttttaatagagatggggtttcaccatgttggccaggctggtggattattcttatatcagtcaggatcctctcaggagacagaagcatgtttggttatttgaacagaaaatttaatatataaagactttctagctagtagaagggtggttgattactaatggagataaaagagaattctaagtgtttccaaaatatcaggggtaaagcagcagctgctatctctaggctgaggaaaagcagacaacaaatcaaataaggactagaagacccttcctgacattggccaaaattcagacctcttcaaagagtgcatggctaccaaaggaacaagctgcctgccaaagggcctgggctggaagtggtctgtagaagtggctcattgtcacttgcggatgtcaattagaacagagctggtctaaagcagcctgccagtggagggactgtctcctgagggtacagctggagctcatcttcatggccactggactccactctgaataatagtgatgattataataataatgatgatggtaagaggtctgcaagggatgtgtctttgccactgtcatcttgcaggttcacgtcgttgctgtctattgacgaagcttcacattctgctatgccagcaaaggagaaatatgtacagggtccagcttcagtatcacaaagaaggacaaagaagggtgaaattggaactcagagataataataaactgacgactggaacaatatcaaaatagaagttggggcagtcttggatctggcttcatcagtacatgtcactgtattaaggggcaatgagtgttctggttagcattgcactgttttaaaatctatttctttctggattgcctatattggttcatggtcttacagtgcacccagtttccaatgccataaatatcagagtaggggccccaaggtcaagggcctacaaatccaagccggccatgacagtggagaaagccagcaggttgaggtggtggtcctctggagctctcaggcccatccaaatggacagcagcttctcagcgccaagcagtggttgctgtgcagcatgtgggcctggggttgccagactttatttttcaagagaagctggaaatccctgaccttcaatctttaaacattggcagataagccaaatgggaagaagactgtgtggaccaagcaggcacatctctgggtggagtcagtccttgggccgccaatttgtgacctttgcttctgagatgtcctcactgcctctcatttccccagccatttggtttcaagccccatttaccttgcttttgaaaacattcagctttgttccattttccccactcccatggccttagtgcaggatcctattgcctctatcctgggctgtaatcatggtctccaatcagcggcctcttctctaccaggccaccaccagagtgatgtttctaaaaagcacagctagccagccgtggtggctcaggcctgtaaccccagcactttgggaggctgaggtgggtggatctcttgaggtcaggagtttgaggccagcctgacaaacatggtgaaaccccatctctactaaaaatacaaaaattagctggacattgtggtaggtacctgtaatcccagctactcaggaggctgaagcaggagaatctcttgaacctatgaggcagaggttgcagtgagccaagatcatgccgctgccttccagcccaggtgacggagcaagactgcatctcgaaatagatagatagatagatagatagatagatagatagatagatagatagatagcacagctctttgtgtggctcccatctacttaaaagccttcccctggttcttcgggataaaactccattgcctggcattgaattcctccacagtttggtgcctccccctccacctggctttgagttctgcctttctattccttgtcctgcggactctcattactttatattactcagatttccctgaacacatttgctactcccattttcctgctttcacttatgctctttcccttccctgataccttgaccacttgtctgctgggcaacctactcactcgtcaagacccagttgaaatgttagctccttgacacaacccttccttctcttctcagtatggacacatcgtccgtgctgctaatttggcactccttgtctgttttgcacttgaatgtgatagccctggatcctgcaccccatctgtcttcccagctgtatttcccagggccgttactcatgtgtctttgtattgttagggcctttcatagtgcctggcatattgtaggtgctcaataattcatcgaatggttgaaccaatgagtagataaatgaatgaaagaccgggtgaattgcttctttactgactctggctgtggatgtttctgtggtggctcattgtttcttcactgattggtaatttgatagtcataagaatgctttactatgtctcaataacagacagccagtggggccaggcttcatttcagaagtccaggctgttaggaatttattctgaattgctagttaccattttgtagacagtcctccagacacccttggatccttacagtcttaaccactgccactttcataaactgtcagagtagagctacgttgcattccatgcaaataaaaaaaatataacccatttttctatatgctaacagttgatggcaagagttggtcattttgaaagcaagattggggatgttggtttagacctgtgggtggggggtccgggatatcctgtgcagggtgttggcttggccagctgggtgcttgggaagtacatcagtggacagggacaggaatgttcagacgggagccctgccctgttggacctgggttggactatttatcatgggggagggcccgtcggcttcatgcacaggtgccctggagaaagccggtggggaagatgccactgggagagggcagggcctggttatttatttatttaaattaaggccaattattttttgtcaagtgcagcgagtggtggattctgggaaaacttgctttcaccgtaaacatattggttagaagtcattaatatgacattcacacatccctaataaagtacataacacagagatctggcaccactgaaatacccagaggacattaagtatgagtcttaaaaccaagaggattggaaacaagatatttttacttctcgtttgggagtaatataattgcattttgtggctctagcagatgctggggccagctgctaggggagccttggctttttttttttccctttattccccctcctcagctttggtcccttacagataaaacccttatgcagaactctcataaaaaccaagctttaagaaattatactttggttgaaaatccatgtttctatgtgcaaaatatatctgagactgtatagactatagagagatttttattagttgaactcaggagatatttgtataaatacatatatatatataaatatatgtacacacatatatacatttgttgttttttgtttaatttgttacagtgagcactaaagacctttctccctccctgacattgagcctgtatcttgaagacagatggaggacggactgtctgagagacctatgggggactctgctttttctaagggctgctccaggggaagctgtgggaggggaggctgatctctctgggctggacccttctatggggttgagacaaagcacagcctgcagtgcatagctccttctggggagggagtgggggcagcagagagagccggggctgagaagttgaggtgaatccagcccctctgagaattgcgtagccctccctgcacagacgggagcctccccacacactggaggggacacggctcgtcacctcagaggtggaccgaggggggcagggggccctgctctccttgaagcgtgtgctatggaacagcttccttcacatgtgggacgcggagggtgcagcggggtggctgccgttggctccaggaggcatatgtgtttgcgggttcctgtgatgtctgcatctagagctggccatccagtacggcggccatgtgtggcatcaagcacctgagacacggctgagcccagctagaggggctggctgtccgtgggaaacacacagggacttagtagggaaaagagtatgagatagcttgtgactactttttaaaaaattagtaaaatcatactctcttggatatattgggttaaagtataaaatattattaaattttcttctcttttaccttttaaaatgtagcttctagaaattttaaaaatctttttatattttacttttaagttctgagatccatgtgcagaacgtgcaggtttgttacgtaggtatacatgtgccatggtggcttgctgcacccatcaacccgtcatctaggatttaagccctgcatgcattaggtattgcttctagaaattttaaaatgacacacgtgccttgtgttgtggctcaggttctatttccattggacagtgcaactctggcactcacagattggccagagctgcctcctgaatgaggggcacttagaggaacagtgctgtgtgacctctcacgtagggcccgagcctcgatggcaactggacctttgtgcatgggagcctcaggcatgggctcttgaggtgacatcctttggaagagaacttcacaatctctccttcagctctgctgtgtcagcagtcatcttcagacacaggaactgtacggggctctacagtgacagacggactgagacacacaccctccctgaagactgaaaaaccaggaagggagaaccaccacccacatagagctagcaagagaaagtctgagcagtgcagccattgctgagaacgttccagaagctgcagtgcactgtggagggagacagcaagggagactcccctgggaggggctgggcgatgaacaggacctgacaggttatgtgggcagagctggcacatgggcgctgaggcgtgaagggcaggagtcaggttggcacagcaatgcatgctcacctgccagcccccatggggcagcctctgccgtgaccctccagccctgctggctcccagctggctggctcctgacatgggctttgcagtcctctatcaaaacccatcagcttggggactggatggtgggtgaccattgcctctgggtggtggagatggatgcatggcagcacggtgtgtgaccaggcagtgacaccaggtgcagcatcgcagtccccagtcctgcccaggcctcccttcctgatgtgtcttgtttggggccttggggaagggcccacctgcctccctggtctgcaggcaccaaactgtatctgctgaacagatacagaggggcctgtctgggaccctgccagtttgttctccaaagcccctgcagcacatagacgccataccttggcggccgtttttctacttgaacgtccaaaggacaaactaaacatttaaaatctgcaagctggacagtctttgctttggagcctgcagcaaatttcttcatcttgacagtcgagtcattcttctcagcatcgatgtggtatttaggatccgggaggaggaggaagctaagggagccagggcactggggaggccgccgggcacgcacacacgtggtccttagggctcaggggctgtctgcgtgggttggatggctggaatttccttccccctaatgccacatctggctggatgttgatgcctccttcttctttttatttttattgtggtaaaagacacataacataaaatttaccatcagtggtcattagtacattcatgaggatgtgcaaccatctagctccagacattttcatcaccccagaaggaaacccgacacccatcagccataactccccatcaccctcttcccccaacccttggcaaccactaatctccatgctgtctctatgaatttgcctattctagatatttcatataaatggcaccatgcaacacagggccttccatgcctggcctcttccactcagcatcatgttttcagtgttcattcatgtagtagccggtattagaacctcattcctttctatggctgaataacatgccgttgtacgtctgtgacacattttgtttcttcattcatccatctgcagatacttggggtaggtccacctcttggctactgtgagcgatgctactgtgtgcatgtgtctgtgtttttgtttgagcacctgttttcacttcctttggccatgcttttgccccagcctcctatgaatctttcaagccagacttgtgtttgaggggctgcaagtgcaggggaaggaacatgcacgcccggagagtgaggagtcctggcctggctccgccatgaacatgctgagcttggacaagtgcttttctgttctatacctcggtttttttcctctgtcaagagagatagaccagacctgtgttttcatctgccgcctttagggtcctaggtttgtggacctctgggggaagagagagaggccagacaattgagctaaaaacctttcttttcacaactccttcccctcgtcggcgggagcatctcccgctctgtgtgttgctttttccctgcttcctatgatgttttaagcaaagggctccatggagacaaggaattttgcctatcactgaagtcgaggatcttatgagttgaactaggcttttggggtggcaataagcttgatcctgctggaaggagagaatccccctgaaggagattcagtctggactcctcctggtccactgaagggaggtggggctgggaagtgaccctgggtcagtggggagcagggagctgtcagcctgggctgggaaaagttcagttcctcactcatccaagcacactgtggctgtcccttctgaaattcagagcagtggtgcagaatgtgagccttggagccattctgcatgggtttgggttctggttctacaggtactggccatgtgaccttaggcaagtcacttaaccactctgtgcctcagtttccacacctgtaaagtggccatggttcctatttcatagtttgttatgaagattaaacgagatggtcccacataagtcctagggcagtacctccaccaccttagcattggtgacattgatggaagcaatgacacagatggtgaagtccttctccccacaatcactctgaatttggatggcttttacatggctccatgccatttagcaccaaatactttgtgtggttttcgttctttagcgaatctccccaaacgagttcctgagcttttgcagggcgggctcacctgtggtctgcccatctggtgagggggtggcctggggaagggccatgggctgggaaggctgggcaacaggggcctggcattatacgggtaactcagacatgctccacccagccaggttcatgcagcagcatgggacagtcgatggcgggtgagtccatctttggggcccagccaacctgagcacaacagagatgggagcctgggcctgtgcatcagcttcctcggaaaggcttctctcagaggggctctgtgtgggaggtgtcctggattgggagaagcaaaatttacctttggggtggaggagggagtggcgggtgatgtaggtagttcttacatcagcgtgatttcctgggacctctgcttgcttgagagaagctcattaaacatgacgtgacccctgctaagtttggccacagaggtgaccccgtaacagcacttacacacactatcatgttgacttgcctgtacccatcgctcgactgtgagctctttaactgcacgcttcaaagtggtcctgttccctttctggtatacagtagatgctcagtaagtgtttgtagagtaaacacagaaggcagtaagtagtgccaggagtttttccccttcggcgggccatagcagtaggaagccctgtcaggctggggtgagcgttggctgaaggatgcccatgaaagtcttctttggatgtccagggttttggaacaaatcacatgtttagaggttgggatccactgcacctcccatcccctgggccactaagggtcacttctctcagcatggtcctgagcaggggcatggatcagggggttccagctggcacagcctattcctctggataccagatctcctgaagttcaggtagataagctgatgcacgtgacaagtggcttagtaaatccacgtactgactccagccgcagtgtgctctggttttgtgaagccaaatgagaaccaattgacaaaccaacaactctgaacggtcattccgatgttaccattcattgtctgcaggcgtgggcacgtggtgctgtccggggtggtggaggtgacagatgatgattaatccagcagtggtggcagcctctgacctggaccattttggtacctgtgaactcatcgggctgctagacaggtggctcacaccacgtagatcttataacgattcatggtagctattgtttggggcttgtcctctgccagccagtgtatttagaatgatcattccttagaactgcctcgtgagctgatagtctcccagtttcataggaaactggtctagacagattaggtaatgtgctcaaaatgagacagctaataagaggccgtgctggtacccaaagccagggcattgtttgcttccaatgcatgtgctcttaagtgtgttactattttgccttcctacagtgacatagagttaattaaataattggcaaagttttagtcaggaactgctgcattttgctgcttttaagctcctgtgtcaactatcttcagtgacacacacacactctctcactcacgtgtgcatgcatatttacttctgccatgcacgtttttcctagccccatcccatcccatcccatcccatcccatcccatcccatcccatcccatcccatccatccggccatctgtctaacaaacacttatcaggtgcttcctatgtgcctcaggacactgttaagtccaggggatgtgtcagcgataacgtgttccttatccttctcatgctacagtgggggatgttatctgagtaaacaagcaattagaatgcagagtgataaatcctgccaactgggggaaggtgccagtgccacccaggcaagcagtagggataactgacgccatcatgaatagttagggagggccagccagaggaaggatctatctacagtgagacctcagggaaagatttttctaaggagaggaaataacacgtaaaaaggctcagggatgagagaacaatgtgctggttgatcagctgcttatttatgatttcttcagctgcagtcagtgatagaaacttgcacagtgaagcaactctatttttgctataggcttctgcttcccaggttctttgtcaggtccaggcttccggacagaggtggcttgggctctcagttcccaatcactggctgccttgtggtggccggctccatgggatgtcaggccttgatctccactcttggcctgtggtgtttggactgcatggcatcaggggcattttctactctcacctgctctgcttaccgggcttctcttccttctcaaggccaagtttagcatctctggtcactggtgtcaactccattatgtcccagctgaaagaggctgctcgcctccaggcagaggggctgctaccttcccaggagccctctaggaaccccggctgcagagagagctgaggtggaggcctcccctctgaattttcctgatagtcagggcaggagctgcgtgttgtagcatcaccaagatcaagggagacatgtactagtccagccttaatttaacttacaatccctgccaatttcatgttagcagatcctttcggaggtggaagtaatgggccatatcatgcctcgagctggagcaatgacttatgttgatgtcactcactggctttttatggaaattattaataaatcagtaattctatctgcagtgatgttgttgtgtttataaatatttaatttgccttcagatgcccacattttcctcatctttaccttaaactctgctgacgttgctcttcttttggatgtgccgctcactagatttaagttatcagtagtgggaaaggttaacttatttctccccgtttcctctctggaatatggctttatcgtgtcttttctttttaatctttgtgtgattttggctcagggggttggggatgaagctgagagaatgcgacgtctcttgtgacagagatgaaagattcgtccagcttcagaaaaggacgaaactttccaattatggtctcgcatcgtggagaattgttgttgttggcatgtgtttttccctccctaaattaatgacatttagaatctgaaatggtgtctgatgtcttcctgccacagagaaatatttttgtccttgccaccgactcatcttttgaggcccagtgctttgattactaccgtgtgacaggttgaatggaaaggccttaaaaaatcaaaatagaaacagagtccaagtcgagtatttctctagcagggatggagttccaggctcgcaaatgaaaacagcagctgggaaacagcaaaaactttcttacctctcaggatccaatgtgagctaattgttgttattatctttttattcttctgtttcaggaaattgcagcttatttaataacatttgagaaacacgaagaatggctaaccacctcccctaagacaaggtaatgtcccagatcttgcagtttttcaaatgtgtaccataagtggattgatttgcattgattacctgatttggccagtgaattcatgggcaacgagttgaaaatgccatgttgtgctggatggctttcgacactgaggtctcattcattgacataagactgtggcagtgaatacgatcagatggattaaaaagagtgcaagtgccatccgccagttggaacttttaacctgacggctgcatccttcagccgggtgcttggaaggcttcacaggcaggagcctcaggggaagtttattttgggaaattgctcgcctgccactagtgttctctagaaacgtgctttgaaaaaagagaaaccagcttaactgcccacttttatctcaacttgtctacaaactgaaagtcaagttcttgattggtggtaaagagatccccccaaatcagaagcaatggctaagctcgcagtttattatgcagtaaatgtccttgaacctgctaactgccgcaaacacttagcttctctcaccacttgggaatagagggaattagtgaaaatatagctgacctgcgttccgccagcaccagtgatgttaccatcttgtgaacggtgatgttgggacttagggttgattttaaaaggcagcctcttttggtcctccccaactctaggtttttatttttggaatgttacaatctagagcttcggaaatacatggccactctcttccaattgccgtaagttttctgttagcagtgacaggacccaggtgtttattagctggcggggtggtagctggagtgtggtttacacaggatgcctggactgcaggcttgaactgaagtggtggaatgtccagttggtttcacgttggacagaagccccagagtccccaggtttgttaggaccagggaagggttgagtgtgtcctctgtgcccgtggcccatcagcttgacctgttcatccttcctgagtcatgggaaaggtcatccttgggaatgtttattccttctagaaggtattttaaaataccacattattaggctgagatatttactggttagcatcttttaggtgagggcacaatcctcccctttgaaggaggctagagggcattgtggaaggaaggttagttattgaggctcccttccccaggtggctctgaatggttcacctctggcctgagaatgggaggagagtctgtccgcaggagtccccaaaacctcagcctgctggaaccatggtttttcctttgctataaaatcaaataatttatatcagtcagcttttgctgtgataattctgtgtaagaaacgacctgcaagcttagtgactttaaacaacaaatctttattttctgctcatgggtctgtgggctgcctgtggctttgggttgaggtcaggtctgctgtgtgcatcattttgctgtgggacctaggctgaggaagccccctctgcctgggaagttggcgtctcccagaggagggcagaggcttacaagcccaaggcagttgatgcaggtgcagttgaaactcctgctcagatgtggcatcatatgtcatgcctgctgatgaatccactggccaaagcaagtcccctggccaagcccagtaagaatggggctgggaaggacatccctccacagagtgggggcaggggtgggcggtggagaggatgggaatacagtgcactatttggtgaatacggccatgttaaactagagagcctgacatgctcatttcccctttcttctgcggcatcttcttggaggacatcattctcaaacttgagcaggcatcagaatcagctgagggctcattaaaatgcgggccccaccctagggtttctgattcagcaggtgcggtgcagggggcctgaacatgtgttatttctaacaagctcccaggcagtaggatgtggctggtctgggactgtactttgagggccactggcctagttttctgggggagaaggaggcttatctgatttctgcctctggaccatttcctgacttccaagggtggcccttatctcaagcagccgccagcctctccttgcgcccttcactctccgctgaaacactccttgaatctaagtggaaagagaagagctcctccttagccagagagggagcttctctggaatgcgtcctgggccagacatctgatttcagatacgcagacccgtgctgggtttcagccaccctttgacggcagaacagtagaacatttcaaggcagcggttttacctcgagtttcagcctttggaatttgggttacaattgagaaggggatgtcactcagggtcatgcctgactcgcatgactttctggaatatacatagagccaagagaccccaccccgaggcacagggtgtgtgcctggcagaagaaggaaggtgggtttcagatgtggtcaagtccgggtttgagtcctggctccgtcactcagtggctttgcgactgtgaaaaggtcatcttagctcctttaaaagccctggtttttcttcttcatatagaaaatggagttgctgttgatcccacccttgctgggtcacgatgaggattgaatgtggtcacgtttctgattctgcttcccatgccgtcgggtctgtccatgcacaggtgtcactgtgcctcttatctgtggggcagtccccaacctgctggatgctttgacttcgacaggcgtctgccaggatttctctgggtttggaaggacgaatttctttcctaaaggcagagggtgaagacggaaggtttcctattagtattataatatccactccatgtttacacttgaaagcttcttgtcccaggagaagcaaaacttgctgtggttgttcaaggaccttcctaaattagttgttgagttgtgtttggatccccacccccaccccatctctagtattgaaattaattggtgcagttaactgctgagttcatacaaactggcctcctggtattaaggaattaatgacaccaatactctgctgaatgagaaggcaatacaacttctgtttgctgctgccgccgccactgctaatttcattttagaaaattaataaaaatgaattgcaccactgacatttatagagtttcctaataaaatgatacattgtttgtgtggaggaatccctattaaattaattgttgtaatcagttcacatatagatgttggtatagaagctgcagaggggccccctgcttgtctctgtggcttgctgctggctgggggttataaatatagtccttgctcagatactgccctaattacagagaaggccccgggagccccagctcacctgtttaataatgaggtgtgctacacggaggctcccagggctggggaccctgggggcagccgcggtatcgcaacagagctgaatgctgaacgttcaaacagcccgtattgtactctcagcaactgggacctccggtttgaaaaatcaccctgcggaacgtgtttttttggcacttgctgtgtgctcagtgtgataataataccatttggagaccccagggaacttcatgctccccaccctgccaggtgaattgagaatcttggaaagaagagtgtcctctgtctagaatgttctcccagctcctcctgcaggccttgactgggtgtccctttctcggggaggtgtccctggccatgcagtttagtctcacccccacccccacccagccagccccctttcctcctttcttgttttacgtttctctggagcactcatcgccttctgacacactgtgtctgtcgcagttgccttgcctaatttatgtattcattacttgacccactccaaagtgttagcacgaagaggagagggatttttagtggggcttgttcatggggcacccccagctcctagaacagtgtggacacctcccagaccctcaagaaatatccataaaatgaacaaaagtgacatagaaaggtgagcctgagtgttgtgaaggaagggacctggttttctccacttcagtttttcgggtatttctagtcccaggattgtccggttgagccagcactgtgttctctcacaccgcccatgggctggatgctgtgctttgaaacccttctggcagctctgccaggtatggaaggtacgtgccctcctgggactgcatggtgagtccgtgctagaactggaacttgaacccagtatgatctcactgcaaagcccataccctttgcttttgtgcctgtgaaggttcccagggagcccgtcaatagctcctctattcctctccgcctctcactgccgtgaattccaaaccaactaggagaaccaggctccaggcaaaggttccctttgtcagtaagcgtggctcatacgtgccagccagaagggtgttctacactgccctctgaattggagttagccccccagtcacaggcagtgtggaagagtggcacaccactgcaggggagcaggtccctttcaccagagggcagggaaccgggctgagcccaggacaggcagacagctgcaaaactgagcaatcccaatcatttattcctgctcccctgggaaatacgcaaccttccctggaagccaggaacacacaaagctcaagattgaagtaagagcatgtccttcccaggaatcctgtttatacccgttagaaagaggctggaaaaggctgttgattatctaattaattaattagattgatatagatagcacctccacatggaagcactaagggtctcataatagaattttcctatgatgaacactaaatgccttttggtcaataagcaataaaacagcccagtagaaggagggggtctagaaggaaaggaggagaaaagtgagccctgagtttcaaaaagactccagtggctcagagagagcttccactctcctcctcctggtttcctgaccccatccgtccattccggcttcaaatgcccagatctttccccgccctgatggtggtggacatcaaactgtgatcctctgctctttcttcccacattctcccttgtggggctcccaggactccccgacaccatggtctcaccgtcaagtctctgtggatcattccccacatccgactctgtctccccggcacctgcatgacgtattatgatctccagctcgccatcttctcccctccttccctgactcccactctgctttccatcttctgacttccctggttctagaagagccacctcgtttgtggagatgccagagcatacaacttggactccaggtggctcctttttctcctttgtcccctgcatctcattagccaccaactccgtcagtgtttccgactgtaattcacatcctcattttcgtatgttttcccccaggttcagctgtgtcctcactgccactgttacgcttggagtattgaaatatctcctactaggtttccttctctaagtcgaactcctcctccccattggtttgcctgaaatattgctttgattccatcgttattctacttgggagcctcagatacttcctgggagctgaggttgactctccagtgatgtcgttaaggccattcttctgtctcaacccacccttttccgtttattttccttgacatcccacctctaggtactgctacaactggggagctgctggctgctctctgaatatctttcttgtcccccactttggccttcacttggcattgccctcacctcgaatgccctcatgtccaatctggtctgcctcttcctgggagccttccccaaactcaccaactcagggcgagccctcttcccttcctgctcccgtagctgcacgtgctttgttgtcggttgtttgccaattcagctgtcatgagtgagtctttcttccccagtggggtggcgggttccccaaggacaaggtcatgctgtcccttttatctcttcacagcctgtgtgcagggaggccagggctttgatggggtggagttgggggcggacagagtgtggatgcattgcacagcagcaagtttgcccaggaggcaggagtgccagtgcctgccatccatggggttctttgtcctagacagcccttggggtcccggcatggtgccagcctatgagctgaggcctctgcctagaaagtcagtgttatcaggccccaggctggtcctggtgcagtggggtttgtctttgttcagccccattgtaagacccctggcagtgacctgttggtcacctttaaggcatctgctctttgggacagacagaggacttttctaaggaagcccctattcctggtaaggctgctcgagtgactggaatagaattgcaaaaaccatttaaaaattcccagagctgaaaagaaatgcaattctgacacctgctgcaacctggatgaagcttgaagacgttatactcagtgaaataagccagacgcaaagagccacacattgtgtgatgtgctgactgagggatctagaatagtcagctctggagatggaaagtagatggtggtttccaagggctggggtggagggagggagaaatggggagttagtgtttaatgggtacagcgtttcagctggggaagatgggtggcagtgatgatggtggcagagcaatgtgaatgtgcttaatgccactgaacttacacttaaaaatggtgaaagtggtacattttatgttacctatattttactacaattaaaaaaaaattcctggagttgcctctgtagctcttcctcaggtattcagctgggcaggattggctggggtggacgaattgtgtgtgtgtgtgtgtgtgtgcacgtgcgcgtgcgtgcgcatgcgtgtgtgtgcatgtgcagggggtgctgttggtggccagagttcggaagggcagttttagatttagagcattttaggactctgcactttggaactatgcaggaaaaaggaaactgggtcagcagtggtttccacgtggtaacctttgcattatgcactgaaccgggaacgcacttcaaattaacacagagacgtgtcacgttaggtgcgtgtcagcatttttgtaatgtatcacaaatccttggccaaggccattgttggccaaagggcaactgcagggtgagggagttggcgggtgccacatctgtcagagttcccagggagcctcctgcccgaggacttcctcgcagggtacctgtcacgtagttttcatttgtttccgggggtggggaatgagctgtggcctgtatcctgatggagtgtctggcggtgtctcgacagtggtagggaagtccccagtctctgcatggaaataggtctgccccagattccagttatctttatcctagttaatcccagaataccacatgtcaaagcaggggcaacccacggaggccactcctcacatcccctccgtgtctaggaagttggccgtggcgggggcactgatggcctggtggggtattgtcacatacactgggctcctgatcagaggacatgtgagcctcatgtgacttcagtgggcttagccacctgttgaaatggcagcaccagtccagggctcatgtccctggcacaagagctgagggttggcctccatcccacccctcctcacttcttggggccaggagtgcaagttcccggtgtcctggaggagccaagagggaagtgttgatgtttgtgtctctgattcctccctgggttagacagctacgacctgtggctcctgcccaccccgccacccccatgctttttaaaaaaattttgatatggagtctcgccatcagccaggctggagtgcaatcgtgtgatctcggctcactgcaacctccacctcccaggttcaagtggttctcctgcctctcagcctcctgagtagctgggattacaggtgcctgccaccactcctggctaatttttgtatttttagtagagatggggtttcaccctgttggccaggctgctctcgaactcatggcctcaagtgatctgcccgcctcggcctcccaaagtgctgggattacaggcatgagtcagtgcgtccggccctcccttcttttatttttataaaaattatacgtgtacatagtttagtatgtcaaatggccctaaaaaacttgtaagaaaagatagcagcctctgcagtacagctcaatcctgtttcccaggggcggctgctctctggtcttttggttctgatatttacctccagatttctaaatatgttgactctgctgtttcttgatttgtcaattttagacatcatcttccggcttcctcagatgctaactgaggatttagctttcttactgtgtccactgcctggctcttccttacctgggggaggggctggttaatggagggagccagctttctgttggtaactctgaggttcagcatctctacattttttctctggaaccatccgggttctcctgagaaggactggtcgatgtgctgcctagtttgagctggcctggctgctggtggtctgggagccaagcagggcgaggggctgggaatgtcagcattgggtatgagagctatcacttaattctcccagtttatagcctgtgtttcttgcctctcttctgctgtttccgagttcggagtctttccagactccacctcttcagagaatcaatgtgtctcccgctggggcagaggccagggggtggttgcctgtctgctcagtgtagacgtgggaccccgggagggtctattgccccctatacagatgtgtgagctccctctgcttcccaccccattcctaacttctgccttccgtggcacctactgcttccaattcacgagtcttctaggggcttggcaggcgggttagcgtgttgttcctggggtcccctgcacggcacttgggtttttgcttcctagattcagctgtgtcagttaccaaccctgcatctgcttcccgtctctccggaatgtgttggcgtctcttatccacactcgtctctgttcccctttggcttttcctttgtggatttatattagttttcattcctttactgtcactggtgaagatgagcgatgcttagtcctccctgtgagccctgtttcttcctcactggcctttgcccagagtcgtgccgagtgggacccactccccttgttttctcattcttcctctctctcctcttcgtttcctgctcactctcaagttaacttgctgtttcactctcttgcttttttctctttttccaagtctttttcagtctgcagaaagaaatgcctcaaagtgcagtttggaggtttctaagtgcgcagctgctcagggctgggaaatcctgctgctgacatgcacacatgcttcttgtgtgtgaggccccaggtgcgcagcccgacccacaccaagccccggcgctggcctcctgtccaccttcttaatgcaccattcttagtttagagcctttcctggcattggcacaggggcgtggtgtggcctctccctgagcagaatttcagggatcttggggacggccagggccatccactatgctgtgcatgtcccctaacagtgggatctcgatggcttttatttttacatggttctgcatgtgtcttctttggattttactgggacaaaagccttcgcggcagaggcttcgtgccagggtgcctgtgatgcacgttggggtgctctgacaccccaacaggagactgcccgcccagggtgacccttgccagcatctctaagcaggacacctggcagtgaatacttccgagaatggaaaagccccctggcactgtgcccacactgatcgataagtatttgcatgccctgtccgtgtccatcgatggtcattttgttttgtttctggcgccccgcaggccccgcagtttattcttagcatcttcagccctgtctccttggtttggagaattaggactgcctggtatttctgtcacgggcgtggattggcatctgtggtgtttcctctggatcaattctgatctaataaattgttactcgctgcccatggaaagggaaagggagttggcctgcgggccttgtggcattatgagataggaaggcgagttcttggaataaaggactttttgcaattcataagtttctgtgtaatgagtaatcaccagatcatctgggggttctgggctggagattctccccctgtgctgtttggctaggaggtattactgtctttgctattcttagattttccacagtccttcattatggagctttctaaaaaaattaaaaataaaccaaaaacaaaggaaggaaatcttttctggttctccaactctgctgcatatcccactttcacttgagcttttgctttgcgttgtgtgtgtgagcttacacacatgtatgcacatacacacacagcacacatgtagacacatatgtgcgtgctgtggcacatagaaccatacacgtgcacatagatacacaactacacatgtacacatgacacatatgcatgaacaaatttgtaacacacaatacatgtgtgcacacagcacaaacacatatacacatgtacacatgtaggcacatacacacatatgcatgtgcccaggcaatacagacacggagcatatacatgcacatatacacacaactacacacatgtacacacaacacacatgcacaagcaaatattcaacacataatgcatgcatgcagcacagaaatacacatacatatacatacatgtacacacatgcataaatacacaacacacacacacacacacacacacacacacacacacacacacacacagcttcctgtattggtcactgttctcttgtaagaagtctctgggaaaatttttcttcgttatgtgtcttagcgagttgaaattttttgggtagaggaaattttctcctcgaagaaaaaattaattattctatactggctactcctgacctcacctggcagggaatttattgttaattaagctgtttagtttgaggtgactctggtggggaagagggagcgagagtccaggacggggcagccacgtccgggaggggagggtcctgctctgctgaggacaggggagctcactgaagcattggtggctggcgttgtgacttcccatcactctctccaccgggatgatctgtaggaattcaggatctgagttttttattttggcctttacctgcgatggaattgaatttgcatgtagaatggcagctggtgcctaggccgagggatcagagaagtcagcccactgtcaggtctggagaacgacgtctaggcaggtgatgaaattatggaaagaacaaatgtatgcgcaaggatggaggagggaaaacagatgagacacttttgcttctccccaggagcacagcctgcaccgtgaaatgtgctatttccacatattttcacactgaaaatccacggcccttccacctccagtgtcatgggctcgctctaattaattcagttcaccagtgttgggcgatgctgcccttctgatgctgggggttgaccgtgctctgtttggggaatgggtgtcatcttctccctgggttatgagcgagcccttttattcctgagctgcgtgacaccgaactgtcaccttctttagttgttggttggcacccactcttctctttactcggtgaataccttccgactgcttcctgtgtgccaggcattgtgctgggcattgggacatagtggtggtgaccaagacagatcatttataagaattgcaactttggggagtgctacaagggtcaagtgcagggagaggctgcccctctagtgcatggggtgggggaggttgggctgccttccagaggggctgcggggtgcagtgggggttcccagcggggtggggggtacccttgaacagggtacctacctgagtagctattattaacacccttgcctggttgccctagggatggacaatgaactggaagtccaagggtgaaagtagaaagaacccgggagtgctcacatgccaatgtagattccattttacggatgggaggactgaggcaccgtctgtctgagaggcacatatacacacaactacacacatgcacacacaacacacacatatatacacaactacacacgtacacacaactacacacgcacacacacagcacacacacctacacacactacacacatgcacacacaactacacacatgtacacaacacacactacacacgtacacacaacacagatacacactacacacgtacacacaacacacaactacacacatgtacacactacacacatacacacaacacaactacacacatgtacacacaacacacatgtacacaactacacacacgcacacacaactacacacacgcacacacaacacaacacatgtacacgcaactacacacatgcacacaacagatacaactacacatatgtatacatgacacacatgtacacaccacacatgtacacacaatacattacacacatgcacacacaacacacataactacacgtacatacaacgcacatatacatacaactacacacatgcacacacaactacacacatgtacacacaacacacatacacacacacacaactacacacatgtacacacaacacacaactacacgcgcactcacacatacacacaactacacacatacagcacacacgtacatacaactacacacacgcacacacaacacacaagtacacacatgaacacaacacactacacacatgtacacactacatatgcatacaacacacacaactacacagatgtacacactacacagatgtacacacaacacacatacacaactacacacatgtacacacaacacacataactacacacgtacacacaacacacatatgcatacaactacacacatatacacacaacacacatgcacacacaactacacacatgtacacacaacacaactacacacgtgtacacacaacacacatacacacaactacatacatgcacacaaaacaaatattcaacacaatgcatgcatgcagcacagaaacacacacatatacatacatgtacacacatgcataaatactcaatacacatacacacacacacacacacacacagcttcctgtgttggtcactgttctcttgtaagaagtctctgggaaaatttttgacttatccttgtcctgttagctgctgtcagcaaagacgccgtggagtctgaccttctgagtgtggagagccagaggagctctgggggaactggatccccagaggctccaagcaccaagctttggttccccttgaatgccagctgctcagatttggctgatgtcagacccacctgtcccagtgtcccctagcactgtgctccttttaaactttctcccactcccatctctgtgtgctcagcccctccccttccaatcagactgtcaactgaggcttcaggagagaaagtggtctccagggacaaggggtcgtgctggctgtggcagcttcacatcacgggcccatttacatgtgagaaaactgttattgatgatgatgatggtgacggataatggagagactgcatggggggaattattcttagatataattgccaaactttgaattcttttttagctgtgatacagaattccaaggtgagaaaaaaaatctctcccttcactttatgagtaagtgatttggttctgctccttctagaaaaattccagccttaaccccatctatcccatcagtgtgtgtctgggaatatctctagttacgccatttctctggtgcttaatttctttacccagtgccagagggtctgcaaggatatgtatgagttttgcagtttattaattttgcattaaataattaatagtaaagttaattgatgaattattcaattttcaggtaaaatgggatgataaatattcataacttattttattaagggaatttccatttcttatgtcattaaatctagattaacaaaggctgattttaaatgaagattgaaaacaattgtgttttggaattaatttaccaagttaaggtcattgctttgtgagtttaccccctgccagaaagttcgggcttatcatctggaaaggtatctgaattcgcagaagtcacattgccatcagttaggagaattccccagatctgctgggaacttcccatgaagggcatgacaggcccacggtggggtggctcggaggcagaggcggatctgcggccttttcctccgttccactgagcactgggctgttgctttgagctgtttgttgtcttctcaggaattggaacacagtttattattaacattagttcatacatcccagggaaggaatgataaggtgcatatgcctcaaagttgattttaaaataactttggggccagacacaatggctcacacctgtaatctcagcactttgggagactgaagtgggcagatcacttgagcccaggagtttgagaccagcctgggtaatatagtgagaccaccgtctctacaaaaatacaaaaattagctgggcatggtggtgcacctgtggtcccagctactcgagaggctgaagtgggaggatcacctgagcccaggaggttaaggctgcagtgagccgagatcacgcaccgtactccagcctgggtgacagagtgagaccatgtctcaaaaaaaaaaaagggtttccccagagttttaggaggtgtatgaaatgatttcctatccactaatgctcttagtcaagggttaactacagtttcagtttttatctgtgttttctagttatcttatttcttttagacctggtttatgttaatttgtaaaactgcttagatcacagacccacagagtggtggtgagaagtttctgagtatcttacaggctgcttacaacttgcaaaacccttcagatctgggatctcaatccttttaacaacctgcaaagtaggtaatgcctggggatacactgagggagggaggaagggagagagagagagagagaaagaaagaaggagaagaaggaggaggaggaggagacgaaagaggaggatgaggaggaaatagaggaagaagagggagcaaaagagagggagggagatggagggagaaagaaagatccagagtaagccacatctcacattcagttttctttctcctgtccggccacttccctccactcacggatgaggaaactgagacccagaaattatgtgacttacccaaggtcacttcagctaattaggtacagaagttgggaccagagcccagctctttctttttcacatttgagtgcttttttcaacttcggtgtctttcttagcgctttaaaataatttttaaccgcccccgagtagtggagcgcttgggagtatttatagccccgtggaaccgcgtttctctgcttcaccaagtgttcattataattttccagtgaaacttgtttgctctgaggaagttgatcctacggtaggccttcatttcagaggagagcatttgatgttgcatctcatgaacctgctctcctaaaattatccctaattggcttggaaagtggcttccaacaagcagatggcttaatatcttgactttctggtgtgactcagggaggcaccaggattagatctggcttgagatagtggtcttgttatttggaggatgagatgctatcagtaatgtgcagactggagtggcagcctctggggagatgtcgtggaaaccgccagggacagctcgtgtcatcagggatgtcagatggcaggtggggtggggagagggggcctcgaaatgcaattccataatgtctagcgttagtcaacaagccattattgagtgcctgctgcgtgcataggtttgtagtaggcactgtggggttacaaaggcagtggaaaacatggcccctgatctaattggaaagacaagtcacacatatctgagataactagagagaagttcccagacggcacacgcaggagagcctggtgtgtgtgcatgtgtatgtgtgtgtgcatgtgtgtgtgtgtgtgtgtgtgtgcgcgcccacacacacagctgtgggaggaatgcaaaatggggccaagatcaattggattcaattgatttcgttgggaaaaacagcacagcagcatttgtacgggtgaatttcaatcagaaaaccgtgaactttggtggggaacggcatgccctgatagggtcgggagagacaatgcttgggcttttctcattcttaagccacacagagagcagattaattggtggcgttgacataaatgatgagaagactctggaggccatggaatgcaagaagatgggacaaaagccgagaatccctgcaggagccacctcccggaggggcgggtgctgctgggatgccttttttgtgcacgctctgtgggagcctggccggggctcagccaggcagagctgtctctcccagatctgctccctgagctgcagggctgtcctccagggcacagcctagcccccatttagtgagtgtctagatgggcactgcgaggctagagggcctttccaagcagggactccagcccatgtctgtctgttgaaagcctgtttgtcccactgcacccatcaagctaatgggaccataaatggaagtgtttacaaggtcaccctgatgggtcactggaatcatctgcctgctgacttcttcctacacttgagaagggtgcctctcaaccagagacacaaccaccccctcgctcagtccccatgggacatttgacaatgtctggagacatttttggtggtcaccatgggaggggccaagctgctggcatctggggtagaggctgttgatgctggaaaccgtcctatggtgcacaggacagagccctgcatgagggagttagcgagccccaaatattgatggcaagaattcagtgaagataattcctaccgaagcgcttggtggtcaagagccgggctctgtatatgaagcccagctcttccatttagtagcagaaaattaccttctcaccgtgcctcagttttcgcatctgtataatgggagtaatgatagtacatattgttgtgaggagtacatgagtgaagcgtgttaagaacttagggcttagtgtcattggtgtattcatgatgatgatctccccaggaatctgttccaaaccgcagacccagatggccctgggctctgtacgcacacagcccagttcttcctcacttctgcttttgtggttgtgcagaaggacggcctgaactctcacatcatcctcgactaccagaaacgattcaacaatccttggggtgaaaaaggttcagagaggaaataggggagaaaactcaaagagtccacatcacagcattcaagaaagaagagcattttaaataggagatggtggttaagagagtcaaatgctgcatgggaagccaagctaagagcccaaacttatttatttattcatccaacaaatatttattgacaatcgtattagttacctattgcgctaattttatagttacctaattgcctcaaaacttagtggcttaaaataacacttatgtatcattttgccctgtctgtcagtcaggaatccaggacaacttagccaggtctcaaggtttctctcggggctgcagtcaaagtgttgctggggctgcagcctcagttgaacactcgactgaggcaggatccactcccaagctcactcatgcattgtgggaggattcagttccttgtgggctgttgagctgagggctgaactcctttctagctgttggccagaggctgccctcagttcctgccacatgggcctctccaacagggcagcttgctttatcagagtgagttagcaagagactacgagagggtgagcaagacaaaagccagagtctttttgaaaataaatctcacaagtgacatcctttcattttgctgccatctgtttcttagaagtgagacattaagtccagctcctgtcaaggggagctgacccaaaagggtgtggcttccaggagcaggagtcattgggggctccctcagatgctgctgccgcactatgcattacacgaaagcactgataagaggggcaaagtgtaggaagaacaggccacaaactgggagttcatcatggcatcaatacgcactctctgggtggcactgggcaaagcattcttgcctttctggggctcagtttccttctccttacaatggctgaattggattcagggatggtgaatatgcatgatccattgatgcccagagcagacatcactacccatggtacaatcttctgtgagctgggtgcaccctcagaatccctcctaacacagctctcgtttcagacagacacgactcattgatcagagatagcacttgtgttgaaatccatctgccatccctgtgcaatctgcaaagagacattctgtgcttatggctccacagaccaccgatcaagatgtcacagtaaaaacgggcagatgaatcgtcctcccattggcctgagtgagaaagctgactccttagtgtttgaggactgggggtccttgttctgtacctcagcactttccttcccagaaagtacccagtgtctagatgggatgattcagaggggacgctgctgaggagcactcggggtctgaagcccatcgtgggattagcttgacctgatggggtgggcttagccccacatcttctgtttggtttcttatgggggcagatttggcctcagtggctctgctgcctatggtgagccgggaagtgagcatgggtctttctggaaatgagcccgaggtggcctgaggtgtttctgcattcaatttatctgagtttcaagtgattcatcctgttccttcctggatcgtgttcctgggctccaggtgatggcttaatttgcttctgaaatctggatcccacccattcactctcttccagtagctgctgggggcatcctgttaacaagaagcacagcacattttctgggccatgtaaccctttatcccaacccattagaattttcagcaccccccttcccccctttttttttaagtttcttttcctgaagggctagaatgttctgaggcagcttaatagacatcgatttgcaatgatttttagccactgtgcttcaggagagttgaggagctgatgattaatcctcgcaacagctcttcccttttgttttaaaatgacctaatagctgaattgcccgagcaggccgggccagtctgacccagttcagctccttgccttctgctgcttcatttaaatgaatctgcgatgaattattcagccctgctacgggggagagtgagtgctcctcctgtaatatttaatcagcaacctgggaggacagcgtcatctttacagacagctgctgctcacttagaggcagatgaatgagtgttcttagaagctgggtcggattcctgccttttcaaggaaggtggcttgtcctctgatctcagagggatggcgctgctcctcgggttcacccgtgatccctttggtcggtcctctttctatgtcagcagaaagcagcccccagggcctcccagtttagggactctgtgcgacctcgattcccaaatgtgcccccttaactgtagtgtcctctcctctatgtaacaaaccactgagaacttaattgcttaaaatgactggaacgcattgtcttacagttctgtatgttagacgtgtgacccaggtctcactgagctgaaattaaggtgtcagaagggctgcgctccttctggaagctctgggaggagaatccatctcttcacctcttccagcggctagaggccgcctgcattctttggctctgggtcccttcccccatcttgagagccagccacggagcatctctctggctctctttctctgacctcctctcctgagtcccccttctacttctaatgaccttgtgattacattgagcccagctgggtaatctgaaatcatctccccatctcaagatcagctgattagcagtcttaattcaacttgccaacttacttcccctttaccacataatctaacatagccacaggtttcggggattaggacatggacatctggggagaggggtacatgattctgccctcccatacctaccattgccctggcttcatcatccctggttttatagaaatttctattgagaagaaaacctctgagaaccttcctgagcacgctgtctaatccaatattaagagcatgggctctggggacagacaggcttgcacccatcttaactctgccatctgtgagttcagagaatggtgttggacacatgacggctgatgaacagtggacaggttgcttcacctctcggagctcctgtaaaatgggtttatggctggttggggtggttcacacctgtaatcccagcactttgggaggatgaggtgggcagatcacgaggtcaggagatcaagaccatcctggctaacacggtgaaaccacatctctactaaaaatacaaaaaattagccaggcgtggtggcacatgcctgtagtcccagctactcaggaggctgaagcaggagaatcacttgaacccgggaggtgcaggttgcagtaagctgagattgcattactgcactccagcctgggcgaccgggcaagactccatctccaaaaaaaaaaaaaaaaaaaaaaaaaaaccgaagactgaactcccagggctgctgtaagatgaactgagctactgtgtggaaagggagtggctctaggaagcagcctatgagtggccaccgtcactatggctgtcacgtatctctgtttctgagtgtatgggtctctctctgtccagaagggggtgttggtatcttattaaccccttatctggagcctttgtaggggaggctgtgtgggtcgccggtgcatttgtccagtggcacgtgcatttgttgcaggaccgctgcgtagagctgctggctgctgggctgtcctctttggtcacctctcacattgggcttccttcaaacccattctcttacttttaggacattggactgtatgacccttagagacatggatggacttttttctttgtatccctcacaattcctgtgggtaattttaataacacccatatttccattagttttccttgattcctcaaagagcttggccattccaccatgtttttcttcactataagtggttaagattgagatgattttccccattttacagacagaggatgaagcactaaatgagctgcccaaggttccatggctgaccatggccgagccgaacaccagccccagatctgactccagatggaacgctcttcccttaagggtctagctccccactctgacagacacccagcggatgttggctactttggataagccttgaggcctcctccctcccgctgtgtgtccctctccctttgtaggagcacattctggggccagcagcctcccgctcagacttgccattgaacacaagggcagggttacagttacacgctgctgaattgtcccttctggcttgtgtgtctcaggggccctgggtctcccaggccctctgtctgcctctctgacatcaaagatcaggaggtggtgctttgatcccacgggccatttgtttgtttcttccactttccagatctcacttccttgcgcggaggtggggctgctttgggctcaggcttcttgctttttggggctgccctgttgaatgcgttgatgcattttctcatgctgcttccttcaccccattggtggaaacctttcccggcagcctcacgtctgcttttcaggtactctggttccatctcttccggcctttgcatgtggggctctcagtttaccctcagaaagtgtggcatcagcacgagaagcagcaactttctgaaatgcaatgtgtgcagataaattattcagtgaaacccagtctaactttattaaggccagaatcatccttttctgtcagaagccacagacagaggctggatcaacaagaggccccaggacctagacagcaccctggggccagaggatcgtggttggccgtgggctggtcactgccatgtgggcttgggttggccttcccgtatgtttgcttggccacgtgcctgtgtggccattctgaccaagtggggtggacggcagagacactcaggtggagaagccagatgcggcccccttggagaggggtcatctttacttgattcccttggtctggagagaaggatctaggggccagagtggctcccggtcagtgtctaggaatggagagggaggaaggagggtctcgggcaagacctcccccaacaggcagaccagggcagtgcctatttattcatggcatttcacatcataagagagttaaagagtttgtggcattttaaatgctttatagattaatttatattctaacatggtaatgaggaagcggcttttgtccaagaggtgagatatgcaaaaataacctttaagtttcccataattaacctttaatgatattctctcactttagcaatatattttgtgcttcaaaaatgtaacagatagaaaggagtgagtgcttcttgcatccaagtgcctggcagaaatgaagtcactttggtgagtgaggttttacttctccgtcctttggtccaaggctactgggagggtcagatggtgaaatacacacaggaaaccttggctttgtggccgtattggtctttctttacatcatcggcaagccactgtttcggattcttcagggctggccttccctcttcacagcccctcccaccactgctgtaacccacgagcctgctgcacgcagggcccaccccccatcctctctccttggactttggtgagatttgaccttgtaggttcattgaccttttgtcaaagtcctcttctgttgattctgcagagcacctaacatgtgccaaggccctgagctgctgccctcagagttatgtctagtgggggcctcagacacccagacccagtggcagcagtgggagggaaggcaccactgctgtgacccagggtaccctgtattagtcagggttctctggagaaacagaaccaacgtgtgcctctgtgtgtgtgtgtatgtgtgtgtgtacatacatatacatagaccacgggtgtccaatcttttggcttccctgggccacactggaagaagaagaactgtcttgggccacacataaaatagtctaacactagttgataagccagaaaaaacaaaaaaaagagaatcacaaaaaaactcataatgttttaagaaagtttatgaatttgtgttgggctgcattcaaagccgtcctgggctgcatgtggcctgtgggctgtgggttggacaagcttgacataggcaaagagattttttataagaaattggctcctgtgattatggaggccaaataatcccaaaatctgcagtcagcaaggtggagacccaggagagctgatggtggtgttccagtgtgagtccaaaaacctgagacccaggagagctgatggtggtgttccagtctgagtccgaaaacctgagacccaggagagctgatggtggtgttccagtgtgagtccgaaaacctgagacccaggagagctgatggtggtgttccagtgtgagtccgaaaacctgagacccaggagagctgatggtggtgttccagtgtgagtccgaaaacctgagacccaggagagctgatggtggtgttccagtgtgagtccgaaaacctgagacccaggagagctgatggtggtgttccagtgtgagtccgaaaacctgagacccaggagagctgatggtggtgttccagtgtgagtccgaaaacctgagacccaggagagctgatggtggtgttccagtgtgagtccgaaaacctgagacccaggagagctgatggtggtgttccagtgtgagtccgaaaacctgagacccaggagagctgatggtggtgttccagtgtgagtccgaaaacctgagacccaggagagctgatggtggtgttccagtgtgagtccgaaaacctgagacccaggagagctgatggtggtgttccagtgtgagtccgaaaacctgagacccaggagagctgatggtggtgttccagtgtgagtccgaaaacctgagacccaggagagctgatggtggtgttccagtgtgagtccgaaaacctgagacccaggagagctgatggtggtgttccagtgtgagtccgaaaacctgagacccaggagagctgatggtggtgttccagtgtgagtccgaaaacctgagacccaggagagctgatggtggtgttccagtgtgagtccgaaaaatctaagaaccaggagagctgatgatgttgttccagtctgaatctgaaagcctgagacccaggagagctgatgatgttgttccagtctgaatctgaaagcctgagacccaggagagctgatgatgttgttccagtctgaatctgaaagcctgagacccaggagagctgatggtgttgttccagtctgaaaaccagcaggcttgagacccagaaagagtcaagtttagtctgacttcagaggccagaaaagactcacgtccccatgcaaggcagtcaagcaggagggcatcttctcactcatgggaggggcagcttttgcttttatttgttctattcaggtctccagctgattggatgggcacatgaggagggcaaccttctttactcactctgctgattcaaatgttaatctcatttagaagcaccctcatccacacatccagaatcatgtttggccaatatccaaatacttcgtggcccagttagattgacacataacattttacccctcacataagatgacccctcatgtaacatcaaccctcatgccctcctgagtctgcaagcctctctccttattaactttatgggttttccctgtctttcctccttgccttctaccccatgccttcaaccaccatctcttgacgggtaacctccagttcttcaccactgactcagctaggttgagtcattaatcagttaattttaaaaaatcacttaaagtagggaattgtacttgtaggtacataagttaaaaatttaacttaaaacctataagtgagtatggacttaccaatctttcgaggcagggcaaggttttcttggttttccttagtgtggcctgctgtttgtgggtgagttctgtctcttttcacagatcaccttgtaagaccttgcctacaacttctcatttagatttcttcaacatggaggggcaacttatggacacactggtgaagcaatcagagaatagaatccttctagagttttatgaaccatcccccccaatattttacagctgaatccacccactttaatttcatagcattccttaagcaactcactttgagtcttgctaagtatttgacttagttttcttttctttctttcttttttttttttttatggagtctctctctgtctcccaggctggagtgcagtggcacgatctcggctcactgcaagctccgccttccgggttcacgccattcttctgcctcagcctcccgagtagctgggactacaggcgcctgccaccacgcctggctaatttttttttttgtatttttagtagagacggggtttcaccgtgttagccaggatggtctcgatctcctgacctcgtgatccacccgcctcggcctcccaaagtgctgggattacaggcttgagccactgcgcccggccaacttagttttcatagaaataactacttttttttttgacagagttttgctcttgttgcccaggctggagtgcagtggcacagtctcggctcactgcatcctccacctcccaggttcaagtgatctcctcctgcctcagcctcccaagtagctgggattacaggcgcccgccaccatacccagctaatttttgtatttttagtacagatggggtttcgccatgttggccaggctggtcttgaactcctgacctcaggtgatccgcccgcctcagcctcccaaagtgccgggattacaggtgtgagccaccacacctggcctatctttctttttatactcacatttcactattttctatattttttatgtaattacaataaagagtacagccagcacagcacgtttggggataaacagagctgattctcagtacacatagaactcaattgatgaagcaagaagtgcatggcagcctggagagtaatgagcacctgtggcccgtgtgctggtgaatgctcagtggtggggagaagggttgctatgtcctagcacttaccagtttccatggggtaaccactcctgccatggatgacttccagttaccagtgattaaataacctaactggctcaaaaccctgaacgtttaataactggctcccccctagtgggcacgggtgactctagcacaccactgcctactgccttccagtgttgagcagaggacggcctctggcgctggcttatgcaactccttaaagaccagttaagggagtgtctaaaaatcagcatatctcagccataattggtcttcactcagccaccagctcctcctcctttgtgtttctaattcctgctccctggggatggcggactctctcgcttcttccagccaattcccgttctgctgtggtcatcctgctgtccctaccaggcctgcccactcaggcagcccttttaactctcctggctttttattcttcctacagaactcctctgttctgtgtcccagccctttcgggacccactaggcttttggctgactaatttaatcagcattttcagccgaggtgttggcttacaaaggcttcattacctccaagcctggaggacaggctgactcatgtgggcggtttgggtctcagagcatccgtcgctcaaatcctcatgcctgtggttgtctctattgatgggtacagccagctctgattgctgggaaaatagtttctagatccagccactgttcttcttgtcacctgagggcattgcctgatggagggactctagagttgggagtacaggagtggcaggggtcagagtgggactgcagattcttggcatccttttttttttttttttttttgagacagggtcttgctctgccacccaggctggagtgcagtggtgcagtcttggctcactgcaacctcgatctcctgggctcaagtgagtctctcacttcagcctcctgagtagctgggaccacaggagtacatcaccatgcctggctaattaaaaaaaaaatttttttttggagagttggggtcttcatgtgttccccaggctgttggcatcccacaagagtgggatggctgttggctagtaccattctgacgcacagcagagaagtttgtctgagctttgatgcttttgattctactcaaaaggtggtttttggagtcagaaatgtttatgactgtgtctctacacatcgtttgaaattttttattgttaaaaaatgtgtgtcccggtgcgctagatgaatagcagcctgtttgcttttgcaaacatacactccacaccctgagtggggaatatggtttggtggcaccagaaccatttgtgtgtcagggactgaggcaggagaccttgatggaagggagggaaacacaacgggaaccttgccattgagaggctccgaatacaaacccatttgtataacaagctgtgtttgtcagaagacgagctgacttcagaagctgatttttatgctgaagagtagcgtgcggcatgtgtaatgaacagagtttatctttgtgtgggatgagaaataatttgctaagccagtaactcctgtatttcccggatacccgtgcagttcacatgcagcctggggtctggagagcaggaatcgccttaattcacagagctctccaaggacccctgatgtcagttcagatttcagaaattaaaggattaaatgctttctgtgttctctgaagacttgctagcacttgatctgtttcattaaaacgactcctttggtgcagtctctccccaaaaccaatcaagagccactgcggcactgctgaaaccccacctttctgtccagctgttgtctaagcccgaacccagatgaacaccagtgcagagggtgttggagaatcctcaagaggtcaacatgagtattgtattaaacatgagagacacaaaccacagggctcctaacctccccatacccctcctcttgccgaaactaatataatccctggaaaggacagcagtgaacagcggggggcatcatttttatttctgtcctgccaaatcggagttctggatagttaacatggaagaacccctgagccgaaaacatacagaagaatgcttgttattggcaagaaatcctgttgttattaagttactctgcgatctctcttctgggctaattggtgggtagagtgggcaggatgaggaagagggcttaggagaggcctcttgatgccagactagacaagactgaatttctacctttggagaatcagggcatctgatataacaatacaacagtaacaaaggattcagctgctgttaatgggagacttccttgcagactttctcacctggggtttcataagagaattaagccgtacagaaaatgatgtgcgtggccttttctcagtccttctgaggatggtgcatagctagtaccattctgatgcacagcagagaagttagtttgtcaccatggatacctgtgggccaagttagggctgaactcccccaaggaaccctcatgagaacctttcgaccaactgtcacatttaatccttacaaccaccccgagataggtataattattatcaccattctacagatgaggaaaccgaggctgagtaactggctcaagatcacacagatggcaaatggaggaatgaggaccagaactcagatctgtctaacttggtgttagttatctgttcctctgtaacaaattaccccacactgagtggcataacacaacacatgatccttatctcacagtttctgagggtcaggaacccaggcctggcttagctgtgttctctgcttcaatgtccctcatgaagctgcagtcaaagtgtcagttgaggctacggtctcataggaaggcttggctaaggcaggactggtgtccaagctcacataggcctggcagggttcaattcctcacaggttgttggacaggggcctcagttccgtgctggctgtgggtggagaccacctttagttcctggacatgtgggcccttcaaggtggctgcttgcttcatcagagccagcaggggagagagagcctgctagcaagatggacgttcctgctggccgtatgtgaacaaatcacagaagtactatcccattgcctttgccgttctgttggtgagaagcaaagctcacattctgcccacatttgggggccaagggactgcaccagggtatggagcccaagaggtagggataacgcaggggggatcttaggctctccccaccacagatcccaaagcccatgctcaggccttgctgcctccctttgtggagtaggaaagacccaactggatgatgattcaaggatcctccctatgggtcaagaggtttaatcgcactgcctgctttgaggtgatacagttttcattgtctgctacatctctgatgttatcagggatggaattaaaatctcagagccacacttgtgattaaggtatcattaatcatttcataaagttatctttcaaagagagtcggccttcagcagagatgtcagggccagggttgttttgcagaagtgctctcacttgtggcaactaagaagagccagcaattctgccagtggtatctagcctctgtactgcctcctaggggcctggtggccacaaatggaggaaaataaaatcttccaagagaagctgcatcaaccacattacctggaggatcgaatatggcatgaagcagagctctgtgtgcatttctggccaccaagtgaccctggctttttgccagggctggccgaggactgggtttaaatggaaaggaacatgagctatgtgtgtaactgaaagaacatgagctatgtgtgtaattgaaaggccccgtgggatcccagtagggcattctgatgggtgctatagacagtcataaaaaataagttacaatttccgatacacaatgggtggataagatggatcaaatcaaactctaatgtggtcataagtgagatgttccagtgaagggaatgttctggttgctagagaacagccacacactttcccacagaaatggtcagtcacaaaagaactggagaactcttgcggtcatgggtgaagtgcatggaggcacacataacaggagagctgtgataactgaccattactgcacttttctcagataattcagtaggcactgatgggctatggggaggtcagatcacctcagtgcccagggggtctctggaaagaacaaggcagggttctgctcttccactgtgcctgctgaggtagggtacacagcccgagacgggagctggcacggcgagttctggcagccctccagagcattccctagacttggctgttggtgctgaggcctggctggggacccacagtggagcagggagagccgcgaggggggtgccacgtggctctttgggagtgactctgtgtcctgagtcttatgggcatctggcagggtgagaggctgggttctaggggagggcactgcctttgaccctcttcctctctctgatgtcaccttctccttggggctcctatggcttgtcagtcactccccctggctcctcatccctcagggcataggaaaggcccttgggaatgccggcctgcagagcagggatgggcttgaggctgtttccgggaaaggccatggagtgttctgggctctgtgagtgtccgaggggaagctggtggtactgtgcacgctcctctcgccctccctgtccctaaacaggacttcttcctccttccacccttgccctgttcttcttttagaagcatattaacctgtccccactgtccctgtcatccctgtcttcctcttgcccccgccttgagctttattgggacatgccagattatatttgcacagccacgtgcaccccagggatgagtgagaagccacccccacccctaagagctccaggtctggaggaagaaatggagacagctcacggagtgaaatgtaaggagtgtgcatattcgtagggggtgcctggcgatcagagcactttaggggatatttgaatggatggtccctgaaagtgcagtggacagacgggaggacacgtgcccctgagggatggcatgtaacaagcagcagagcaggcaggcacttcgggtgccgttctgtccaccagcatgccgtctgagcataacttcccctctgcaacagggcttatttcctagccaagtcagctctcaggaaagtgtctgcaggtaaggctgatggaagctcagggcttccttcctcagggctgttgttgctgagtgtggctccacgtctgatgctggagtgcaaggccgccccaccctgcgcctcccatgcccatcttcactccgcagcctccctgctgctgaagccagaagcttggtgtcgcccgagtctcctctctccctccatcacacctgcctggatgctcttctgtcttgcagacatcacagtggccctcactggtctcccttttatacccatccccagccattctccctctagaagtcaaggcgctctgtaaaagtgtgtctgcccatgtcacattcctgtcgaagccctggaggactcccagctcttctgggatgaaactcaagatccaaacgtggtctgcaagccctgcacacacgtggggctccgggccatcttgccagccagcatgatggttgggcaccacgtgagtttccaggagctgacctgacaagtttccacatctgggtagcttcaacaataaccatttcttgcctcatggttctggaggccagaagcctgtttccctctttggcttgagaaggaagctctgtttcatacctagcttctggtaccctcaggtgttccttggcctgtcggtggctgtctctttctcgtgtcttcatgtcatcttccctttgaatgtgtctgcctccgtgtccaattctccctctccataaggatgccagtcatcttggaatagggccaccctaatgatctcgtcttgtcttgatcatccgcgaagaccctatttctcaatgtcccattcacaggtactggggtgggactctaacatatttggggacaccattcatcctatagtaggtgccacgtctgctgcgtgcccctgccctctccacacctgctctctgcccttgtgtgagtgtgccaggctctttctcaccgctcgccttcacccaggcacatgtggcagtccctctgctttggataagccctgggcacccagcctgggtagtaccttggcccctctgagccctggtcactgccctcactcccgattccttcattggggatgcctgttctggcccttgacttgtttggagagccctgttgtcacccccacagcccctcaattctcctttgtggtattttcctccacagcctgacccattcactgccaagtccctttgagggcacagtgagaaccaaggccttgcagagggagaggtctgtggggttgcatccaagtccaagggcagccaggggaggtggctgtgggcttcacggggaaagtgtctcatggggttgacccaagggagtgaacttgggctggacgttcccatgagaatgtcaccccacagcttctcagctgcaggaatgcgtcttggccagaggtgggttgggcttgggggcacagatgtctcacctcgcagctatagtggtgtttccaggtagcctgctgggtgccttgtcattctccgcatttgtcactgggtcccagtgagtgactctactgagtgggagagactgaagcagcgtctcaggtctgcccttggcaacaagctgttctggctggggccctcttctgtgttctgtgctcttttccctctcctgggacgaatctcctccctcccagacacctgtcccctgttgcgttcccaccgtaggtgctaccgacgggtgcagcatcctccctgcacacacactgtccctcccgttgtggaagcaaattccctgctagaatattctatcccgccttcgaggcctggatcaaatgttacctcctttctgatgcttttctccacatttgcaatcagagtacgtcattccttctttgccaggaatgtcatgcgccatgtggatggcccttctgcaatgggaactcgtgccctagacgcttatcctctatctgcccctcgcttgactataaagtccttgaagtcaggactgatgtgctgatcaatactttatattccagatgggggatgcccaatggatttgctgactgatctttctggctctgccgtcaggaaacgttaagcagattccttgaagtttagggtcatgggtctcgttcttgagtccccacggcgaagcacggcgctgacagcaggagatggcttagtaggtgtgcatgggacgaatgaacttgttagctgagaagatttaacgtcgccctccccaagttttctgcaatttagtggtgaactcttaaagaacaaagattttaagcactagataaataccattttattcgtggaagcctagagaagtgggagtcaggaaggggaagggaggagattttgtcgggggaagttttcccagtgcccttaaatccactctaagtgccgtctctgctctgtcctcctagctgtgagcacccagggagctccgagcctggtttctgtcatcagattgaatatctgatttgtaagaagtggaaagtccccatctgttgtccctgctccctgagtagagttccaggaagcaacgcctctgcatctacaccgtgttaagatggaggagggcacgctgagccaagcatgggaatcaatctctgaccacttgaatggggctgcccttcctccaggtcaccctcctccacgtcagcctgggggacactagaagttcaaatggatctaagggagcagactgtattcattcattcattcactcactccctcattcatccattcatcaggtgttggttgagcccctcctgtgtcccagatgccatgctgggtgatggggagacagaagtagataggaccagttcctgcaatgtgaaagttcggagtgattgcaatagagccaaacagaccgtgtgttcaaggtcagcccagagaccatgatgggtggcataaaacatggcagttgcttacccatccataggcacctacggaaacacttcctggagtaagggacaaataagcagaggccccaaggaggagtaggaactcaccagccagtgggaaggtggaggagggacaagggcatttcaggtgggaaacaggattgcagaggctagaggaaggagagctggccccggggcgactgggggctggcggttcagcaggagcagcatgtagggtgagaggggctgaaggttgagggaacaggcccctgagggcctcatacatcacccaacctgaggaatttgggctttgacctgaagtgaaatcacgggacagaggttccaggggtccctcctttccatctctcctccccaaagcctcaaagccccaacgcccagtgtgttagtccatctttatgctgctgatagagacaggcctgagactgggtaatttataaagaaaaagaggtttgaggttttaatgaactgacagttccacatggctggggaggcctcaaactcacagtcatggcagaaggtgaagagagagaatgaggtaagagagagaatgagagccaagtgaaaggggaaaccacgtataaaaccatcagattccatgagactttttcactaccatgagaacagtatgggggaagctgcccccatgattcaggtatctcccactgggtccctcccacaacactggggaatgatgggaactacaattcaagatgagatttgggtggggacacagctgaaccatgtcacccagcagtcccgcaaacctaacaaatgcctgcctgtcttcacctcagatggaacggccctgattcagctttccccatccgtgccttctaccccctccctaattcaatctgctgcaagcctctttccaggcagctaatgacacaagggtgtttaattctgaactctgcaatctcaaaagattaaataatggattttgtgatctgccaggctctttcctggatagaatgataagatatcaattggaaaaatttaaatattgatgagttttaacttttgtattgattgggcagtgacatattttaaataatgattcacattaaaaatacaagggttcctattgatcatgcagcatctggttgtattaaaataatgaataatctttagaacttactatgcttttaacattttgtttttcctagtagctgaagatccaaccaatgcatagcttgcaacacctatttggaacctcatgcatctgtctgcccatgcttttctgtcgctgctcaggactgccatttcttttttatgtttttttgagaaggagtctcgctctgtcacccaggctggagtgcagtggcgtgatctcggctcactgcaagctctgcctcccgggttcatgccattctcctgcctcagcctcccgagtaactgggactacaggcgcccgccaccatgcccagctaatttttgtatttttagtagagatggggtttcactgtgttagccaggatggtcttgatctcctgacctcatgatccacccacctcagcctcccaaagcgctgggattacaggcatgagccactgtgccgggtccaggactgccacttctttgtagggtcaggcagcatggggcctgggagacagggggctgagcccgcagacgtggggctagccgagcagctgggcactatgcaaccccaggggaattctctgattgttcagctttttctgggtgcttgtggctccaggggtgaagggaaggccagaggggctttttttttttttttttttttttgctagccggaagccgttcctttaggatctacgatgggaagtcttcaaccgttgcacccagggaccttgctcaccctccttgaagtcacctttactcctcttgcttggacttctgaccatgttgtctcaaagtttccaggctgtctcttcatctgcactgttacaatcctgactttcttcactcatcgctaaaaatatttccctagggccctcaaggagtctcaagactcaggcagttaatgggagtggaactgccacctgctggtgttgatatgtgccggtcaccttgccagcctcttcgcattcattcaccctgcatccgtcattcattcacccagtgcagatttattaaactgactccgtgccaagcaggcacgatgcttgtccataggaagcttagaatgtagaaggggacagatgttaacaaacagttaatgcttgactattaattccaagtgtgatagaaccggcacaggaaacaggcaagaggacctagcctcatcaagggtgacatgcaggaaaccgctaacctagcaggcctgttggttgtcctcagaaagccctcaggcctatccttaggaaggcctcttgcaactttggctcttggctggtgtccaggaacttgattggtaaaccgttctctattctgacataaaaccttcactaaaggattagagcggctcacagtgcctaaactgcttgtacaaaccatgccgtttatgccgagcactggctttccttcttggggtgtggaattttggtatgtgctaagcagaggatgcctacatgacccccagcagagccctgggtgccgagtctctgatgagcttccctggcagacagcactttgtgagtgtatcacaccctgttgctagaggaatcaagtgcgtccggtgtgactcccctgggagagtagccttgaagcctgtgcccggtttccccctacctcgcccatgtgcccttcccttggctcatttttctgtctccttttgctataataagtcttcaccatgagtacaaccatgtgctgggtcctgtgagtcctttcagtgactcaccaaacctggggatggtcttggggttccccaacacgggtggccagggaaggcctccctgctgaggtgacatttagctaacaccttaaggaacagtaggtgtgagatagcaggtgttagaaagcatccttggcaaatccaagagcttgtgcaaaggccctgaggtagcaacagaaacagggttgagtggtcagggctgttggtttggaggattcggtgtgagatgggctaagaaaagtcagatcatgtcaggccttttagccatggtaaggaatttgggttaccttatttctaacttttacagaagccctacaaagtagaaaggattagccctatttttttttttttttaagatgaagtcttgctgtcacccaggctggagtgcagtggcacgatctcagctcactgcagtctctgcctcctgggttcaagtgattctcctgcctcagcctcccaagtagctgggattacaggcgtgtgccaccacacccgattagctccccctcctttttttttttttttttttttttttttgagacaaggtcttgctctgttggccaggctgaagtgcagtggttcgatctcagctcactgcaacctctgcctcccaggttcaagtgattctcctgttcagcctcccgagtagctgggattacaggcatgtttcattatgcccagctaatttttgtatttttggtagagaccacctcactatgttggacaggctgatcttgaactcctgacctcaagtgatccacccacctcggcttcccaaagtgctgggattacaggcatgagccaccacgcccagcctagccccatttttaaagaagaagactataaggtcacttgcccaggctcccacagctggtatgtggaaggacttgccatgaatttgggtccatctggcttctattaggttggtgtaaactgtgattacttttgcaccaacctcatagaaagcctgggttctttccatcagaccttgttacagaccaagacaggacttgagccttcccgagaaaggttaccgagaacactcaagccaggttgctgtctctctctccttttcctctgggtctgctctgtctccaggactcactgctttagaatagtaccatgttctgtcaccactgaggggagggggagcgttttgtgaccaagagtcttatcccaggtgtcagaagttctgcgctggaatcttagctgtgtgaggttcttactccaggcaatacacttaattcctttttgcctcagcttttgtatctgtgaaatggagacattaatagtgcttaatttgttcatttatagttttatcaagatgtaattgatgtaaataaactgtatttagagtgtacaatttgatgagttttgacatctgtatatattcatgaaaccactaccacgatcaagatagtaacacattcatcaccctaaaagtttccttgtgccttgtgtaactcatcccttctgtccctctcccatctctagacaaccacttacctgttttctgtcactatggattagtatgcgttttctagcattttataagtatgatatcagacaatagttgttcttttagatctaccttcttttgtgtgtgtgtgtgtgtgtgtgtgtgtgtgtgtgtgagatggagttttactctgtcacccaggctggagtgcaatggtgcgatcttggctcactgaaacctccacctcccaggttcaagccattctcccgcctcagccccccaagtagctgggactacaggcacgtgcgtcactatgcctggctaatttttgtatttttagtagagacggggtttcaccatgttggccaggatggtcttgaactcctgacatcaagtgatccacccaccttagcctcccaaagtgctcggattacaggtgtgaggcaccatgcccagtcaaatctaccttcttataatcagcatagttattttgaggttcatacatattgtgtgtatcaaaaattcatgccttgtttattgctgagtagtattccgttttatagatatgccacatttttgctatctattcacttgttcgtgcatagattattttctactttttggctattacaagcaaaattacatgtacacatctttgagcatatacctttatttatcttggataaatacctaaatgtggagtggttgggttgtatgggaagtatattgaactttatatgaaaccatcaaagtattttcctatgtgatttttgtgtcattttacttttcttccagcagtgtatgtgagagttccctttgcttcacattcttgctaaccctggggtggtcagtttatttacttatttaaaaatttttagctaatctagtgtatgtgtggacgcatctctaatgacggatgatgctgacagtcctataaacacactcttcccatatatctgttctcaagagctgataatctctccaactgtttgtctgtttgctatccatatatctctcttctgcaatgaagtacatattccaatcttttgcctctttaaaaaattggaatgtattcctattactgagttgtaaaagttctttgcatattttagatatgaattctttgttggatatatattttacagatattttctgagtttgttccttgccttttcttttcttttttttttttgagacggattcttactctgtcaccaggctggagtgcagtggcacgatctcggctcactgcaacctctgcctcccgggttcaagcgattctcctgcctcagcctcctaagtaactgggactacaggcacgcgccatcatgcctggctaatttttgtatttttagtagagacggggtttcaccatgttggcgaggatggtctcgatctcttgacctcgtgatccacccacctcggcctcccaaagtgccaggattacaggtgcgagccactgcgcccggccgccttttcatttttataacagcgtcatttgaagagaaaaggttttaaatttcggtgaagtaaaatttgttgactattttttcatggttcatgcttttggcatcatatttaagaagttaataaaggaagaaatccttgtcaaatccaagatcattaagattttctcctaggtttacaagaagtttagtagttacctcttatagtcaggtctatcatagtttcaagttagtttttatgtgtggtgtgagatgagggtcaaggatcgtcttttcttttttttttttttttcttgctgtggctacctgattattcctgcactatttgttgaaatgattattctttttccattgaattgccttggccccttcactgaaaaccaattcaccatgtatgtgtgagtcttttcctaaactttctatcctgtttcatttttccgtatgtctctacttatgccaatatcatactttattaatatagctttacaacatgtattcaaatcaggggtgtacatattccaattttgggccgggcttggtggctcacgcttgtaatcccagcacttagggaggccgaggcgggtggatcacctgtggtgaggagtttgagaccagcctggccaacatggtgaaaccccacctctactaaaaatacaaaaattagccggcatggtggcacatgcctgtagtcccagctactcaggagactgaggcaggagaatcgcctgaacctgggagggaggttgcagtgagccgagatcgaaccactgtactccagcctgggtgacagagtgactctgttacacacacacacacacacacacacgcacacacactccaattttgttcattttcacaattattttggcttttctaagtcatttttcatttccatatacattttagaaattttaacatcagcttatcaatttctgcaacaagcctgataggattttaattaggattgctttgaatgtataggtgaatttggggagaattgacatcttaataatattaaggtccccttcctccttcccttctccttcaacagagtcttgttctcttgcccaggctggagtgcagtggtgtgtgatcatagctcactgcagccttgaactcctgggctcaaacgatcctcccacttcagcctcctgggtagctaggactacaggtgtgtatcaccatgctcggctgatttttgtattttttgtaaagacagggtctcactatgtttcccaggatgggggaattgacttttaattttacataattatagactctcaagaagtgaaaatagaacaaagaggttctctgtgaggccagggttggtggctcctgcctgtaatcccagcactttgggaggctgaggctggtggattgcttgaacctgggaatttgcaaccaccctgggcaaaaaaatagattctgcatgccttttatccaacttcccccaataataacgtattatatagctatagagtattatcaaaaccaggaaattgacattggcacaatactatcagctagactaaaaaccttactgagatttctgctgtgagtttttttcatgaatggatgttggattttgttgaatagttcttctgtacctattgacgtgatcatatgatttttgtcttttagtttgttaatagggtaaattaccttaattgattttcaaatgttaaacctacattttatcagcctatgttacattattatttttatatatagctggattttatttgttcatatcttttaaatattttaacatatgtgtttgagggatatttttctgtaactttctttccttataacatcttagtctggttttatatcggggtaatgctagatttagaaaattaggagtgaaatgtttcttccgctcctatattctggaaaggtttgtgttgaattggttatatataattgtttggtagcattcatcagtgaaataccagttatctgggcctggaattttctttgtgcacaactttttaactgtacatttaattttaataggtaaaggtctatttaggctatctaagtctttatgaataatcttagtacttcgtgtcttttaaggatttgtctatttaagttatcaaattcattgccgtaaaattattcacaatatttccttattacctacttaatgtctgcaataactgtagaatgtactccctctcatcccttatattaataatttgtgtcttcttttttttcccttatcagtttttctagaggtttatcaattttattgagcttctcagagagccaccgttaattccattgatgtttctgtcaggtatcactgtcctgcactgtcaatatgtgaaaagtcttgtttcatatagtttgtcctttgagaaaagttgtgtaaggtgggaaggtaaatccaatccttgtcctcccatcataggtagcagcagacgtcctccgtgattttcagggctataaaggagttctgtggtgagagagtgggagaactctgttagctctagctgaactgtgtcctttcctgaggttactactcccatgtggccctctcaaatggtggatgttttctctctcacactttttgttttattattagtacaatgatagagtcatagattatttggtaacagttttactatgaaataagttttttaaaataatgtcaactcttgatttagataccgagggtatgtgtgcatgtttgttacatgggtgtattgtgtgatgctgaggtttgggtatggatcccaccacccaggtggtgagcatagtgcccaacaggtagtttttccacccacacctccctccctgactccccccaggtagtctgcagcgtcaactgttcccatttctatgtccatgagtacccaatgtttagctcccacttttaagtaagatcatatgggatttggttttctgttcctgcattaattcacataggattatgacctccacctgcatccatgttgctccaaaggacatgatttcattctattttatggctgcatagtattctattgtgtatatgtaccatatttgcttttatttttatttatttttatatgttctgagacagggtcttgctctgtcacccaggctggagtgcagtggtgcaatcatggctcacttcagccttgacttcttgggctccagcaatcctccacctcagcctcccaagtagctgaaactacaggcctgtgccaccattcctggctaattaaacaaattattattattattattattttagagacaggtctcactatgttgtccaggctgattacaaactcctgggctcaagtgatccttccaccttggccttccaaagtgttgggattataggactgagccaccatgcctggcccacattttctttatctaatctaccattgatggacacctaggctgactccatgtctttgctattgtgaacacatggtagctagtaatcccattactgggtatatgcccagaagaaaataaatcattctatcaaaaagacacatgcaattatatgttcatgggattactagctaccaataatgagaatggtagctctgtcaacagagtaaacagagaatctacagagtgggagaaaatatttgcaaaggatgcatccaacagaggtctaatatccagaatccataatgaacttcaacagatcaacaagcagaaaacaaataacctcattaaaaatgggcaagcgacatgatgagacacttctcaaaagaaaacatacaagtggccaaaacacatggaaaaatgctcatcctaatgaatcatcagagagatacaaatcaaaaccacagtgagatcctacctcacaccaatcagaagggtgattattaaaaagtcaaataaggccaagtgcagtggctcatatctctaatcccagcactttgggaggccggggcaggcggatcacctgaggtcaggagtttgagaccagcccggccatcatggtgaaaccctgtctctactaaaaatacaaaaaattagccaagcggggtggtgggtgtctgtaatcccagctacttaggaggctgaggcaggagaattgcttgaacctgggaggcagaggttgcagtgagttgagattgtgccactgcactccagcctgggcaacaagagagaaactccgtctcaaaataaataaataaaataaaaagtaaaataataacagatgctggtgaggctgtggagagaagggaacaattatacactgctggtagggatgcaaattagttcagcccctgtggaaagcagtttggagacctcttacactcttggtgctgcaggacctggaggccatgtaggcatcttcctcccacctctttttcactcccaggccattgtcatccatctcatttcatcttccctgaaaaccctcctgctgctttgagcctcatgccttcaagcttctaccacctgttgccttttctcattgcaattattacagattgcctgatttgctctccctcattccttgaagattttagcacctggatcgctgtctctttctgactctctatctgtcgtaattcatgatggtttttaatatccacacagagatcctttcaaaacccaggagtaccagcgacattaagtaacactctgtgctgttacaaaccaacctggaaatctcagttgcttaacccaataaaagatgatttcttgcttgtgccaaatccaatacacctctatggtacttacctggctataccccatgcctgttcaaagccaactttttactttctgaaggcttatatctcgcagcccagtgtggctggagaaaaacaggtacctgtgctaactggtcttattttaaatgtatgatccctaccccaggccctggtgctataagattccacacactactctgtccatacctgtgccaaacaatatcatgtggtctcctctttcagacagctcctcttcctcctccacactctcagcttttggccctgcttcttatttctctgggggaatggaacaaatcagaagggaatttctgcatgctcccagcagcatggctgcccacccctctgtgtctgcacccacacggcagccttccttccagttctgtggatgacctgtttgtcctggctgcaaccacccctttccttgtgtgccagatcacattccttctcttttactcaagggcatcactctgcaattattccctctccctccttcaaccttagatgtttcctgtctattggatgattcctatcagcgttcctattgttcataccctatctatctgtagtattccctatcttgaaaaaaaaaagcctttcttattgctactgcctgtctctctccttctgtctgcagcacaacagcttagatgtaccacattgtcttattcattttttctggttactcccctccagttcactcttaagctgtctggcttttgcctttactctgtgggaaaagctcttgttaaggctgccaagtgcaatagttgagtatctgttctcatcttactggtcgatgagtggcatttgacatgactggctgcctcttcctcgtgaaaccgctctgtcctggctggctccttcctcagagactgctccttctttgtcctgctaaccccttaaggctggagcgcccagggttcggtcatcatcttctccgtttctctacccaaatgctccctggtgacctcttagctttgcacactttttacatgctgatgacctcaaatgtgtaattctagccctggctttcccctggccttcagatgcatctatccacctgagtgtcagatatctcggacttaagcgtctgaacaagctgttgattcatcacctcttaccaagctgctaccctaatctttcctgtctcagaaaatggcaactctaacctgccccggtgcctgggagtcatcgtttattgtattttttcttctcttccctcctttaatccatcagcaaacttgtggctccaccttcaaaatagatacagaagccatcaacttattcgaaaccttcactgctttcactagagtctatcccaccctcacctttctcctgaactgttggtagagccctcttttaggatttctttttgacattcatcaccgaatcgctgaaagacccccaccagctcctgttctactcaaagtctagaagaccctgctgggtctggctcttgccacttttgtgacctcagcccaacagaccttacgtccagcagcccagtgtggctggagaaaaacaggtacctgtgctaactggtcttattttaaatgtacgatcccccgctccaggccctggtgctacccagagattctgcacactactttgtctgtacctgtgccaaacaatgtcacatggctccctctctcgcacaagcatctcctgctggcctgctctgctccagctgaagcttgaaccctgcactcctgcctcggagctttggcacttcctgcttcctctacttggtatgccctttcccctgatatcctgaggctccctccctcgtttccttcaggcaatgcctcaaatgtcaccttctcaaggaggctcaactcagccaccctacaaagaacaggacccctgtccccacatcccttctctccatctccctcctctccactgcccggccatctgggggctgctgtgtcttccctgctggaatatcgggcaggtatgtggatgctggttcactgccatgctccctggagcatagaatcatgcccagtttgtcatagggactcagtacattttattttatttatttatttttttgagagacagagtcttgctctgttgcccaggctggagtgcagtggcacaatcatggctcactgcagccttgacctcctgggcacaagtgatcctcccacatcagccacccaagtagctgggaccactggtgcgcaccaccacgcccagctaatttttaaaattttttgtagaaatggagtctcactatgttgtccaggctggtctcatctctaactcctgagctcaagcaatcctcccgccttggcctcccaaagtgctgggattctaggtgtgagccacagtgcttggcccatctttgtagcatgaataccttttagctcatatcctcgattagtgacatagaaataccctgccacagtgtagcattggcatttaaatgccctcctttaatattacgtttcagaaattaaatatgatgactaaaaagaatcacaagatttaaatatgcatttttatggataattagaaaacagtcgatgctaattttgaaaaattcaaactctacagaaatgcataataaaaagtgaaagattgtcttttccatgttttctcccatcccgcctcccacaggcatacacgtcttttgatgatgttgtgggcatcatttctctgtagagataaaacacatacatgccaacatttttaaaaactggtatcttgttttgtatctagctcacctttttttacttacttaaaaatatactgaagatctgctgggcatggtggctcacacctgtaatcccagcactttgggagaccaaggcaggcggatcatttgatgtcaggagtttgagaccagtctggccaacatggtgaaaccctgtgactactaaaaatacaaaaattagctgggttttgtggtgtgtgcctgtaatcccagctactcagtaggctgaggcaggagaattgcttgaacccaggaggcagaggttatagtgagccaacatggcaccactgtactccagcctgggtgacagagcaagactctgtctcaaaaaaatatatatatatatatataattttatataaatttatatttataaatatatatttatatttattatttgtttatttatatttatttattatttatatttatttataaaataaacaaaatatatttttataaatataaataaacaaatatataaatataaatatatataaatatataaaatatttagaaaattatatttataatatttataaaattatattcataatataaatatatatttatatttataattataaaattatattcataatataaatatatttatatttatatttataaaattatataatatatatttatattataaatattataaatctatggtatataaatattttatatatagatatataaatatatctcaaagatctttctatgctggtgcctctagaccttcagaaaaccctctccgaggctgtggtgggtgcccagcagcgattctgctttgcccctcctcctttttccaggggcatgtttgcttattaagctcgcagtttaagagcccctccctggaaagtctggattctcagagcctctgtgacattgcccacttcacacccttcacagaacttttccacacagttttccctttcctcctgtctgtctgcagccttgctgcttgtctgcctgattcattggatgacatattccttggcgactaggtagtgtgtgtcttttgtagtcttgtgtcctccatagttgtgggctcagcggatggttgttgggtggatggacggataaatgggacaatgaaaagatgagcttctcttctgttttctccctgagcagcagttcgcaatgcttcgtgactcaaattgtgcaggtttgctggccgggcgtgagcctttttattttagtccatcagggaaagtggctggctcattcagccacagtgtagcattggcatttaaaaatatatcaagaatgacaataaagattagttaccatttattgagtgtttactctgtgcctaaatgctttatgtacattatcttctttactttttcaacaatcttgtttgaattaggtcctattattatctccattctgtagaacaggctcagagaggtgaagtactttgctcacaaatgcacagctaggtgtcatagggaggtagctaggtggtagcagagccaggattcgaaccagggctgcttgatccacagtccagcttctcaagcccaaccttgtacttctgtgatggggagccaggtttgtgtggaattttgtcttcctatagagactggctgcatttttaattgcagaaaacatgcaacctgtgatgaatagattaacatggcaacttttttttcccctgagaaagtggtactttaatttgcacataacattaatagtgaagagactgtctccagagtaagtagctcccctccacccctcccccaagcccttataggacttcaaaggggtcaactccagctctctcactgcttgatttctttgactgcttttctgctttagcagtgagaaggcaatgagaagatggacttgtgagaattcacccaggagaataagcaactgggtctcaagtgttttgttatgtaagcagtaaacactgtggacagcatcatctactgtttgtcaaactcagccctgggttctacaaaactgagtttaaaagaaaaaaaaagctatctgtggagattttgttaaaggttccacttggttagcatgcttgcaatgcacactgtaacaaagctttaatataattaaattttaaattccatgtagaatctagtgggtaggcagatgtaccggtatgttaaactttatgtcgcttgaaaatggttttcaagtacatcagagggagaccatccagctgtaaaattatctgctttatgatgccgcatcacagctctgatctttttcttttaattaaaaatgtaccttaaagttgaaccatccccactctctgctaccttttcttcctttctgtctaccgacagaagatgaagtagcatgactgttctgtgaaccttcggggatgtttatgcaggaaataacttttcaattaaatattaatttttgtggctcttcagctggactcggcccctctgcaggccaaagggtagctccctctgtatatggtgctgtccaggttgtgaggcctttggttggtcataccttctaacctcttgcagccagttccagaaatcaagagtcatagaaccttgcaaaggtgaaaaggtgataccccctgggctcttcctgacttgccaggtgtgaccggcttcagaaggcatctgttctcacagtggcatgtcagggtcctgctcctgtcccccaaacacctttcttactatagctttctaatgtctgatttcttttcctggagaatgttatctctttaatttgaggtctcattctctgttaaaatatggaccactggtggacagcactcaccagtcattatccccttgtcatggctaacgtctccagatcgcccatggaagatattggatgctggtgcccaggaaatggccttggcagaggggaaaagacatagaagggcacactaggtgcagggattccccagggctggctctaggtgtggctaatgagcagtcgtcagcatcagcacactcagcgttacttttcaaatgagatcagtcctaccatgcacctactctggagtctggcacgcagcaagtgctgggtaaatattagctattattgagattatgaatattttattactctaattataatcagatcctggtaggttcttttaagtatccttctggaacctgccagctggcagaaggatgagagacaggcaatggttacatgactccgaaggcctattgactggtcatcagacgggaatggaacttatggatcatctcatttcatgctcctacttttgcagaacaaaaccaggggcttgtggtagagaagggcctcagttagggacacacagcgagccatggcagagttgggtcctctgacttcccctgcttttttcctgatgtcttggctgctcccacctcacgctagcttcctctgtgctgggaagggcccttgctaagctgcttggatccagctcttcctggtaccccttctgttactttgttggggtgagtgcccagatgttcctctgcagtcttggagagccctgctctactgccagcaccctcccaggctgtgggcagaatgaatggccaaagagggtgtccctgaaccttaaagaaccttccagtttccagcagcctctctgctttctttcaactctgctaagcagccagtaccattcactccctgtagcaggaaaggtccttttttcctctgtgctggaacccagttgtgatgagactatttgaaagcagtggtccacgaactgcaatgatggggagactaccacccagctcggcctccaggtctgtgatgatgggcaggtgatgtcccctctgtgggcagaaggtgctgctctagtttggatgtttgtactcctaaacctgttacaatgggatcctaatgctggaggtgggacctaatgggagatgtttgtgtcacggggtggatccttcatgaatggcttggtgtcatccttgcggtaatgagtgagttcttgctctgttaattcctgtgaaagttcctccaggagctggttgtttaaaagagcctggcacattccttctcttcctggcttcctctcttgccatgctggctccctttagcattcatcatgaatgggagcagcctgaggccctcaccagaagcaaatgctggagccatgcttcctgtacagcctgcagaactgtgagccaaatgaacctctttcctttataaattacccagccttagctattccttttaagcaacacaaacagactaagacaggtgccttccctgaaacacgagaggctggacccattggctttcatggtgcttttgggccacacacattgattctaatttggcattttcatgcctgagctgtctcagtttctccagtctaaggttcacattggggaacctggatctagacttctctccctccaggtgaccccagagggaagacaggctgctggactaagtgcaggcccctccagggaccatgaggagaaggaacaggtagaaaactgagcagagaaaaccacggggtgcagctcccatggtggaaggtggggtcgtcagcagcaaggcggggtgggccgagactcaggcacactccagggagtgagtgtgaggagtgagcccagccctcagaatcctgggctaacagccatccatggtatacaggtagcagcctccattctcatcagatattatgtatttggaaaatgaatcttatcctcaagtattagtcactgcaagaagcaaaaaccttccttgagacactttggaatgttccagagtcaatgttgtttggagtaagatgtatgaaaccaaaattaatgacattttgcacacccagacaaactcctaagtgccacccattggctttctcccatctctgggtgcagcctgcttttctggtcagattattctttcgggcagtgcaggatctccttccgccaggagctccttccaataccttccaacctccaactaacactgaggttcttctcccaaaggattcaggatgccctgggtattgtgtcataccatcttcttaccttttacagtgaggtcattgcagaactactcagctatatagcaaacactccctttcctagtgatgggataaaagtatttatggtctacctgaaaatgttgacttttagggattcagataaagtagttaaatgtcaacttatactaagtgtactaatttcattgtatgaacgcatataaagtcatatgtctatacactaaagtatttgtagaaatatggcttttttccccatcctttaattctgtgaaatagtttctattcaagttcttcctgtgcgtgttgtcatccacaaagccactctgtgtgtcatcaaacacaaggacatttttacttctctgttgtttgagatacaccactttttgaatctaggtatgcaattttaattgcatctgtcttaagtcaggctgccgtaacaaaataccacagactgggtggcttaaacaacagacatttattttcttatgttctggaggctggaagtctgagatcagggtgccagcatggccaggttctggtgagggctctctttctggcttgtggacgactgccttcttgctatgtcctcagatggccttttctaagtgtgtgtgtgtgtgtatgtgtgtgtttgtgtgtatgagtgtgtgtttgtgtgtatgagtgtgtgagagacagcaagagacagagcgaaagagagagtctcttttcgttctaaggccaccaattctattggatacagaccctatctgacctcatttaaccttaattacatctccaaatccctatctccacacagtcacactgaggccactgagggtaagggcctgaacatatgaattttgggggacacaattcaacccctcatgctatcaggaccgatatatataacactaggcaggattagaagatttgccttgtcggtgtagtttgtggcttcagtgttgtgaggacttactctcattttcagaactcgttacgagacttgtttatacagatattaggacttgcaattgtcaggtcacaccactcagaataattactaaaaactgtgtcaaatgtatttgcttccttctaccagtcctgtctggtaatctctataagcatcccaaactagtattgattgacgtcattttggctaatgggtcttctccaaagagtactttattgtttaaagtagagccattgagaatgttccctataatttgaacaaccctaagaattcaactttaagctggtcatttgtcctccacaactacctggtgaggcagcacttgctttttcttcccatgttacaaatgcagacaggaaggccgagtaacctctcaagctctgcagcggttgggaggctgagctggccttgacctggattcgctttcttctagaattgggtccctttcggtgcctcactctgctctgggggaagtaagggagtgaggttcaatgacgtggccaagatctttcaggggacgaggggcagactgagtcctctatccagggcccttctcaaagccatcatggatctcttggaagtattaaccccaaggggtggagatgccgcctctgagctcctgtcaccttcccaggcccgggagggagagcatctttccgcaccgctcctctgcggcttatgtgggattccacgtgcctctttatcttgcattaaataatggttttagtgggctgccagcttattcatctattgtatttatggaaactactaaagacttcaaaaaagggtttaattcaatgtgaggttctatctttgaagaaatttgtttaatagtgcagggaaaattgggcttttaatacaggaggagcagaacctgctctgtaacttcagagagaaaatggaaatcgagacgggaagtaccagagaagccactgggcttggaaggagggtgacttgggaatgagctggagctgggcccaagtaaagcccttcctagccttccctcgtctctgtctgtgtagggaaggcaaagacacaggaaaatgacagcttagtgtccggaaccctggggtcactgcaggagctggactccagtctgattgcatagagctgtagtaacccatgagtctgtgagcacagaggggccgggacgattgcagtcatccgtgtctcccgaaagcacagtgcctgtggcttctaggctgcaagcatgaagcctcccattgcagaggggaagaggctgcccttcagcgaaatgtggagtgggctgaggggatcttgggtacggggttttaaaaaacgtaatcctgggttcaaatccctgtgctgccctctatgacctgtgacctgggtcagtttctttatgtccctgagctttggccttcttgtctatgtagcagagataatctcaaccgtctaggtggtggcatgcatgaatgatagcttctatttactgaacacttactacgtgcgtggcactatgcccagtgctttaattggatcttttttttaaaatgggatgattgtaaaggccgggccgaggatctcccctggggatgggcagtcatggtgcttccccgccctgggcagctgcttattccagaaattgccgtgggcctgcaatcctgcttgcaacacccctcgcagcaggagcttggcagcccctgaacccggtgcctgctcatgagccagtctccctcttggcttatgtagatcaaccagagccttgggatatgagaagttaatttccacatatcctggagggggaagaagcacgtatgaaagaagtgaagagataagaatgtgtaggaaggttatctttcaattaagaagggcagtaatgcttcccatcaagagtcctgtcggggaaagtctgggaatatctgtttcggtgctttgctgagaaccagttaggtgaattctgtgctggtggacactgccgcccagcaggacactcatcaccatggccttccttgaccccggccacgtcctgccggctcctcctccttgaacaccaaccatcaggttgccaggacctgtcccctggggctgggtcctcactgcttccctgggaccggctgtgtaggggttgatgtgggcagtcagagggggtagggagagaagggtttggcgtattgcacacacacaaacacacactcaaacataaaccatgcacacacacacacttgagcatcatgcacacatatataccacacaaatatacaccatgtgcacacacaccacacacacatataccatgcacacacaaacacaaagacacaacatgtacacagacactcaaacatatgccgtgcatacacatacacatcacacactcaaatatacaccatgttcacacacatcacacattcaaacatatgccgtgcacacacacagaaagttacagcacgcacacacgcactcaaacatgcaccatgcacacacactcatacactttgcacacacactcaaatgtatatcacacacatgcacacaaaaacacactcatgtacagcatgcacacacacaaacacacactcaaatatataccacacagccaggcatgatggctcacgcctgtaattccagcactttgggaggccgaggtgggcagatcacaaggtcaagagattgagaccatcctggctaacatggtgaaaccccgtctctactaaaaatacaaaaacaaaattagctgggtgtggtggtgagcacctatagtcccagctacttgggaggctgaggcaggagaatggcgtgaacccgggaggtggagcttgcagtgagccgagatcgtgccactgcactccagcctgggtaacagagcgagactccgtctcaaaaaaaaaaaaaaaacaccccaaatatacatcatgcacacacattcatataccatgcacacacaaacacactcaaatatacaccatgcatgcacactcacacactcaaacatacactatgcacacgcaaacacaaacatacatcacacacacgcactgaaatatgcaccatgcacacacacactcatacatcacacacacactcaaacatacaccacaaatacacatactcaaatatgcaccatgcacacacacattcatacaccatgcacacacacaaactcaaacatataccatgcacacacacactcatacaccatgcacacacacaaactcatataccatgcacacacacaaactcaaacatataccatgcacacacacattcatacaccatgcacacacacaaactcatataccatgcacacacacactcatacaccatgcacacacacaaactcaaacatataccatgcacacacacactcatacaccatgcacacacacaaactcatataccatgcacacacacactcatacaccatgcacacatgcatgcatagaaatatgcaccatgtacacactcaaacatacatcacacatacaccacacactcatacaccatgcacgtatgcacacaaacacacactcatacaccatgcacacactcaaacatacaccacacacacgcacacacactaaaaatacacaatgcatacacacacgacacaaatgtacaccatgcacacatgcacacacatgctcacatatgcaccatgtagacacacactcatacatcatgcacacacacaccacacactcacacatacaccatgcacacacacaaacatacaccaagcacatgcatacacatactacacagtgaaatgtatgccccccacacacacaccacacactcaaacatacactacccacacacatacacaccacacactcaaatatgcaccatggacataccccaaacacacgaatccaccccctccccccccgccacgctccccgccatgctccttcttctccctgtgctgggcttttggaaagagccaggggtctgcttttgttctgaatccccatcctgctgacttgccaccggggtgtctttacctatggggggagtgggtccagtccccacgttgccaccttctgagtgagcaccaaggccctcccattgcagttggatgtggccagccggcccattcagtccaagtgcccaggagcccagtgtgcccttcctttggctctagctcctccctcccccatcaggggaccactggggcactaagtgtggtggcagagggcaccatgtgggctgtgaccacctctctccagcagactggggggtgcctgcagagcactgactgccagtgggcaacattactctctggcctgcctcaccattgggctgtctgttcacttgcttctcccagctcagttgtggtctctgaggtaggtcagagcctgggctggcttatcaccaggtcctgggcacctgctcaggatggagcacagagaaggccttgctggcagctgtcaggggtgcgtgtgtccagtggagtggggcttcctgccctgtgggcacattcccgaggtacgggggcctggtgtttccacaatcatccactcccttccagctgcccagggattggggtgtcggggcgtaggggcttctctgggggtgggtacaagtccctacttgccattccccagctaaactgccactgagtggagagggcggctttccccgcagggaattgggagtcccagatgtctcccttctgcgcttgggaggggtgctcctccctgaaggacagggtttttgcttctgagcacatgggccttttgcttctgagcaggagaaagactttctggcagggcaccgtggttcacggaaggttctgaccctgcaggtgggcttcggcgagactctcacgcaagggactttgctcattttctgcccctctgctgccatcaaatgtagcagaaaaaaatgtgtgtccctctccagccccttgctgtaggaatgccagcttcggctcaggctggtagtctggtttcgtaacggccgtgtggccgcgggtcaggtgcttcacctttgggcctgggataatcatgccacctcctggggctgctgggggatccagtgagctgatttccatgaaggcggaatgttggcgatgcgagtttttagctagtccccgacacacactgagaacaggaaacgagccactgggtgctcagctctccaagcacggccgtccctgagtgctgggggatgggcaggtccagccatgttcccggaataactccggcctgggcggcggccagcaggtcagagctgggccagaggtgccgacggtgcccagggtaaggggatgccgggaagacgttgaagacaaatgtgtgcctgtggggagcagcatgtttatggcaaataaaactcctgataacgattcacgaatcctggcagccctgccttccttgccgtacctgggggcttgtactgccaggggaggcttcgtctcatttccttcactgctggggaaggactgcccaggactcaaacaggaaaactgagcctcggagacgttcaactccaacagggagcagcagccgctgctgttcggtcgcccagcggcctccctggaggagagtccctcagtgatgcctcttcaaaggctctgcgtgctgcccactgtccgtaaggagtgaggcaggtgtggtcagagtgcctggacccgcatcgccctttgcctccccagctgcaatctcacttgctcacttggggggctttggctgagctttgcaggttggcctggaccggcaggtgggcacaggcccattgcacctgactgggtgtgattaaggaaacaggaatggaaatgcttctccaactggaggaagtcagaaagccacagggcatcctcagacgaaacccctgcttcctccatcagagcgggggcaagcagatggggaggggagatgcttttcctcagagacaccaatgcctctacacccaggcctctccatgcaggtgttatggacattccaggctggataattcttcgttgttagggccatcctgggcatggaagcatgttgaacagcatccctggtttccacccactagatgccaatagcacccccgacaaccaagtgtgtctccaggctttgcccagttcccttgaagggcagaatcacccctcaccgagaaccactgctccacccaatgcaaagatgtaactctcggcatgtttaggaccaagtattgggatgtgcagaaggacgcgcaggacgtggaaccctgtgtgcttgggtcgtggccgtgccttccggatgcttcgagggaaatgacctggctcctggtcagacataaaagtgggaagtgtattttccctctgatgttgtcactactggctggtgccgcagacggactcagaaagcaccgtttcattttgctcgagtaaagaaggcaggcgcagagtgctgctcatatattgattgactcatcaaatgatctgctgcagctgcctgcatttgtttacagggcgaaaattaatgccacagatgtttactgtataataggatttgaaatctgttggggggagcacccgttgaaaccattgggccaagaatgagaaaaacactttgcataaaggaggatttggttcactaagtagcacacggtgcttgctgtcaaatgctaacaagaaacatgggcctcctctcccttggccagcgctggcgttcgcgcctggctccctggctttcttctacactgtgctttgatgtggcaccttccaaagtgttttcatgatggagagggcttcctctgaaatgtagcacccgagcctaattaactgatgcgtgattcttcattagcatctgggcaggcctggggcccccagttccctttccttcctcggcccctctttgcagcgggcaaccctggattgcccagcgaggctgcctggcccttgggtgtctgtgtctggggttcccctggtgaccccaccagctcctgttgtgtccctgccttccactgcctggagccaggtctctgaatgaatatagccatcctccgagacgggagctgctttttcttggcacagcatctaagccctgcaaccctgagtgtcttgacggcacagccaattcctcgctatgcccaagggcttttcccaggcatcagggcagacagggacccccagtgcttcttagagcctcctccagaggaaatggctttggggtgtgtctcccagtcgaggacggaggacatggcaggctgctggtgctcctggtgaccattgggaggccctggagggagcctccttcccaggaagtttccttccagtgggttcgagtgtgcatactccgtttgtattttcactttccttatgtttttctcttcagccagctctgattggattcaccacagattaacattttccattatacgttataatgtgtttttttaaaaccaaatctcccttcacagattgctgtctttataatataggaattatttctcagtcactttaaaagtcctgcttcattagcttggtgactgtttggtaatttgcaaagtcactttcgcaagttttaatactgcccggttgaggatcacagcaataaatgtattaggtttgaatagtgttatgattctgtctgaagtgaaaaaattagaatcagtcattagctctgacctcagcatcagcccacaccgtgcaggagatgatgcagatagatgatgcgatcacagcctccgccatgggaagaatcctgggtaaggccttggagccctttgtctcagctctttgccaagactcgaagcagtagctcctacatctccagtaccttccacgtttctgttctccttagagtggcttaaagctcccccttccatataagtctctcatgtctagactcagccctccagggaaggcaaatggagactttgaagcccccaaccttgggctccccctccagcttttttgacagatgatggtacctgctgagagaatgtgaccagaggctttcattgggattttgggggccattctgttttcttcctcctcctgtgttgaggccatctctgagccatgctgagaaaacagggaggttgccaagggcagagatgtccagcccctgctctgaggctgtcaagtgcctcctcagggagaaggggagggtgcgcattgctcgattttgctcaattcccagcaggcttctccacctcccaggaggcgcctctgagtccctcccagcccgagactctttccccctggaagagagggtgggcaggctcggggagaaccccagagcctcatgtggccatgtcgtgtttcatttgccctgattaatttggcatctgtatgaaccagagggagtggtgctcgaccctaacctttcacagatgttccaggccgaggttttctggcaaaatcgattttgacattttgataagaaccgttttgctgtgttctgtattttgaatctttgactctaagctgttctgaaaaccagctgtgaagctaaatcttgtttgtaaaatctgcatactgcatcagcagcagaaaacgccagagcctcgaggtcatttcatagacacttgaagcaagttaggtgggatgcgaggatattgaattgcggtggtttgtcagacttctgccatgggaagcattgtgagagatgcataatgaatgtcttgaaccctcttctgtctcttgcagtgtttggaatgcaaaaaaaattagacctttaatggaaagatttggtattcatgagaaagacagagtccctactacttaggaaacttggttgccttgtaaaacagaacatctgtatcaggagcacggtgatcttttgtcatttggtataaggaaaaaaattaaacattggattggaaacatttgaggtcactgtgtaaaaggcacacacctgctgtccaaactgaagttctcatttgcaagcgttatttgagggggaaaaggagtggtttccaaactgccttagcttccaaagaaatggcttgcttccctgcctccctgcgtacctgcactcagaaggaggctctgtttcctgcttcactgtcggagacctcctgaagaaataacacaaaccgacggggacaagcagagtatgcaaggagaaaggtccagagcccaggcgggagggaaaagatgaggcgagtgaccggcaacctcccacctgctctttctcacagcagacagccagtgggaggtgatctggtgggcggggacattgcagctgccctagggctgcctctgacatgagggccactgcaagttcttgaccctctttgtctttcttccaccgtgggtcccttgcatgacagggacgcattctaggtcttgggagcatttcatgaatgacagtggacatgctgttaaaaggctggatgtggcccctgagaaggctgcatggtgacaccaaacaaagaccaaaggaaccaggagccactaggcctgggctccggccacgattctgctcctggcttcctctgtgatgtgggcacagccatctccctttggggcactgggtgtcctgtgtgtacctggggacagtgggatggatgagcagggccctggaatttccgagtgcctgtggcaagccattgttttctctggagcatcactgtacagttagggtgggtttgtggcaggtacttagagaagtcctagtaggagacagcagatcaaaatacagggagatgctgggatccacccactttatagttaaggggtaccctttctagagtcagaagatgaacagattgaccctggaggtaacccccacccgagactcccgtctgtaggtgttgaggtttgcatttgatagcaggaaaaggtgctattaagatcctggagtcattgataaatgaggggtgcatcagtgaatgagcctgtcttagatttcctctctttttcctttgtgaggtcgatggggtttatcttcagctctccaggcctcctcctctgtcccctttccaaccccgccatcacttcccatctctgggcacttagatctttcactgctgtccacatccctttctggcaggagaggatctgagaaattgactcacactaaggcaataatgaatttatgtgtaatctgtcctgtgcgtgtgatacttgctctaaagaggactggatgaagagagtacgcttgcctgaagggaaggggtgctgatggtggggttccaggcatgtgacacccacccgagttccgggatgccctcctgtcccccacaccagcccggaggctggaagctcttgggaaaggagactggtcaagggcttgtgggcagtctctttgggtttattggactccaaatctttactgtccaggagttaaaaggtgatattcttcctctcagctcctcagggagtccatggtttggctgtggggagagcaggtctgtttccctgcagagcccctccccactccagccgggcttgtgggtgccagcatggagcctgcagcctctgcgtgtgcacatccttcattaaatatctctcctgtcctgtgggcagaacatcccctgaccagtttgcagtctgtccacactgggcccttctccagccaggatgagtaaaaggtacacggctgaacatcagtgccagtgagtgagaggctacagaggcacggaacaggatggtggcagagaggtccctgggaagcctgtgccggggcagcaggggtgtggggggctgtgggccggaggaggcagcatcactgtggacaggcaggaaggtggcctcggggggaaggggacagggcagaatgagcctttcccaaaagtgagacactcaaagcctcgtcatgccgggcagcgcccatccctgcctacctgtcccttttgctgtctcggagggagcctgtgggagggaggtcgagatcccagcctctgtgagggcaccgttgggggggggattgggcagggaaaagagtggcgcccacagagcaggacacggagaagccttgagctggaaataaggaggccaatatctaggcctgacctgtcattaacgagccatgaggcatgaggtctttttttttttttttccaagagatcctcccacctcagcctcctgagtggctgggaccacaggtgggtgccaccatgcctggttaatttttaatttttttagggaagaggtcacaccatgttgttcaggctggtcttgaattcttgagctcaagtgatcctcctacctcagcctcccaaagtgctgggattactggcgtgagccactgcagccagtgagccatgaggtcttgagcaaggccgcccctctgttagaagtccccttctctatgcctcatggttccacagcctggggtaccccagctccaaatgacacatctccctgcgtttgctgtgcacgtgcctgggtgtgggtgatgctgatttctaatgcatttcttcattcattcagttccacatttatggggcatctcttctagagctagctctgtgccaaaaaggaggtataaagataaatagagcaggcgcggtggctcacagctgtaatctcagcactttgggatgccgagatgggaggatcacctgaggtcaggagtttgagaccagcctggccaacatggagacatgtttaatagagacatggccaacatgtctctacaaaaaatacaaaaaaaaaatagccagatgtggtggcacgtgtgatcccaggtacttgggaggctgaggcaggagaatcgcttgaacctgggagacggagattgcagtgagctgagatcgccccactgcactgcagcctgggcaacaagaatgaaaactccacctcaaaaaaaaaaaaaaaagataaataggagagggtctctatcttcaaggaacccccagcctagtggtggaagcagatagatacatgaatggtgaaagttaaagtaatgtaggcaggacagtgagagagacatgtgggatcagagagacaggcgaccagctggcctctgagggccagagagggcttctcatcagggaggtgatgtctgaactgaattcccttcaaaatgagctccctctgacctgcactgactattcacagatattctagggctcctaccttgtttgcaagaagctgagccacacgccctggtgaatacaaaatagggtaaggaattttttggccagttgcctgcagctttgctaatcctgattgagcattcttcataccaagaccaagacgatttcagaagtatctgtagcatgtgtaacttctgtccttttgactgttttggggacgacatttaattttatggcaagcagatcattcattatttcagatgacccggatgggctcatactttgaacagtttagacagtcttgtcttcactgctagccctattcctttcttgctaagtcctccactaccaccgccatactcaccctggcttgctcctcttactgtcaccagtgggttataggccagcagaaactgtaagagacgggctttcagaacaaaaattcccaatcacctctctgttcccaagaaaatcagggatcagaaagaatttttatgcagaaaaaagtatttgacaacacttaacacaaaaattaataataaaaacttttggccgggcgcggtgactcacgcctgtaatcccagcactttgggaggctgaggtgggcagttcacaaggtcaggagatcgagaccatcctggctaacacggtgaaaccccatctctactaaaaatacaaaaaaaattagccgggcgtggtggcaggcacctgtagtcccagcgactggggagactgaggcagcagaatggcgtgaacccgggaggcagagcttgcagtgagctgagatcgctccactgcactccagcctgggtgacagagtgagactctgtctcaaaaaaaaaaaaaaaaaagcagaaacaaagaaacaaaaaacaaaaaaaaattttttagcaagttagggatagaagagcccattcttaatctgataaaaggtagctatcaaaagtctgtagcacaggcaaatggaaactgaaaccagaatgagatataacacacccaccctactggtgaaaattttaaaagactgaggataccataagctggcaaggttgtggaacaacaggaagcttcatacattattgatggggatgtagatggtacgaacaatttggaaaagtacctggcagtttcttaaactaaatatacatctattgcatgacccagcaattcctctcttggacatctaccaagagaaatgaaaacatatgttcacaaaaagacttgtatgagaatgttcttggcagttttactcatagtcactgaaaacagaaagcaactcaggggtctaccaacaggtgagtggacaagtggaggtatttttgtacaacagaatgctgccctgcaataaagagaaacacattttgggggccgggcgcggtggctcacacctgtaatcccagcactttgggaggccgaggagggcggatcacgaggtcaggagatcgagaccatcctgactaacacagtgaaaccccatctctactaaaaatacaaaagattagccaggcgtggtggtgggcgcctgtagtcccagctactcgggaggctgaggcaggagaatggcgtgaacccggaaggcggagcttgcagtgagccgagattgcaccactgcactccagcctgggtgacagagcgagactctgtctcaaaaaaagaaaaccaaaacacgttttggatacatgccacacacatggatgaatctcaaaaatgtcatgcagagtaaaagaagccagaaacaagagtacatgttatatgtttcatttatatcaacttctagattaggcaaaagtaattggtggtacaaaatgatcctaaccatggcttcctctgttgtgggtgatggtgtctgcaatttactgggaaaagacataaagtaactttcttgagtgagtacaatgcctgtatcttgacagatgttggattgcacagtgaggcgcatttgtcagatgtgtcccatgatgcatttgagatccatgcatttcactctgtaaaatttacttcaaacaaacaaactgcaaacaaatattgaactctagctaatgatatgcctttagacttgtactgatgttggcaatttactctgaaatgcatcaaaaaataaaatggatcgatgaatgcacaaaaggatggctggatggatagttacgagatagagcaaatatagcaagatgttaattatagaatccaggtggtggaaacaagggtttcctctgtaaaatgctttcagattttctgtatgtttgatagttttcatagtaaaattttggaggaaaactgagcaatctatctttggattcatgcacatctggtaaaactagattcttaaaaatgatgggaattttatgcacaaagatcaggaaggaggtttccctttgggttaggcttgctaagagtggggctcaaagaaatacccacagtggcttaatgtggacgattctagttcctaagttggggtgaggtgggggtggggtaatgggtcttcttttatttaaactttgtgctttataaatacagaacacacatctttctatgtatgaagtgttacgtactattttttttttaattatatggctcttaagttgttttctttttttaaaggaaatagtggggtctcaggagtagggcagttctgtttttaataggctttaaatggtttgggcctaagatgggctgcctttcatcaccagggtgagctagagttcaggagaattttgaccttatttgattgcaaaacttcaaagtgatgggcattttcagtatgcttacttttcaatgtgagtagaaaaacatacaaaccagaacagctggaatttaaactctggtaacacagacctcaagtccggtcaccttcccttctccctgtcagccagtgatctcactttctacttctccagcccaaacagaagacaggaaatcagactgtcctcacccatgccccacaggctaccgacttccctgtgtgccttccgttctccacctccctgagctctggatcccaccattttttcctcttcatcttcagttttgttttcgttcttgtttttgtttttgagacagggtcttgctctgtcacccaggctgaagtgcaatgacacaatcatagctcactgcagccttgaactcctgggctcgagcaatcctcccacctcagtctcgcaagtagctaggcctacagttgcacaggatcatacctggctaattaaaaaaaattttttttgtagagatggggtcttgctgtgttgcacaggctgttcccaaactcctgacctcaagtgatcctcctgccttggcctcccaaagtgctgggaattacaggcatgagctaccacccctggccttctggacaaatgtagaggatcgccttgcccctccgtgcctacttcatagtattgttccataaagattagaatggttcctggcacatagtacactttcagtaaaaaacttagctgtggctgggtgcagtggctcacaactgtaatcctagcactttgggaggaggctgaggtaggcagatcacttgaggccaggagtttgagaccagcctggccagcatggcaaaaccccatctctactaaaatacaaaaattagccgggcatggtgatgggtacctctaatcccaggtacttgggaggctgaggcaggagaatcatttgaacctgggaggaagaggttgcagtgagctgagatcatgccattgcactccagtctgggcaactccatctcaaaaaaataaaagctgttattattaatgacttaactctccctatcatatatcctttctatatcttcagctttactccccctgtccctccccaaatgtcctgaaattgtccaaagtggctgtctttaccttgtcacctggcccccaccaacgacctcctggttgccatcggacgtttctcagtcctcgtttctttgactatctcggcagcattgattggacactctgagccccgtttttttttcttgaaacagactcttccctaggccctctggagtaccatgcttcctggctttccttccaactccctgaccaccttctctcttctctttgtgacctcccattcctatgctcatcccttctatatttgtgatgctcaagattcagtccaaggcctccgttttccttactttaaaaactttctttgggaaatttcatctatttttatggattttgtttcaatgatgacacacagttctctgtctacagcccaggtagtaccactaagtttcagaacagtaaccccatttgactactgaccacttccccttggattccccacactgttttcctctctcccctgacatgcgtttctcttgggttctctttctcagtatatggtaccatccatttgagttctcctccctgctccaatcagtcagttggtccagtcattcaccacttgtgttgactgtacctctgatacctggaagtcacttctttctctctgtccttcttaagcccatctgagttcagggttccatgatctctttcctgtattgctgcaaaggcttcttcctcttctccttgctccctctcttgccctcctctacttcattctataaacctcaattctgtgtatgtcattccaatacttaaaaccttttagtgcctttcctctgctctcaaacaagatccaaactcctgaatttgttcacaaggcagcactcatgctggctctagcctctttccccacattcctttcatctctctgtgcccttttcctatgggctttcaggtctctgttctctcttcctgcagccctccttctccaccctgcacagttagctcctgctcatcctctagtgctcagcttcacagtcacgccacccaggaagccttctgtgatctgtttccttcactcatgcagcaaatctccattgagggctgatatggtttggctgtgtccccacccaaatctcatcttgaattggaactcccacaattcccacatgtcttgggaggtgattgaattatgggtacgggtctttcctgtgctgttctcatgatagtgaatgagtctcaggagattggatggttttaaaaacaagagtttccctgcacaagttctctctttgcctgctaccatccatgtaagacatgacttgctcttccttgcctttcaccttctgtcatgattgtgaggcctccccagccacatggaactgtaagtccaataaacctctttcttttgtaaattgcccagtcttgggtatgtctttatcaatagcacaaaaacggactaatataagggcccattccatccgggcaccaagggtggagtggtgaaggacgggcaagggtctcattctcagagctgacagccactggggaaaggcagtaaggggcaagcaatgaatctgattggctccaatagtacaatagcaatgaagaaaacagggcaaggtgtgcaacgccaagcttactgtgtgtgtctctctgtgtcggcaacgtcagatcctctcgcctgagaatatctgaactcaaacttgaaggagatgaagaaactagccctgcaaagattagagggaaggacagccctggcaggaggaacatgtagaaggccattgggcaggggcgtttcttgatgtgttagaggaatagaaagaaggccagggcttctggagtatggtgggtgcaggagaaagcagggagctgtcaggtcccaacagttggctggggcaagaccatgtatggtcttataggtcatggtagggagctaggattttatttttggtgcagtggacgccattcgaaggttttaaccaagggagttccacagttggacataatcctcatataatacaattcaaagagtacaatttgatggtttttaatatatttacagagttgtgcaaccattgccacagtgtgtcttagaaccctaatcagttttcatcatccccaaaggaaaccctgtacccatcagcaggcactcccttttccccccagcccctccagcccagggcaaccacaaatctactttctgtttctattagactgatgtattgtggacattttatataaaaagaatcatacaatgggtggtctcttgcaactggctttttaaacttatggtaatgttttcaaggtttattcatattttagcacttatcagtaagtactttgttcctttctatggctgagtaatattttgtggtctggagggaccgtatttcatttatcagctcctcagttgatggacatttaggttgcctcctccttttggctaatacaaataatgtttctgagaatcttcctgtatgagcttctggatatgtgccttcccttcccttgggtatagacataggggtggaattgctgagccatgtggtgactccgtggctgatcttttgaggagctgccaagctgttttccaaaatggctatgccattttatgttcacaccagaggtttagttttgaacgttttggcagttccagatctctcctgccatggaaaatagattgtaggcagcaagcggggaggcaggaggacctgtgaggcactaagggaggctggatgggcctctctgccttcaagattgtgtaacaatagtccctgaaaccatgctgaggagaagagtgaggctgaacaggaatgatggggagtgaataaaccatgtggttggaagtcctgctcagcccgagaatgactgggtgatagtcctggtgccaaagacctagagccacagatgctggtccgagaagaggtttgcagtggtggtttcagaggtggtgctgttattggtggctggaggtgtgggtggccaggctggggtggggggaaaggtcactggatggggggagaccaaggagcgggaggccggggggtgggtgggtcatcatatggatgttgaggtcatccagaatagtggcaggggtggacctggagaggaagagagtgacccaggcctggcagaacagagcaggcagcacggccaggagtccacagatggcagtgatgggaagcgagggacggcagtgatatggaatggcaccggcttccagggaactggggttttgatggaggaagcaggagaaatactttggaattggtaacagggaacaaggaggacatcaatttagctctaggctctgcaatacttggggtatgggagaaaagatggcattttgggagtcctagagagatggggtccttggggaatggcaggtttcatctgaggcctgacctgaaagcaggtggacaacggtgaacagtatgtcaatgatcctctgcgggacccaaagcaacatggtcgaaggattggggagggtgcggggagcaggccagggagggacagtgcctgtgcaggaattcccactatatgctcttagcacctgtcacatccttatcaagctctaccctaattactggtgcactcgttttccctttagactgtacattttgtgttatagagagcatatctttttattccttgctgtagctgcagtttctagcacagatatgctagcacctactatgtgctcaaaaatgttggttgaatgggtgagagaatgctgagctcttcccagatgccatcacaatgccaggatagcagttagctgaggtttggggaggagggtgtatagatttagaggcttccccactcctcgctccccacgtttcttctcattctgactctagtgtagaagtcaagtccatcctatattttatctcagaagttttggcaaataacaaggcatgcaatattgactaagagcctccaggatcccacaggccccagtgggccccattaccagctatttggaagttgaggcagacagactgaattgggtcgttgaaggagtttgccagtttgtggtgggaattgagttgaatttattatcatttttgccagcaaccctttgccacatatttatttaatccaaggattctagagaaagctaggggtttgatgggcaggtggctggatgccagcgtggcccgtgtttgggctggcacccctcactccacttggcgctttattccaaagctgtggcacccctgcaacacacagcagccagtgtcttggggtctatgcccgtgcctaggactggcccatcctgtcatgtgcggaattgggcatctggtcagatctcacaggaaatgctgaatttatatttgcagctttgaaagccagggagaaacagaaatggacagatcatttgaaaattcaaattatttgttccttgtttttgcagcgtttcagccagtaaggtttgtttcaccttcataaaggatgattaatcgaactaagagaagagccctgtctaattgtgtgtgggtgtgtttggggcagtgtgatcattggaacaccaagagaatgatgcagacaaatatttatgccctctttgtttcctatttcaatggtaacatcatctgttaaagtattgctctttgcaggagtatcctgcattagaatgctcgtccctttgtccctttcggaattgtcacttttctttatgagaaagtgtttggaaaagcttcttaaataaaatgtagctgaaaaatgttgaaagcacgacagtaataaagtagacatcactgcctagaaaaaacgatctgcttttgaaaagaaaaactacattgaaactggccaaatcacttcaaatggctagattgcaaaatcatcccaggatggatgaatgttgtcaacatagaaatgagtggttggagatcttcatttgaaatgcattattaattacttcataagatgatacctacagacaagcatagagaataatgtaatgtacagctgtttacccaccacttagctttcttgatcaaatcttaccctttgccccatttaatttgatttcttaaaaagaaagaaaacataatgtatacacataatcttgatctaatttccttccctctggccccagtgatagtgtttttcaccctcatgcttcttttcttttcttttttttggagacggagtctcactctgtcacccaggctggagtgcagtagtgcgatctcggctcactgcaacttctgcctcgcaggttcaagcaattctcctgtctcagcctccccagtagctgagactacaggcacgcaccaccatgcctgactaattttagtatttttagtagatacggggtttcaccatattgctcagtctggtttcgaactgctgacctcaggtgatccacccgtctcgtcctcccaaagtgccaggattacaggcgtgagccaccacgcctggccacatattttcattccaaagtatttgcaatacttttatcacatatttatgtatttattaacaatacatggcattgttttgcagattttaaaagtttatatgagaccatccaatattctcttgcaacattgttcttaagtgttagatccttacagagagatgatagagagagataggggtgtgtgtatgtaataggtattatgtatcttacatatgtatatcataacaagacatacatatatttctagttcacttattttaactgctgtatagaattttattgcattaacatttatatgctagtgtctctctaagcgggggggtgtgtttacttggatactctctttttttttttgagatggggtctcgctctgtcgcccaggctagagtgcagtggcatgatctcggctcactgcaagctcctcctcctgggttcaggccattctcctgcctcagcctcccgagtagctgggactacaggtgcccaccaccatgcccagctaattttttgtatttttagtagagacagggtttcaccatgttagccaggatggtctcaatctcctgactgcgtgatctgcctgcctcagcctcccaaagtgctgggattacaggcgtgagccaccgcgtccggcctacttggatactctcatattcctaaaagtggaactgttgggtggtagagtacctataccttcagcgattatcattgctgtccaagatgtttgtattgatttatggtcccaactacaagtggagtgtgtgatggttcccatttcttcacattcccatcacagactttgtcttcatttctactttccttgctacagtgaggctgagcttcttctcatagagggttattggccatttgggtttcttctgtgaattgcccattcttttccttgctattggattgtctgtcttttagttattgattgatttgcagggattcttaatattttctagaccctgatcttgagtttgctctatgcattacaactgttttcttcattttgatacttttaagaaagtgttcctaatggtgtcttggtgggtagaaattcttagttttgatgcagtttttttttttttttaaattgagatggagtctcactctgttgcccaagctggagcgcagtggtgcaatcttggctcactgaaacctccaccttctgggttcaagtgattctcttacctcagcctgctgagtatctgagattacaggtacccgccaccccgcccagctaatttttgtatttttagtagagatggggtttcaccatgttggccagactgttctcaaactcctgacctcaggtgatccacctgcctcggcctcccaaagtgctgggattacaggtatgagccaccgtgcccggacaatgcagtttaatttaattttattttttatgttagtgcttcttgttcttgtttactaaatctttatcctaatccataaatattatcttctaaatagtttaggagtttggtttggctttcacatccaagttttaatctatctaaaattcattttgtgtaggaaaattctcctttttttccgtgttggaaagaggtgtcccatgcattggatgagtcatcctttccccagtgatgtgcatatgtcaagtctgtccatagatgattcctgtcttatgtcaagtagctgcctgtgcgtagatctgtttctgggccccttatgccatcactgtagtcgtcagtttgtctattcttgtctcagcacaccatcagttcagttgctgtagttcactgtagcttggaaataagtcttcacaggtggttgatcacattctcctctccctcctaccactatatatatgttctgcatttcacctattcttggcctttgctgtttcatgaacattacggaagataatcttgtcaaaatcctcaaattcctatggggagattttgattggaattacattaaatctgtcagtttggtgagaattgacctatttaggatattgagtcttcttttttaaattaattggttaattaattaattaattaattttagagacagagtcttgctctgtcacccagtctggaatgcagtggggtaatcatagctcactgcagcctcgaattcctagcctcaagtgatcctcccacctcagcctcccgagtagctaggactacaggcatgtgccaccatacccagctaatttttacctttttggtagagacagggtctcactatgttgcccagactggtctcaaatttctggcttcaaacaatcctcccaaagtcctgggattacaggtgtgagccactgtacccagctgagttttctatctttgaacagaagatctatcttaggttaaacactaataatttattcttataaactttagcttttaaattgcaattatgtgttattttaaaaagtatattttctgtttgttgctattgtatataaattaatttattttttgtatgttgaccttatgttaggcactttggtggaatcttttaatactttgcctctagattctttgaattctatgtagataattcacactcaatgaatattgagagttctttcttcattctcaacccttagagattttatttcttattcttgcattactgagcagattagaacttctgttgtactagacttctattgtattagaagttctttttgtttgtttgtttgtttgttttttgagacagagtcttgctctgttgcccaggctggagtgcaatggcacgatctcggctcgctgcaacctctgcctcccaggttcaagcagttctcccatctcaccctccctagtagctgggattacaggcgtgcaccaccacacccagctaactttttgtatttttagtagagacagagtttcaccatgttggccaggctggcctggaactcctgacctcaggtgatccacccacctcggcctcctaaagtgctgggattacaggcgtgagctactgcatccagcaattgtactggaagttctgatctgcacagtaatgcaagaacaagaaataaacttgaagttctaggacagagaacaagaatagaactagaagtcctagtacaacttctagttgagtagaaatattaatagcaggaactcttgcctcatgtctgattctaaaggagattcttctagtgtttcatggttaatagtaatatttgctgtaggggttttatttgttggttggtatagtataaactctttattagatcaaggaaggtttcttctattttagtttgctaagaattttaaaatcacaactggatgtttaatattattgaatgcttttaatgtcactagtaagaataatcatatactttttctcctataatctgttaacattatgaattatagttattttctaatattaatctaactgtaatcctaggataaacccaacttgttcatggtttattatttttagacattactggatttggttttctaagattttgtttaggagttttgcgtctatgttcatgatttataatggcttctatatttcttttctcatgatattcttgtcagacttaatgtcaaacatgagtttgaggccatggaataattatgctgtggaataatttgtgtaagatgatgatttggattgttacctgaatatttaattagaactatttaagtggtaccatcatctggacctggtaatttttatctactgcttcttttttgtgtgtttacaagaatattcaggtttttatattttcttaagatggtttagataagtttttttaataatttgtcaatttcatttagactttttttttgttgaatggagtcttgctcatgccaggctggagtgcagtagtgcaatctcagatctcagttcactgcaatctctgcctcccaagttcaagtgagtctcctgcctcagcctcctgagtagctgagactacaggcatgcaccaccacactcagctgatttttgtattttcagtagagaagtggtttcaccatgttggccaggctggtctcgaactcctgactggacttgagctgggctcaagtgatctgctctcttcaacttctcaaagtgttggaattacaggcatgagccactgtgcctggcctaagcttctaacttattgtcatgatatagtcatatatcctctcaataattttttaatatttgaagcttctctggttatgttcttttcactcccaatattatcctttttaatcagaattttgtcaactgtattgttcttttcaaagaaccaacttttgactttgctgtttgtatctattttagatttgtttcctgttttgtgaattccgtttttatgctgttttcctactttctattctttgaatttattctactttccttcttctaatttcttaagcaggagcattggttcattaattttagctttccctcttttctatatgaacatttaaatgaacaattcctttctaaatatgttttagcgtatgttccatgtgttttaacatgtagtagtttgattatccttcagttcgcaatgttttttaacctccattatgatttctgttttgaattgtataaaatgggtttctttttttttttttttaattttactttaagttctgggattcatgtgcagaatgtgcagatttgttacataggtatacatgttccatggtggtttgctgcacccgtcaacccatcatctaggttttaagccctgcatgcattaggtatttgtcctaatgctctccctccccttgccctccaaccccgacaggccccagtatgtggtagtcccctccctgtgtccatgtgttctcattgttcaactcccacttctgagtgagaacatgcagtgtttggttttctgtttctgtgttaatttgctgagaatgatggcttccagcttcatccatgtccctggaaaggacatgaactcattgttttatatggctgcgtagtattccatggtgtatatgtgccacattttctttatccagtctatcattgatgatcatttgggttggttccaagtctaaaacatatttcttaatttccaaacatatagggttttttctgggatctttttgttaactgatttctaatttaagttttggtctgtagttcacttcattgttatttggacaatatgatgctagcggttttgaaattttttgagacccagtattggttccagcaaatatggaacatggaatgttttccattttgtgggtgccatgttctaagtgtttgtcgaatcaagtttgttaatcatgttattcaaattttccttatttttcctgattttagtttcagtttgacctatactgagaaaagtgccctaaaaatctccccttttaatggtggatttgttcagtttctcctggtcttcccttcagagctttcctttattgactacttcacttttgaaaaatgttttcaacctgttctcctggaacgtgaggaaaatgcagcttgttccttgttccatttgtccagtggccagttcaagaaaggttggacccacatctatcatttccatcagcagtgagctgttcagagtatgtgcaattgccttggtttggagacatggctgcacacatttaggactctggctttgctcaagctgttcccctgcacagaatgcctttaacctctcccttttccctgccccttgttcacctggtgaactctttctctttccagccctgctcaaatgttacctcctattacgattatttgtttccacttctgcctcccccagtatctcagggccaacacagaccaagtggtcaacaagtatttattggactgaaatagtttctgctcttaagggactcttttctatgaattattctcccctgcccccaatcaaatccatcccttaaattttaaaaaactgagatgaaattcacataacataaaattacccattttaaagtatacaattcagtggcatttagcacgtccacgatgttgcgcagtcactgctacctaattccaatgtgctttcatcttcccaaagtgaaagcctgtacccacggctcaggcagtccctccctggtccccctcctacagctcctggcaggcactcagctgccttctgtctccatggatttgcctgttctggatgtttcatagaaatggaatcatataatatgtgaccttgttgactggcttccttcactcctcatgcagtttctgaggtttgtctgtgttgtcgcacatgtcagtgcttagttcctcttcgtggtggaataattgtctattgtactggaccacattttgtttatccattcatctgctgattaatatttgggtagtttcccatccctgttccatttttccttttctctcactcagccccatcattcagcattttgcttttcattgtcacgggacaggttcaggttgaatcaagtggaggtggagatcttgtcctgtgacttctctttttttttttgagatggagtctcgctgttgcccaggctggagtgcagtggcgctatcttgcctcaccgcaacctctgcctcctgggctcaagcgattctcctgcctcagcctcctgagtagctgggattacaggtgcctgccaccacgcccagctaatttttgtatttttagtagagacagggtttcaccgtgttggccagactgctcttggactcctgagctcaagtgatctgcccacctcggcctcccaaagtgccgggattacaggcatgagccactgtgcctggtccccaatgacttcttaatccaggagagcttctagggaggtgaaggtatgcggagcatgaacaacagcatgacaggccttggaatgatcatggtggtcaccaaagggggcagggcatggagcgacttaatgagcacagagagcctgaatttctgcacacacatctgatgagggatgcccagcctggggatgctctgtgatctttaaacaacggtctcactgggcagctgagcctctcagccagcctgatgttttcattcttgccaggctttccctggggagacaggaggacactggactcagcagaaagaaggacatttgcttgctaggaccatgcccgtgatggctggcatccccggggccctggagggtgaggcgtgaggggcagtgacgcaaatgcacgatctcctctcatggtgggtctttgcagactctccgtctgctatccccaaggtttgggagcagccaagtgtttaatgatgttctgcaccagcaattttagactctcggagctaaaattagatcccttcctggtgcctcggggaggatgggctggctgtgtccatccatcccgtgctggagcgtggctggggacaggctgtgcgggaggcgcaggggtgaggctccgaagcaagagcagccagacgctgcgtccctcctgtctcttcagctgcgccttcctcaggagagacagaaagagcctttggctgccctctgtcctcttgagggtcactatgtctatgtttgcatcccagctttacagcttcccagttctctggcctcaggcacatcatcctaaactgggcacgataatccccctgaggcggagttgtgagctgaaatgaacagaaggcagagcggggtgcagggcctggccgtgactgaggctccacgaacgctggctcccttcttaaatttttgtggaactgtgggaacacacagtttaatttttttttttaagactgattttcactctagtcatccaggctggagtataacagtgtgatcttggctcactgcaacctctgcctccagggttcaagcgattctcctacctcagcatctcaagtagctgggattacaggcacgtgccaccacaccaggctaattttgtatttttagtagagatggggtttttccatgttggccaggctggtctcttaattcctgacctcaggtgatccacccacctcagcctcccaaagtgctgagattacaggcgtgagccaccgtgcccagcccagagcttaatttttttttttaattatttctttctagccttctttacatggtccctggcttgactgggggttgggaggtgcaaggaggaaggtgacagttgactttccttcctacaaaaactcaacatggctcagtggactggaccccagcagaacttagcagaacccaaaaaggcccagtggaacccaggggacccacagggactcaacaggacccagcaggtaccaacaaaacctagtggaactcagaggggcccagcctttaccatgggttacctttgacaccaaggttcccccacccctacccttcaagatacctgggtacctttccttgtcattgtgactgtcaagccctctaatcagtccacacgagagcccctccactcctcacctcccacctccctctccctgaggaaaaacagctgatcagggagcagtgcaaagcaagctctctgggccttatatcccctgaaggagcagctctgtcaggccgggaaaatggttgtattattcttctgcagaacttattagattagaaacttagtacaaacagccccagctgcaaccgctatacatagtcactatcaacaaggaaaatttatgctttaaaaataaaaagaaactcaagtgcattagtcagagtgaggaagcgttcacgaaaaaaggtttgttctccaagtaaacagccacaatggaattgtaatcaaatttcttaattatttctataaatcttgggaacataaaaatacacaaggccctttttcaaaaagtcactgtttgcaagtgccttggatgagagaagaggtaaccgaaacagctctggcatgactggaagattccagaaggggtgaagccacgattcgggagctgagagcacattgcctcgtcacagaccaggagcagaggctggggggaccacttctgagggggcgccacgagagccgcatttagggcgactgcataaagaacctgagacccagttctgcagagctcagcttcctccagtcacgagaggccgtggacgagcaggaggcaggtggccctggggggcctgggaattgggaggagttagagctgcttctagggaggcaggagaagctgggcatcattggtgccccacggcccaggcgaggcagaggtgccctgtctgtcctcgtcaggcaggcagcttgtgggtctgggatggtttttccctgctgtgtgtctaaggcagaagagattggcctgacatccggatgtcccatcatgcctttccccaggattagggagcagttcttttataaactatgtttgaaactaatttagaaaattagaaacatagaaaaaaaatgtcataagttatcttggtacatcctggtgtgtgtgtgcgtgtgtgtgtgtgtatgtgcgtgtctgcaggtgtgtaggacaggaaagtacaggagtgggagggtcaggcactctggcccatgtgcccaagcacacacttggatgttggcacttttcaggtgtccaggtgttgcctcttgtcccagtggacactctgggaaggacaatagacagggtcgttgacatctggccacggtgcggctggcagttttaatgccatagaatatgtgatggagacagatgcatgtcaataacataataaagatatttttccatccacaaatgtctgatattggaattactattcttctgttttctgttctgctataacctgcttaactcttcaagaaagccagagtatcttgtttgaacagttggccacacgctcgcatgataacacaattccattaaaacattcataccttcagcagaaaggcaccccgccaaatgctctatgtgttgtattaagccataagcagaattaaagtgcggaatcccagcctttccaaatagtgcaggaattgcgtggggggctgcaggctggggaggagcaggcaactgcactgttaaaccccaggtccaaatcctgcagccaccccagccgcttgaagcggggtatcccctgggatcaaaccgttagtccatcaaacactgccttagtgcaaagccctgtccctggccgaggcttctcccctcccctctgggcagtcctcagctgagcagagcaggtgcccttgtcctttcagcccccaggtatttgcaggtcctggactgacaggctttgcctgaagccatgtgggtttcagaaaggctctttcctgccgatttacactgtgacttcacaaataagctattttcatggtcattgatcttgtcggtggtccctcacatttccccagatcatctctaagcaaactctgaagtgggtcagcaaagcagctccccccagggagggcagcctggagctgctgcagctcccaccacctgaccttggaggtatgcacctcacttgggctattctgacctcagattcctcctcttcggtaattggggtatagcggggatagatacctcttgattcatgttaaaacaatgtaatccttttgcaatgtgatgagctgcccctgctgcattttgtcagatcagagttttgcaacaaggactctcttaaagtgagatgcacttgtcactgcagctggatctttctgtccgagcaggaggagcagcgtgaaggtgaaactgaagggaagaagaacccacactcaaggcattctgagctctgtggtaaccagaagccctgggtgactggggtgcttgagggagatgtaggctgctaactccttccactttggtgtctgtacagagggagggaccttttccaagggaacaatgcctttatgttctggaagagttctgtactgagcccatagggtatccttaggcctcggagtcaggggcctacacatgctaaactccagctgctctttgagtctagacactcgctccagctccaactgcttctgattctacagctcgttcgcactttttcctggttgccctgggttagccattgggatagacagatgctgagggcataggagcactcacgggtttctactctggatccttccatagcatatttaatcaagacatttttgcaagaatagatgaattgggaggcagtatagtaaagcaatgacaatgtgaattgtagcaatggtcaggccacccctggctgtgccatcttgggcaggccctgtgaccagtgtccacaggagagattgttgtggaccaggcctggaagtggcatgcatcatttatgccacttcccactgggcagaagtgagtcacaaggccccactagattgcggagaggctggaaaatacagtttaaaaatgtgcccaggaagaggaggaggaaaccacattgctgagcatctgcataacggggtgcctggggctggctgggcaatagaccatgccccctcccctcacaaggcccctcctacccaccaaggctccttcccacagaggcccctcccacacactgaggcccctcccacccatggaggctcctcccacacaccgaggctcttcccacatactgaggcccctgtaacacatcaaatctcctcccccatgccaaggctcctccccacacagtgaggcaccacccacacaccgagtcccctcccacacactaagtccccttcccaacacgcaggctcctcccacatgctgaagcctctcccacacattgaggtatctcccacacactgaggcttccttcagcacatcaaagccctgtccacataccaatgcctctcccccaacacagaggactctcccacacactgaggcccttctcacacacacaagtcccactcacacagaggcccctcccacaccctgaggcccccccacacacactgaagcccctcccacacactgaggcctctcccacacacaagtccctcccatattgagacccctcccacatactgagacctccagtgcatcaaaactctccccataccgaggcccctcccatacactgagactcctcccacacactgaagcccctcccacacattgaggcctccttcaacacatcaaaaccctgcccatataccagtacccctccccacacacagtcccacacattgattaccctcccacatactgaggcctctaacatgtcaaagccctgcccacacgccaaggctcctccctacacacagaggctcttcccacacactgagccccttgccacacacagaggctcctcccacacattgaggctcctccccacacactgcgcctcctccccatacactgagccccctccctcaggcggaggctcttccgacacagaggctcctctccacacacggaggctcctcccacacactgaaccccctccccacgcgtggaggctcctcctacacactgagccacttcccaagcactgaggcctcattcaatacatcaaagtcccgctcacatgccaaagcccctcccacacattgacctgcctctcttcctgagaagtccctcctgaggaaaaggcttgaacacttaaaagaacaaggaggtccgttctcttttctgtatagcttttgttcctctctctgtgctcagggctgccagaactggtgcagagtgtagggccataggaaatatccctcactatttctccccaccatgctctatctctgccactatttttaaaatgctcttttaaagggtttgtcaacagttatcccccgtttgtctctgccctgatttatatttctagtgactattaattgcctaccaaatgaaggctcagcatttgtaattaggctggcaaattctacctgacatcttcggctctgtgttggggcaggaagggagcatgtgttaatggtgttgaactaagccacacccctcccccagcccgctgattaaccccaggttcactaatcaatgaagtctaactgattctctttgcatttacatcctgccttgactcttagccaagggctgagggctttggttccaaaatgctttctatgcccagagaggatgcctctctgccttgttcctgcagaaggaactctcaccctgaatgggtagggtgggggttccgtaaagagctagagggagaagggcacttgcggagtagccaagctgcagagagctccctgtagctgttctggagaatgaagccctcctcagcctcctttataaaaagtctgccataattcagctgaacacaacatggtaccaagaagccacaacctcagggatttccttggttttctgttctgttaatcttttcaaaacacgattggattggaagcatccattctcagccacagcaggttgcttggcagtggccgtggaggagctgtccaggatgctggctgtgtgaaccagggaacagcccaggattcatgtatacttattggcacaattggtgccctaagtgaggaacaccagtaccaacatcccagggtgtcttcatgaccaaggcgaagcatctctgtgcccctctgtggtcattgcttccaaatacatgaaaggacaaatgatgatatgggttctgccttgcccacagcaggtgctcaatgactacactcagaaaaatggctgctaataacaattcaaaagagttatatatcagtcacgaatatctatgcatgaaataacacaggaaccacctttataaagcagatactgcaaaagaaaccaggaaatgcagagaaaaccactaataatgggaaaatttaacataccacattcagcacaaggcagatgaagtggaaaaaaataacaatggaatcaagaagataggtattatggagatatagatatctttatgtatacatttatgccacaataatatagaatatactttcttctcaggtatacatggagcatttacaaacagttatatattagctcacaaagaaaatttcagtaagttctataaggtagaaatattataaacaatactttctaaccacggtgcactaaaactggacattattaacaaaaagatgaaaataccctatcatctggaaatgaaaaacaacctattaactcttggatgaaatggggaaagcaaattaaaaattaaaaaataatcataatgaaaacactacctaccagaatgtatgagatatatttaaagcagtgattggaaggaaattcatatccctaaatgcttttattaataaaaacacaaaaatgcaaataagtgaactaagttcttaccccaaaagctaggtaaagaaacacaaggtaaaccaaaagaaagcacaagaaacataatagtaaggataaaagcagaaaatagtaagatagagaatgaaagaacagtagacctgattagcaatccctaaatatgggtttttaaaacattaacaaatgaatgaaacccttgctagcataaaaaatggagagaaagcacaaatatatgaaataaatgacaaaagagacataaccattgacatagaagacatttttaaaaattatgagattaggccgggtgcggtggctcacatctgtaatcccagcactttgggaggctgaggcgggtggatcacctgaggtcaggagttcgagatcagcgtggccaacgtggtaaaaccgtgtctctactaaaaatacaaaaattagctgagcatggtgtcacgttcctgtaatcccagctacttgggaggctgaggcaggagaattgcttgaactcgggaggcagtgagctgagatcacaccattgcactccggcctgggtgacaagagcgaaactacatctcaaaaaaaaaaaattatgagattattttgtagacctctattaaaaatatgaaaacagtatcaatttggtataggaagcttaaagcttaaataaaccaatttccataaaagatctagaaaaaatcctgaaggaactaccccaaatgtcactagacttttttttttttttttttttttttgagaccgggcccccctctatcatcctgaagtgcaggggtgtaataacggctcactgcagcctccatctcccaggctcaagccatcctcccacctcagcctctcaagtagttgggaatacaggtgtgtgccaccacagttggctaatttttatattttttatagagacggattcaccatgttgcccaggctggtcttgagcaccggggctcaaacggtccatctgtcttggcttcccaaagtgctggtattacagatgtgagccaccacacctggtccaaactttcaaagaccagatattcttcattctttattaattgtttagagaatcgaaaataaatgaatgttttctaagtctttcttgaaagtaagtactacattgacacctgaatctgaaaaggcaagtaccaaaatgaaattacagaacaatatcacttataaacttataaatattgaagtaaaagtgctaaacaaattattcgtaaactaaccaataccgcaataagaaatcaatgcaccatgaccaaatggtgtctttttcccaggaatgcaaggttggttcaacatgaggaaatctattagtgtactatattaaggtatctaaggaaaaacataatgattatctccataaatactgaaaaccctttgaaaaaattcaatatgcattcctgatatatcattgaagaaaataggaataaatagatgcttttttaacctgaaaaaatatttgaatcctaaagtcaggatgcttgttgatgggaaaacactagaggcatttccacttaaagaccaggatcaaggcaaggatattcattatctctgctactatcccacaattgtactggaggtattagcaattaggtaagataaatcagttactggcatgaatattagaaaagaagaaccagaactatctcagtttgcacatgatatgatagtatactgggataaccctagagaatcaatgataaaagtaaattaaacaataaaatcattatggtagcaggaaaaatttaacatatagaacttattaactttcttgtacataaataagaaccacataaataaccagtttgaggacgcaatagcaacaaagaagatacttaggaataaacttagaaagatatgggcaaagccttgataagaaacatttttaagctcttctgaaagatgtgaaagtagtcttgaacaaatagaaagacatcccttgattttggatggattgatttaacatcataaaaaagtttgtcccaagttaatttatgaatttaacataatcccagagaaagtatcagtaagtttttttatggagctacacaactgatacttaagttcatatgaaaagacaaacatgcagtaaccacgataaccctgcaaattaagaactactgggaggaatagctctaccaaacattaaaatgaactataaagcctctataattaaaacagtatggtgaaattgatgcatgaatattcaaaatagcagtagaattgaatagaaagtcttgaaatagaccccaagttcatatggaaatttagtatatgacaaaggtggtatctcaaatcactggagcagagattaccttttcaatacattgttccgggatgaccaggcagcctttggaagaagataaaattaatgcataagttccagtatacacaagaaaaactccaaatggattgagatctaaatataaaaggtgaaatcataaaagtactagaagtggctgggcacagtggctcatgcctgtaatccttgcactttggggggccaaggcaggtggattgcttgagcccaggagttcgagactagcctgggcaacatggcaaaaccctgtctctactaaaaatacaaaaactaaggtgggaggatcacctgagcctggggaggtcgaggctgcagtgaaccgtgatcgtgccactgtactccggcctgggtgacagagtgaacaccccatctcagaaaaaaaaaaaaaaaaacactagaagaaaacatgggtgagcttttctgtaacatggatgtaagaaaaggttttctaacaatgactcaaaatccagatgtagttaaagaaaagattgacaagtttgattacaaaagtccatgataagcacagtcaaaatgcaaatgactttgtaggagaaggtatttgcagcatatatcagaagtaaagggttaatatccctgatatgtaaagagctgttatcattgaggaaggggtacttgatagaaaaaatgggcacaagacatgaaagataattcacatcaaggatatacaaatgtcctttaaacaaacgaaaagatgttcaacatcactcataattagagaaatgaaaatggctttgagctgtcatttttaatctgtcagattggcaaacatgaaaaagcaaggctgtgaagagacaagcaatcccacacattgctgggggactgcaaatgggcttagcccttttcaagggaagtgtggcgattgtactcgtctgttttgcattgctataaaggaatacctaaggctgggtaatttataaagaaaagaggtttgttttggctcacagttctgcaggctgtacaggaagcatggtgtcagcatctgcttctggtaagacctcaggaaacttttaatcatggtggaagggaaggggacctggagtgtccgatggtgagagagggagcaagagaaagaggaggaggtgtcatgtaccttttaacagccagctcttctgtgacttcgttactgaagggagagaccaagccttttttgagggatcccccccaatgaccccaataactcccatcaggccccaactgcaacttggggaccatatttcaacatgagatttggaggggacagatattcaaaccatatcagcaatatctatcataactgcttatacatttacattttgacccagaaatcccacttctgggaattcacccttgaagatatacctcaaaagtatgaacatccccacccacaaggttatccactgcagcattacttgcaattccaaaatattgggaacaacctgaatgtccaaacacagtggggtggttgaataagtgctggtgcataatgcatagtacatggcacagtggatactatgcaactgtgaaaaagaaagaggatggtttctatgaactggcatggggtgtatcccaggatacactagtacatgacaaaggcaaagagcggaagagcatctgtgggtgggagtagggactgaaggcaggtgagcatgaggacagttcttggtgtaatgctggtgagagttgcacactctatgctttcttaaatctcatcagactgtacacctatagtgagtaaatttatgatatgaaaattgtacctaaacagagctgttaaaaggacatctttattatgccactgtttcatattaaagaaagtaaaataactttatctgcagtagccaagatttggaagcaacctaagtgtccaccaacagatgaatgaataaagaaaacatggtacatctacacaatggcgcactattcagccataagaagagtgagatcctgtcatttgcaacaacatggatggaactggaggccattgtgttaagtgaaataagcccggcacggaaagacaaacttttcatgttcttgcttattcatgggaactcaaaattaaacaattgaacgcatggagatagaaggaggatggttaccagaaactgggaagggtagtaggggcagtggggatggttaatggctataaaaaaatagttggaaagaatgaatgagacctagtatttgctaacacaatagggtgtctatagtcaataataatttaattgtaatttagaattaactaaaagagtataattggattgtttgtaacaaaggataaatgcttgaggtgatggacacaccatttatcctgatgtgatttttacacattgcatgcctgtatcaaaatgtctttgtaccccatgcatatatacctactatgtacccacaaaaattaaaaattaaaaaaagtaaaaaagtaaaataagaaaacatacacagatctgtgtagtttagtaaaaaagaaatataggaaaggtgagttagaatctaatgagattgattactgatggggttgttgggaccagggttgaaaggatgggaggatgggaaggagacaggagacagaaagttagatttctctgagtatatctgtttatatgcttttgacattaataatcttgtcaatatttcaaactaaaaacatcatgggctagagacgaagcctaatgtggaataaaaacagaaacaaacgaaagcagccgtatttcaaatggataaaaagccatgctgaaagttgggggcagctccccaagtaacttttgggctctgtattttggccatgtaccaccagtctaataagaggaaacaactgtaaaagaaaaatatatggctactgtagtagggtttgttttttcaagtgatgtggattagcagttctgaaatgatttatattcaagattgaagaaatatgtaaatgtattataagtaatgggagccattttttcctctcaatcagtgaagggagttacacatatggaaaggtatagaaggctagaattagtcctgtggtgttgggttggaatttgaggtatcagtatgaacacatatatacacacagagagagttctagaaatataaatgcatgtattaatgtagcagtctgctaagatagcctagaggcaatgatgtctcagtagtaaacctaccaccctgatttttttcttaaataacttctccactaaaaggtagcagggtgatatggttaattctagggttagggcagagacagtacaaatgagcctggaaaaattttgaccagaaagtaagggagagctgacacactcatggagatgtggtaaaagacacagagccaggcaactactggtcagagctgtaataattgagcgtcaaaattaatataaataagtgaaaaagaaggaatagtgtttcttatagtagattgaaaatgtagaaggaatttacatagtcctgacatatctccccacaaagttcttactaatttcaaagggggaattacaattttacattgaagaaatatagcagacactacctgaatcaagtgatcaaaagtaacatcgtgaaatcgggacaaacacacagctgtggctctggtttgaagaatgaaggacctgacatcgtttctgtgatattcctgcccaaaatgtacaacctgaacctaattatgaggaaacatttgacaaacctaaactgagtgatgtctacaaaataattggcctgtactccaagaaaaatgtcaaggtcatggaagaactgttccacattaaaggaaactaaagagatacaaaaactggatgttcgcgtaatgctggatcggatcccggaccacgcgagtttgtgttcttttctttagctctcaagggctttataggacgcttggtgaaatttgaaggtctgtggattagataatatgttttatgtcagtgttaatgttctgatttttagggaatacacagtgaagaggtacaggggcatcgtggctttgccttactctaaaacagttcagaaaacaatgtgtatgtggggatatatttgtgtgcatgtctgtaggtagagagggagagcaaaagagcaaaagagagagagggaaggaagggtaaagaaagcaaatgagataaagacatttggggaatctgggtgaaggatatacaaaaattgtactatttttgccaattttctgtgtcttgaagtgtttcaaaataaaaatctattaaaaagtgggctagtataatatctttcttagtagtgttaaggattaaatgagataatacctacaggtgctagtgctgggacctggacataggaattaccaaagaaatgatagctttgatgatcaggagtgatggccttgagggtatgtgtgatgctggctctgagttgatctgttggagatgtccctttcttattgggggatgacagatggcagcctcctttatggcaaaagccctgatctgagaatctggtgacctgggttcccatcagctctgacacccacctgctatgtgactgcaagttggcagtcattcaagtttcattttgccggggctggttggggggagggtacattttcttaggcttactttagaatgagttttattcattcattatttaatttattcacgcattaacatctttattgaaaactatgtgccaggcactattccttgcaataagccaggtccacggagaatgaatgctgtagtttaggggagagaaatatacaccacgctggcagtgtagagaaacgtgcacaaccaggtaaatatttcctggtgaggtgcagttcaggagtcttcccggcgggggcgtgaaaatcagtctccctagtggggtgtaattgaggagtgttctggtgggtaaaattcagagtcttcttagtagggggtaattcagagtctccctgggaagtcagtgctcacttggtctgggagaagggctggaggtgctcacctgtgatggggggaatataggatgggcagtgaagccatgctggtcactgtcctgacagtatgagagagtggctggggcacagggcagggtgggtgcgggggcatttgaaccaagattgaaaatgactccaggtttgcagagaggaatatgggctcaggaagcagtcccagactcaagaatcctgaccagtgccagcctgcagagtttttactggtctatggcaagatatgggaaatgaagacagtggtggtgtctgcatactcactgggaaggattgccaactgctgtttctcggaaagaactacttttatgcccaagctcattttttaacataaaatacacattcttttatgaaattatattgaaagcagatggtgattttttttaacgtcgttacttaacaaaataaaaagttgtcaatcctatatttgtctccccattaaatttttaaaaactggatcataaaatctaaacagctgggaacttaagcattctagacttcctgaatgaagtttcatggtaatttctggttttaaaagatgtattttaaaaaatgaatataatatttttaacatacatgaaattatagagaataagaggcacatcagttcacctgccctctggatttcagaaaagcccatacttcctggcaccaaccttcattatctttgcattttcattttcactgatgatttgtttacccaccctttccccctccatcccattagagtgggacctggcttgaggccagggtctgtatttgcatgcagttattttgatagaactcttttggagctccttcttggagacagctcttttgatgcaggaacattgggatgggccctgtattagtctgttatcacactgctataaagaaatacccaagactgggtaatttacaaaggaaagaagtttaattaactcacagttctgcatggctggggaggcctcaggaaacttacaatcatggtggaagctaaggggaaacaggcaccttcttcacaaggtggcaggagagagaagtgggcaagaggggaactaccaaacacataaaaccatcaaatctcacgagaactcactcattatcctgacaacagcatggtggggggaactgcccccatgatccaatcacctcccaccagtctctcccacaacacctgaggattacaattcaagatgagatttgggtggggacagaaagcctaaccatatcagggcccaaacaaaccattaaacttttaaaaggaaattgtggtgaaatgcacctaacataacatttaccactttaaccattttccactgtaccattcagtgacattaagtatgctcatattgttgttcgaccataactactattattctgcagaacttttttgactttccaaactgaaactctgtacccattaaacagtaactccctccctctcccctaaccctggtaactattgttacactttctgtctgtatggatttgactactccagggacctcatacaagtaccaatacatacaagtatttgtccttttgtggcagacatatttcacttagcttgtcatcttcagggttcatccatgttgtagcaggtatgaaactatccttcctttttaaggctaaataatattccactgtattccatattttgtgtagctgctcatctgtcaatggaaatctgagttgttctctaccttttggctatgtgaacaatcctgctatgaacataggtgtacacatgtttgttcagttctctgatttaatttctttggggtatatatccaaaagtggaatggctggaccatgtggcaactctgtgcttaattttttgtggaaccattataccattttccatagcagcagcaccattgtaccttctcaccagcaatgcacaagagttccaatttttccacatcctcaccaactcttgttttttgttttttaataatagccatgctagtaagtgtgaagtggtatcaaaccatcacactttaagcttcacatttttgtcaacaggtaatatacaaagctggtgtctgttctctatcctgaatcccatcctctctttggcttcatgctctccttcagcctcaattattgtttcctgtgcacaaagttgtacataaaatactttctgtgtggtttctaacagggaaacactgtagaaagcctaaatgtccatcagaaaaaccaaggttaaataatgtatgccacacagagattggaaaataccatgcagcaatgaacaagaatgagctatatctgtaagtgctggcattgagtgaggtccatgacatattgctaagtgaaaaaaatcaagccatacaagagcacattaaaaactacacgtctgaatatccagaaactacagtgaactcaaacaaattagcaagaagaaaacaaacaatcccatcagaaagtaggctaaggacatgaatagagagttctcaaaagaatatatagaaatggccaacaaacatatgaaaaaatgctcagcatcactaatgatcagggaaatgcaaatcaaaaccacactgtgataccactttacttctgcaagaatggtcataatcaaaaaaatcaaacaataatagatgttggcgtggatgcagtgaaaacggaacacatctgcactgctggtgggaatgtaaactagtacaaccactatggaaagcagtgtggagattcctcaaagaactaaaagtagaactaccatttgatccagcagtcccactactgggtatctacccagaggaaaggaagtcattgtacaaaaactttcacactcatgtttatagcagcacaatttgcaaatgcaaaaaggtggaaccaacccaaatgtccatcagtcaacgagtggataaagaaactgtggtgtgtatgtattttggcaccatctttttacacctagtaagaaggaatgaattaatggcatttgcagtaacctggaggggattggagattatttttctaagtgaagtaactcaggaatggaaaacaaacatcgtatgttctcactgatgagtgggagctaagctatgaggatgcaaaggcataaggatgacacagtggattttgcggactcgggggaaagggtgagaaggggtgagggatgaaagactacaaattgggttcagtgtatactgcctgggagatgggtgccccaaaatctcacaaatcatcactaaagaacttactcacgtaaccaaataccacctgttcccccaaaacctatggaaataaaaaattttttaaaaatcaagccacaaaagagcacattaaaaactacacatatgaatagatatatgtctatgtacacatatctctgtatgtgtaatacatgtgtgtattacacgtagcatatataatgatgtactatatgtaaatgattcttatacgtgtgtagaaaataatcatgatgtaacataaatgtacatataacttttttaaacacacagaaagctctggaaaaataggcagagttagttgactgtgattacttctgaaaaagagactgaggtgagtagcggaggggaatttcaatttttacttgttatgcttccaactgtttgagtgttgttccttttttaacaagaagtatattacttttgtaatttaaaaaaatagaaaaaaacaaatatagtaagcccagcctgcaagtcataaaacacaaatcctcaatcatggggccacacatgttttaggtgcacgtaatggtaatgcattattctaatgcgtactgggaggcagactccattctaagcacttgaaataacctagtttcccagaaaactacactatgaaggaggttatccatgttttacacataaggatataagctcagagaggtgaagttacccacctaaagtcacacagctagtgaatggtgtgtaattagtgctttaatggtgagacttctttcttccagacaggtacactggtaattttttagaacatggattttaacttctgatttatttatttttttacatactgagatagtgcaggttgtgtttgtaagattcaaggaccattagggtctcgcattttgtttgtttggctttatttgaacacagctctgattataagagcccttgggcatgggaagagtgccaggagcttgtcagccatctctatcagaaataaatggtgctgtgtttctttttaaataaagagaattactgggtaggacaccccatagctttgttctgaattctagatgtaaatggagacttcatagtttatcctaaagttgctgttgaattctctaattctggatataagcgttctattgatttccctctgcacatgcaccatgcatgaattgctcctagaaggctgagtggcggacatggtatgccaccttgcaccatattatcaatagtgttgcgttttcaagaagcgttgtttagttcctttacaaatcatccttttctttaaattagctctcttgggtggcaccatcttttttacacctaaatgaacagatttcacaacaaagatttctaagtgcatcattttgttaaactcttaaaactgttaaattaataaaatcagcttaacagaaccctgattagttcaaaattgctttaaatttggtcattaagtttcagggaacatgtaattttctccacatctggtacagctgcaaggcgtgagggatgaggacacagtgctgtaacaaatacagaggatggggaagaaacgctttgtcatcgacagtttctgcactgctggtttgcagtccccaggaataagcttcctgaggagacattaggccttgtgttatttctctaagaacgtccccttcctgcagcgagaaggccaatgcagaaccgctgggcatcaagagatctgggttcactttttgagaaccctgggaactcactgtgtcactagacacacattcctctctctgtgcctcaacatcccatctgggaaatgggctgatgttcttgagatcctcttccattagcttgttgggggctgggactggtgggggaatagtgtcatcttttgctaggagctattggacacatctgagatgcattatttggataatcgcatgtcaagatgcatttgtctgtcttcttggctacaatgctcctggttctggctcttctggttgggactccaggatcaggtctgtgagatgctgacactgatgtcgcttgcgtggtagcagccagcctcttcctctgcatctttctccactttggggtcaaggtttgacaagctcctcagctgacttggtgtgctatggcgtctgacctggctgaaagccatgacgcttggcctttggttgggatagcaccacttgattcatcactggcagctgcggaggggcagagcggagggaacatgtcagtactttatgggcaatcccaatgtgagaagggactgaggccggatagcccagtggtggaaatcccgtcattgtagaagggagggcctgggatctcaaatctgggaatttttgagttagatctagaacctgaggctggaggcaagttggatggaactgtctgtgcttgtggccgctgctagccattgagccgagtgccacctgcaggagcagtgatgatgggggtcaggcccagcccctgagtgcacgctgcccgccagtgtgtgctgggcatcacggccccctcacaaccctgcaaggtaagacgtgtgactcccatttaacagatgaaggagcgagcctagtgggattatgtaggttacattgtgagtcaatgacagggttaggatctgaacccaggagtgaggagtgaatgcagcgtcaccggaaggaaaaggaaagaaggagaactggaggatgatctgtctcaggcaagctttagtctgaggttctaagtcatgctgtgaaggtctctgcagagtcactccttggcttcattatgcagagagcttgtagccaggtggcactgggcaggggctcatcccaggtgcctaaaccccacatgcatcaaaacttagaggagaccagcgtcttctgctggtcctttaaaaatagtcatttgggccaggcacagtggctcacacctgtaatcccagcactttggaaggccaaggcgggaggatcacctgaggtcaggagttcgagaccagcctggccaacatggtgaaaccccatctcaactgaaaaataaaaaaattagcagggtatggtggcaggcgtctgtaatcccagctactcgggagcctgaggcagggagaattgcttgaaccaggagttggaggctgcagtgagccgagattgcaccactgtactccagcctgggcgacagagtgagactctgtctcaaaaaaaaaaaaaaagtcatttgctctgtagtgtcagtttccaagtcccaagtctcccatgaaagccaaatgccttctgatattgatggtacttcagcaggtgactgcagcccaattgtatcggatgtttctgatgacagcagataagtgccagtgaacagctaaagttcagtggcacttacctgctgtcatcagaaacatgaggggaggggatgggatagtggaagaaaggacatagggaggtgaaggacgcagaccctgaagacaaagtccttccactcatgtgcccacctgcagaagggggtgcggaagcttgagccacacacagagggtctggtcccaaatgcagagagcccaggcagtggcttttctgagggatagaatgtgagcactttggatgtctggaattctgtaagaacccaatggaaagaaaatatgaggtttggaaacttctcctccgagtgctcctttaggtgttcaggtggattttacagaagaggctgacggcccgaaggggaggctagccatcagatttccattaatgtctcccaccatctctgaggcctaaatgacagggttcttgaagacagcaacagaacagtggtaacctatattttattcactatctttcatgcccttagcatcatatctcactgatacgtagatagacacatgtgaacggaagcattttatacgtaaacgtagggatgtgtgtgacctagatttaaaggatgcatattaaaagaattgtacctaataatatgaactatttttggcccatgacatgcggcctttagaagcatgacaaaccaaaaacacttttaccaaattccttccctttacaatcccctaccgtcctcctatctggtcaaaatatagctacttttttggtacgttggttttaaaaacagctctgtcctccaaagatatggcaaagttttctagttactgttttttaatacttcctggtattcttagagtccacagctttgagtgcagctggaaaacatctacacagaggatatgtttggacaggtattgaatataataaactatatttaaatatttatacgtgaaatttttttttatggtgctgttctttaaatcattgaacgaggtcctttcatttctccaaaagatatatgagcactgtcttttggcatatagatcatttttgcctttgaaagatgtctcagttaaaaatgatttctacagatgatcttttacatacatttgttattgtggtgagcgttacatcctgctgttttacagcgatacttggaggatttctcctgaaaatagccctttatttgtggcaagctgaaagggagagggcaggaagaggacttgcgatatttcatctgcctagagcttagtaaggagaggagagggccgtgcagtccccagtatgaccctccttccctgtgctcgggaagcagcttgaggctaagagaaatattgggctcttctcttctgctaagaggcttagaattctgtgatttttattttctgcttctgcctgcaaggccctccttctcctttgtcaatttgaagagctctctttctattcctagcagttatctagataacaatcatttgtttttgagattgattcctataaacagtacgtggagcatctcatggactaaaacgtggtaaattgtcaaacttctcagagtaggaagatgtctgctggctaggtagaaggtttctggtttaatggtgaaaacagccaaacacacaaataagcaaacacgcacataaaccaccaactaacccagcccagcagcaggcgaggttttctgtcgtccagcacgtgcaagagaagggctgggcagcttgatggacatttgtgccgtccaccttgcaggcatatggcagctcccacgttctcacaccattcgacatttggggtgaccaagtcatgcactctgaccagtgaaatgcaagtggaaatgacaagtgcgacttcatggcacagattttcggagtccaagtgttgctatacacattctctgcttgtcttggctatttggaagcacattcagtgctgagcttccctgggcttggtggccgagtggagtgaggagtgcagactccccagctgcccgtagtgaccatggggcacaagcagggaatagagctttcctgttacagcatcatggcctcacctgtcctgactgatgcaggtggataccagcaggcaacagtggttggcactgtgacactctcccgccacacatggcacactcaccttcagccaggtgcccgcactgctcctgagaccactctgaccccatgaggaggttggcttgtgagtgcttatatttagccagccattgctcacagcagaaggataaaggggttcgattaagagagcttgtgggctgggcgcagtggctcatgcctgtaatcccagcactttgggaagccaaggcaggcagatcacctgaggtcaggagttcaagaccagcctggccaacatggtgaaaccccgtctctactaagaatacaaaaattagccaggcatggtggcacatgcctgtagtcccagctcttaggaggctgaggcaggagaatcacttgaaccaggaggtggaggttgcagtgagctgagatcatcccactgcactccagcctgggcaacacagtgagatactgtctcaaagaaaaaaaaaatgtgtgatacagtttggatttgtgtccctacccaaatctcacattgaatgagaggaggggcctgcaggaggtgattgaatcacgggtcaggtttcccccttgctgttctcgtgatagtgagttctcaggagaactgatggtttaaaagtgtgtggcacttcccccttagctctctctctctctctctcctactccacctggtaagacgtgcttgcttcccctttgccttctgccatgactgtaagtttcttgaggcctcccagtctgtgaagcctgcagcactatgagtcaactaaacctcctttcttcataaactacccagtctcaggttgttctttatagcagtgtgagaacagactaatacagtatgtgtgaagaaaacatacattcttagagatctgtttgcctgctctcacagagcccctgaccagtgatgggacattccagttagcaggagagagggtgtggtggagcacagcgtggctggaggaaatcactctaaacgggcttcagtgcactaacagattttggagtgatttatatgaaaacagtttaaagcatttactagctgtaggaactaatttccaataaatcagacaggattcccttgggaaccagaaataaatgagggcaaaagaaattgctaagggttgttgagcaataaagagatgggttctagataccttaaaatgatatttaaatggacaaagttgatttagctgtcttctctcatgtctaggagtaagattgaagtccatagcatgtcattatgaccaggaattattcaccaggagacctgcagcatttcatgcacattccgctgaatggcaattttaatattccagtttcagtcctcggttgtaatgaaaaggcattaattgcttggttccttgcaaagtctgtaacaaaagtgttcctagaacaagttcaaatttggcacacaaggcagaacttttatgatctaacgttagtcattttttttctaattaagaatttttaatgcatatatattttgtgatcttcaagttctcaagtaattatttcacacacacgggtcatctggcatcgtgccatgtgtcttggaaaatgcagaaaaatagaatatcactgtggtccttgcactctggaagtgtacatttcataggaagatgaagctgtgacaccctctgagaacactgaagccacacgtgtgtgtcaaatgtgaggatggaaggaccagcagccaggagatgctgacattgcttcagggaggtggaggccaaacaaggggctctgaagcactggctagacttggccagagtggggagacagctcattgtcccgaatgagcaagacctgtggccagagctggatgcagtttccaaagaccaggagatgctctctcagctgcccacacagggttcgggagacatctgttctgttaaacatggacacttcttgtgaccaggacgtagcatcatttcctaaagaggtgggggctcagagctccctgggaccagggggatgactgttctctgttttaggaacctgcgtgtgggatgttcttgggagatgtgaagagagaggaaggaaaggacactcaaattattgtcccccaccacacacacacacacacacacacacacacacacacacacacacacacacaatctacttgcttatttatctgctcatttcattgacgcttcccaacaactggggtatttttcattcccttttcctagttgagaagaaagactccgagagggtggaatcctaccctaggtcatttagctggaaggttgcagagtggtcttcaaatccaggtcatgccccttttcgggacactggaacattccaatcaacagcaggggaagccgtatcttcccctgctagacttggccagagtggggagacagctcattgtcccgaatgagcaagacctgtggccagagctggatgcagtttccaaagaccgggagatgctctctcagctgcccacacagggttcgggagacatctgttctgttagacatggacatttcttgtgaccaggacggagcatcatttcctaaagatcccctgctagaacttactgatagtaagttctaggatattggggtgacccaaacccaggaatccagtttctgcccttgcctttctcttgcataaaaggttgaattgtgcctcattcaagtgcatgaacttccccaggccctgctcagtgcatctagtagagccaggatgtcccagctgaccctgcatttggaggcctggaggtgggctcaccacagtttgcagcttaggtgtgcccccactcccctacccccgacctgtcactggtcctgaccccaactcttctggaatcacgtggtgtgagtggtacaggaggcctctgcttgcaaagctgggtgctgacctgtgtgtgcccctgatgactcctgtggaccgtgtttgctgctgcacttcagaaggtgtcaggaatgtgtcccttccatgtctcagcagccctgggtgctcccgacatcaccctgagaaacccccaggacctctctgggtctcatttccagagggtgtctccatcactcatacccccttggccacgctgcgctggcttctttgagcctctgctaagaggcgagtggcagcttccacctctaggacctcttcttgctgtgactctgcttgggaccatctttcctgacacccatagcttcccttgttccttcaagtctttgcttaaagtctccttcctggccagatcttccctgaccctggccctctggtttgggacagatgcttgcacaccgctgctccattcctgtagtgagtctgggggagccctctgcaggcagggagccccgcgggcaacgctggatgcaggcaggagcacacaggcccccaggctccagttcttcttccctactcctgacctttttcttctccaaagcacttactcccagttgacatattgtgtgctggcttgtttgttttgtttattgtctcttccaccgcctcccaggagggcagaggtgtttgtcttttcccccccacttctctcccctaagcgcctggaggtttgcgcggcacgtggtgggtactgtctccatctttgctgaaggagggaaggttccttgtttactgatgccccccccaactcctgttcagaggacaggcgaggcctgggactcggattggagcccgcccccacgcctccacccgctgggcatcctgcctggagaagcctcctcatgtctgactgtgggaagcaagctgcgctcagcggggcatcagttccaagcggagggtaaaagggagccaggcagagaccacttcttttgttactcagtccatgcgaggtggtggcgtcagccctgcttcagggaggacgcctgctgctcagcgtcccttctgcaaggagctgtggggaccccattctctttcccagacacgggcacccgaccctagggctgggaagtcatctgcccccatgtcctgtgcctggtgcacaacccccttcccctgtccttctccgaagcaccagccgccgcctggaagaattcttccctcccacccaaggcagcggtgggcacgcccagcccttggtcctgttctccagggaacccagccgtgtgcgcagggagagtttctcagtgtggctgaaatgtatccaaggacgcatgggaactggccgcccagtgcagtcctgcagttggtggaaaggaggatggtggctggggagggagggtggggagtgggtttttaaattttaaatgttattatacaatattctagatatacaaaaagataaataacaataaaatggatagcctcatacccgccaccagcttgagaagtaaaacacagttattgcgtacctggccccatcctccccagagctaaccactgtcatgaatgtttatacacctttgctgcatgtgtatatagatgaggataattttctttcatctgctttagaactttatataaatgacattgtactgcaagcatgcttttttaattaaaatttttatttgaaacaatttcagaaagttgaaaagttttttaaaacatacaagtaccatttgtatatcattcgccagatttcatagttgttcacatttcactatatatacttaattattctctgtgtatgtgggtgtgtgtatatatatgaagtggtgtacatatgtaacattttaacactcttttgaaatatttgagaatagattgaagacatgaagcttcttacctctaaatatttcactgtgtgtttaagaccaaggacattcttgtacataaccacgtcttatacataaccacagtacaaatatcaaagtcaggaaattaacatcaatgtgatactattattattttatcctcatcccttacagaaatttcaacaattgtcccagtaatgttctttatagcaaatgaaaaacaaatggttgtttgagttttggtcctggattcaatctgggatcatggggcgcatttagttccagtttcttaatctggaagagttctgccgtctttctttttctttcttgaatcggacatttttgacgagtacaggcctgctattttgcagcatgtccctcagttctggtttgtctgaggttccgcatagattagattacacagtgttgtccaaaatactacggaagccatgttatgtccttctcagtacctcatatcaggagatttgcgcattgctggttggtgttaactcattgcttgattaaggtggttgcctgccaggtttctctactggaaagtactgtttattttttctaattaataagtatctcatgaggtggtacttggggactgtgtgaatatcttgtttctcatcaggcttaaaaattttgaaaaacagctttattgtgatgtaattcacgtgctgtacaagtcaccatttagagtgtacaattcaaaggtttttagtatattcacataaatgtgcccccattgattttaaacattttcaaaacctccagaagaaatgccatgttatgtagccatcacttcactatctccccatccacactccccaccgccagccctctgcaaacattaatccacttagagtctctatagctttctctgttctggacctttgtaagaatgaaatcgtataatatgtggcctttggtaactgtcttctttcatttagcatcatgtttttaaggttcatccacattgtagcatgcagcagtgcttcattcttttttatggctgaataatatttcattatatggatataactcatttggcttcattatatggatataactcatttggctattattaaccatgatgctataaacatttgtgcacatgtttttgtgtagacatattttttttcatttcttttttgggtatccacctgagtaaaattgctgggtcacatggtaactctgtgtttcattacttgaggaactgttagacctagaccattttccacagtggccacaccaatttacattcttaccagcagggtatgagggttccagtttctctgtcaacacttgttattatctgactttcagattctcatcttcctcctgggtattaaagtgtcatctctttatggttttgatgtgaatctccctgatagctaataatatcaagtgtctttgtgtgtatatttgtatattttccatttgtatttcttccttagagaaatgtctattcagaggctttgcctatttttaaattgggttacctgtcctttttattattaagttgtaagagttctttatatattctagacataagttctttatcagatatataatttgcaaatattttatcctattcttccacagtttcaatttttttggtgtcctttgaagcacaaaagttctgtgttctgaagaagccccatgtgtctattttttattttgttgttcatgcttttgatgtcatatctaaaaaatgctttgccaatccaaggccgtgaatgtttatacctatgttttcttttaagaattttagttttaactctttcatttagctctttgatccatctgttttgagtttatttttgtatatggtgtgagataaggattcaatttcattcttttgcatgtgactagctagttgtcccagcttcatttgttgaaaagactatttttttcccagttgaatggttttggtgccattgtcaaaagtcaattgatgacagctgtatgggtttatttctaggctgtcatttctattctattgatctgtacgtctcctttgtgctagtaccacattgtcttgattaccattgctttgtagtaaattttgaattcagaaagtgtgaatcctcctactttgttcttttcttagtattgttttggctattctgtgtctcttacagtttcatatgaattttagaatcagcttgacaatatctacaaagaagtcagctggaattctcacagagattgaattgactctgtagagcagtttggagagtactgatatcttaacgatgttaagttttctgacccatgaacattgaagtttttccatttatttaggtctttttaaatttgtttcaaccatgttttatagtttttgcaatgtaagttttggacttcttgtaattattcccaaatagtttattattttttgttaaattgtgaatgcaattgttttcttagtttcactttcagattatttattgcaattgggtaaaaacacaattatttttatatattgatcttgtaacctgcaaccttgctgaatttgttcattagttctcatagtgttttttagtggattcctcacgattttctaaataaaagatcatctcatctgtgaatatagttttatttcttcctttccaacccggaggtcttttacttatgtttcttgcctagttaccctggctagaacttccagtacaatgttgaataggagtaaaagtagacattcttgtcttgttcctgccctaggagaaagccagccagtctttcatcattaagtatattgttagctgtgggacttttgtaggtgtcctttattaggttgagaaagttttcttctagttgggtgtttaggcatgaggatttagtcaaattctttttcagcgtctattgagatgattctgttttttagtctattgattgatatgatgcataacttagttgattttcagatgctgaaccaaccttgacttcctgggataagtcttacttggtcatggtatgtaattctttttacatgttgctggattcagtttgctagtattttgttgaggatttttttatccatacccataagagatattggtgaataattttcttataatgtttttgtctggttttggtatcagagtaacacaggtttcataaagtgaattggaacatattctctcctcatattttttgaaagagtttgtgaagaatcacattcattattatttacatatttggtagaattcagtggtaaagcgacctgggcatgggtttttccttgtgggtagtttttttttttttttttaaattgcctattcagtcttttcatttgttataggtattaatatattcagaccatctattttttttcttgagtcagttttagtagtttggggtctttataggaatttgttcatctaagctatctaatttgttggtgtacaattgctcatagtattcctttgtagtcattttcatttctgtacggttgataatactgtccctgttctcatttttgcctctagttatttgagttttctcttttttttttcttggtcagtctaaagatttgccgattttgacattttcaaagaatgagctttttgtttcatcaattttctttacttttctttctttttttttttttcgagacggagtctcactctgtcgcccaggctggagtgcagtggcgtgatctcggctcactgcaagctccgcctcccgggttcatgccattctcctgcctcaacctcccgagtagctgggactacaggcgcccgccaccatgcccggctaatttttttttttggtattttttagtagagatggggtttcactgtgttagccaagatggtctcgatctcctgacctcgtgatccgctcgcctcagcctcccaaagtgctgggattacaggtgtgagccactgtgccaggccaattttctttatttttctattctcacgtcattaacttccactgtaatatttattattttcttccttctgcttacttttggattagtttgtgcctctttttccagtcttaaggtggaatattaggttattaatttgagatttttctttcttagttttttctgagttcctttaatatttttgggggagaagaagtttcacagcatcccgtaagttttggtatgttgtgtcttcatgtttaccaatattcgtatttttttatttcccatttgattcttaaggcattgattatgtaagaatgtgttgtttaatttatacatatttgtgagtttctcccattgtttttctgctactgatttctaatttcattgtcattagaagacatactttgtattatttctatccttttacatttattgaggtatgttttatggccttgcagatggtctatcctggataatgtttcatgtacccttaagaagaatgtgtatactattcttgggtagagtgctctagaaacatatgttagtttgttggtttatagtgtagttcagatcttctgccttcttgccaatattctatctagttgttctatctattattgaacctggactattagagtctccaaatactattattattattattattgttattattttgggtcagagtttcttttttttttttctttttttctttttttttttttttttgaggcagagtcttgctctgtcacccaggctgaagtgcagtggcacgacctcggctcactgcaagctctgcctcctgggttcacaccattctcccgcctcagcctcccaagtagctgggactacaggtgcccggaccacgcccggctaatttttttgtatttttagtagagacggggtttcaccatgttagccaggatggtctcgacttcctgacctcgtgatccacatgcctcagccttccaaagtgctgggattacaggcgtgagccaccgcgcccggcccagagtttcactcttgttgtccaggctggattgcaatgttgtgctctccgctcactgcaacctctgcctcctgggttcaagctattttcctgccttacccaagtagctaggattacaggcatgcgccaccatgcctggctaattttgtatttttaatagagacggggtttcactaagttggtcaggctgatcttgaactcctgacctcaggtgatccacccaccttggcctcccaaagtgttgagattacagacgtgagccaccatgcccggcctccaactactattattgaatggtctaccttcatcttcatatctatccattttttcttcatgtattttggtgctgtgttactaggtgcattgtgtttataattgttatatcttcctgatagattgaccattttatttttatgaaatgtccttctatctcttgcaacatttttttaaagtctattgtatctgacatggtataacaactccaactttgtgtttgcatgacatatttattttcatgcttttactttcaacctttttgtgtctttgaatatcagatgtgtcttctgtgaaaaaactttttatttctgtgtagtcctgttcatcaatcttttcttttactgtgtgtgtatttttgagtcatagtaagaaaacctcttcctacatccagatcaaaaagaaattaacccaattttcttctagtactcgtatggtttcattttttttcttacatttaatctttgattcatttagaattcattcttgtgcttggtaggagatactggacttaattttttaaaattgttattcagttgttccagcagcatttatttaaaaacatctgttttctccagtaattttagaggccacctttatcgtatactgagtttccaaatgtggttggggcatatctggacttcttctactccacttctctgtcaactcatacaccagtatacactgttttaattatgaaggctttgtagtatttttagtgtctggtagggcttatgttcccattgaggcttttctgtgttcctggctattcttgaaggttaattttcccacatgaactatagtatcaatttgtctagctccataaaattgcattatatttataaattaatttagggagaactggcattgtgatgatactgagttgtctcatccaagaagaatttatgtcttcccatttgctgaggaatacttttgtgttatttagttttgaaaggttttctcatggaggttttgcacatacccgaataaatttattcctaaatagtttatctttattgttgctattatacatgggagtttctttgtagtactgatttctgagtgccagttttatattctgctagtttactgaatccttttttgtgtgttcgagttataatgtgcttttttccagtatattttcatgagattcatctttgtggatgtttgtaactctattatttattttcactgctgtgtactattccattgtataaatatatcacaggatatttatctgtttgtatttggatggacatttagattgtttcccatttgttgaagttgtcaagtagttttccaaaggcgttaattctgttctcactcctttctgtaatgtgggagcctctgttgcttcacatttttaccaacattagctattgtcaatgcttaaattttgtcagtctgagggagtgcaaatggcacagaagcagcatgctttttaatgacttctcttaagtccttggtttccaaattctgacccaaatgctgcttcccacatggacacagtctccatggattgcacaccccacccccggcctgcttcttctaagtgcccctctctcattcagtggctgctggtaggagttgagaatggcaacgctgctttcctagtctcctgagagggaaacacacttctgtaaaaattaaacactttattagctgagaagtgtctggccctggtactggcctcctagaggaatttctttgctgacttacttgcattatatctgttgtataattatcaacaatcagcatccactgagtagcatcttgtacctgacactttactaggctctgaacagggcttagtgatgaataagacccagttccccaccactcctggggctttccacccgcttggaagaggagacatgtttacattaggtgatatcgctggataacaccagtgatacccagtgagcgtgtcaagggccaggttgctgacactgacagggaggtctgtagaaaatgaatgtggaaagaaaatcttctatcatattatattacaaattcaggaggaaaatctgtcattgaatgttttcttcttgttttaaaaagctgaattcattctgataaaaatgtatataccacctaaaaatatacactctatttttccaaccgacacaatcacccacaactgaaaattgaccttggagccctgtcccacctctaatgggtggatctaggatcaaccctatttctaaaggggtacattgcaggatcctgggtcacgaggccagtggctggtccagttgtggccttgactcaggtgtccttcccttatttcttatgaccaaaccaccggctctgtgcttctccatatggtgtggtctattccaagctcctggtatcttgtggatccaagacctgcctttatctccccagtcttcgtgaaataagagctcttctcttcctttagtgtttggggccctgctacctctcctgggcatttgaaagctaagtgcccactcacctcaggtccagggatgtcctccattagcatttccctcattctgctgcccagcaaaaccagggttaaactaaggtttggttacagcatatgggtaagaagtttccatgctcaataaaatgccacgtcatctactttataaaagggtaacacatcccttccgagctggaagcctctctctccatgcttgctcctcttgtggccaacagcacaccctccaggcaactggggagcattgcaggtgtagaccgggcttccgtcaggcagtgctttctggcagaagccagctggcttgtgcagacatcttgtccatagccttgaccttactggatacacttgctaacctcccagacaaactgatccaggctcatgaaagttggtttgttctttggtttgttcattgtgcattcattcatttgtttgttcatttggtaaacacatactacatacttcattgaaaattctgcaatgatcaggtcagtcaaaatgcacacacacacaaagagcctctttctccctttaccctattgagtattgggtaccttattgggcatctgagatgctgtggaatttttgccagaattttacctgtttgtctacccctgtgctaggtgatgtgaaagctacatagggcaggggcttgactcttgaaaaccatgtgattctgttgaaggtgtaaatcaagccagcccacaggaagcaatgagtcaacatgtgcacctctgtgttttgctcttgtgggtccgagaagaggcgcttaaattgcccagtgttcattgagggctgccgtgggttgggattgtttcctagaaccatagctgagccttgaagagtgggaaggctttagacagattctggggaaaggtgtcatacctggggagaataacttgactatgtgggctgagagtaaacatagtgggttctgatgatgtcgaagggaccagcttgatgatatgtgttgtttcacatgttaaatccttgggacctcctacttgactagatcagcacttgagcccttcgtatagaaagctatgtgctacagtgaccattgctgggccgactggctggcatggggctgtggttgactctgtcctgggtggggccgtggagacaccatagtctattcctagtctggccatgataccgaaatagcctttaaccatgattcaaggccccaccctttctcctatgtgattgttgtttgaatacttctattttgttgttgttgttgttgaaactgtagggtaattacccttgtccttaataattgctttagtttccttgatgcgcagagatgctctagagtctacgctgttaaaaagaggttaggattaagtttttcaacctgccgctggtgtgagaaggatgtctccatgccaattactgtcttcttgataggattagtcactgtgttaattgctactcagaaaaactgccaagtttgttgttttagacattggcttttaaaatattgcagatgtcatctcaaatgcaaattgtatttggtattagagataactgttgatctattaacactttggggttgattcatatctgaggctgtgtgagtaaaaggagtctcacccttggattaattgcatctttgatggtggttccagaactgggagggggaggcagctgtcaggtctgtttcttggcactctctttgagagaacccagagctctgtcagcaacaatctgttggaattggccagcgtaatgtatgaaacaacctcgttcttcagctcaagagcatcacctacctactccacaggtcgcagtggttggtaagctcctggtttaccttgaatgttgacactccagggagggtcaaatggccacagaagttcttaatccttagagatttccgagtcagtagaacctccccattttggaccaggaaagaatagagaattctgacattacatagcatttaattttttattaatgttttatttttaagtcatttcaagatttcagaaaagttgtaggaataaaatgaagaattcccatatgcccttcacgcagattcccgatattaacattttatcatatctgtcttatcattctgtatgtgtgcatgcacatgactgaaccatttgaaagtaagtttcagacatgatgccccgttaaccctaaacacttcaatgtgtatatcctgagaactaggacatcctcttgcataagccagtgcaatggtcaaagtcaggaaaatagtactaatgcaatagcattatccaatctgtagactttattcctgcaaccaacaatatcctttattagcaaaatacaataataaaaacaatagtctgttgtaggatccaattcagaatctcacgttatgtttagtttccatgtctctgtaatcgccatcaatcaattcttcagtctttgtctttcatgaccttgccatttttgcagcatacaggccatttattttgtagactgtcctttggttggggtttgtcagatgtttccttaggaccagattcaggatatgcaattttggcaggaacaccacagaagcgacattgggttgttcttagtgcatcgtgttagaaggtgcatggttgcctgcccctttactgggattgttgactttgaccattggttaggatggtatctgctaggtttctccagtgtaaagttattgtttattctcttcataattaattcgcattttatggaaaaatagtttaggtctgtgtaagtagcttgtatttcattaaacttttaccccttgatttagcatccattgataattcttgtctgaatcaattattataatgcatgccagatggtgatttttctctaaatttatttattgtttagtactctgtaccaaattggaaagctttttgctttcttacatttatttatttactcattgattcgtttatacccatatggactcatggatttctatcttagtgagtgacattgactagattatgttgactgagttacattcattaggttatatatttgtccagtggtttataacctagttgttttggtaattatattgtcacagatttggccaatggaagccctttcaatttggctactgtgtccttttgacaaatccccataatatttttccacaacattttattatgaaaaacttcaagcatagagaacgttaacagatttttttcagtgaacactcatgtacctatcacctaggttctttaatgaacattttattatgctgtctttatcatagatctattcagctatccacccagcaatgcatcttgtgtttaaattgcatttcaaagtaagttgtagatgtcagcacacttcatccataaacactttggcaggcatgatagtgtctcgactttaacatttatttacagttcttttactcagcaaaacttacttacagtgcaaggtacacatagtaagtgtaccatcgaacaagctttgaccagtgcatgcacctgtgtgactcagacccctatcaagttgtagagcattgcagccagttcagaaagttctttcatgtttctttctaaccagttctttctccatcgtcttcagcagcaaccgctgttctgattttattctcaccatagattagctttacctgttctagcacttcatctaaatggaacatgtgcaatatacattcttttgtataaggatgatttcactcattattgtgattttgagattcatccgtgttgttgttatcagtggttctttgcacccgtcattctttgagcgcttccttttttctggtccagcaaaatgtcccaaggtcgccttccacttcctctcaccaaccctgggattagctcaatctctaatgagccccggctcctttcagcagagaatggtttctgaattccagctgtgtgccttgcgagtggtatgccattgcttctagacactctctgccttagtagaagaagctaagcaatgcatgtgtgaggatacattcatagatacacaaacacatatatatccacacctacttctaaacatccgtgttcatggatgtgtgtaaaaccatgcattgtgatgataccaattctagtccaacatcacagggttcctcctagccgttcatctttccatatgtggcactttcttttccaacatggagaaattttcctgagtatattattgtctaaatcctaaatatatataaaataatgaaataagagttaacctataccactgaagaaagcaaacctaccaactatagttcaatgtttgtttatagcactttttctttagcctgagggcatataatcaaaatactgtgttcataagccttttgggttaatctctaccccctttctctctggttatgttattcttggaaataaaatataattaggctcttttgtttttttgcttgtgttctattttatggtctctccccatccttgttgatttttttaaggatggaaaacattaacatgtttataaaaatcaaaactatgcaaaaaagttagatccagagacgtgtcactgcccccatccctccccacacatgggtaaccactctcattattatctccttatctgttttgtgtttctttgctgagataagcagatacatgtatactttcttattttctcctttttttcttacacaaaagacagctactataaatactcctttgcacattgcatttttttaaattaaactttctatttcaagacaactgttgattcacatgcagttgtaagaactaatacagagagatgatccatgcaccctttgagctgtttttctcaatggtaacatcttgaaaactatagtagagtatcacagccaggatacttgatgttggcacaattaagatacagaacatgtccctcacctccggggtgctgcaggatgccctttttagccacacccacttcctcccctcccctacaccctctttgactctttgcaacccctaatctgttctctatgtctataatttttatcatatcaagaatgttatataattggaatcatacaataaattaccttttggaattggctactttgactcagcataattgtctcgcgattcatctagattgttgcatttattaagagtttacttctttttattgctgagtgatgtaccatagaatgaatgtgctacagtttgtttagccctttatacattgaaggacatctgggtgtttctagttcttggcaattacatataaaatgtctataaacatttgtgtacaggtttttgtgtggtcacagatttttatttctttgagataaatgcctaggaatgcagctgctgggttgtatgataactacatatttagcttttaaagaatctgccaaagcacttttcaaagtagccgtgctttattttcccaccagcaatgtacggatgaccccatttctctgcatccttatcagcatttggtgttgtcactattttttattttagctcccctgacaggtgtgtaatgttatctaatcgtggtttaagtttgtatttctctaattggctaatgatgttgaacacctttgcatgtgtttattgccatctgtatattctctttggtgaattaccttttggagtcctttgtccattttctaattagattattttattttttattaagctttgggggttctttatatatcttaaataccagtcatttttctgagaggtggtttgcaaatattttctcctaatttgtatcttcttttgcatcctgtccttcacagagcaaatattttttttcttttttttaaatttcttttttttattatactttaagttttagggtacatatgcacaacgtgcaggttagttacatatgtatacatgtgccatgttggtgtgctgtacccattaactcatcatttaacatgaggtatatctcctaatgctatccctcccccctccgcccaccccacaacaggcccctgtgtgcaatgttccccttcctgtgtccatgtgttctcattgttcaattcccacctatgagtgagaacatgcggtggttgtttttttgtccttgcgatagtttgctgagaatgatgttttccagcttcatccatgtccctacaaaggacatgaactcatcattttttatggctgcatagtattccatggtgtatatgtgccacattttcttaatccagtctatcattgttggacatttgggttggttccaagtctttgctattgtgaatagtgccacaataaacacacatgtgcatgtgtctttacagcagcatattttataatcctttgggtatatacccagcaatgggatgggtgggtcaaatggtaattctagttctagatccctgaggaatcgccacactgacttctacaatggttgaactagtttacagtcccaccaacagtgtaaaagtgttcctatttctccacatcctctccagcacctgttgtttcctgactttttaatggtcaccattctaactggtgtgagatggtatctcattgtggttttgatttgcatttccacagaacaaagattttatttatttttttctttttttgagacagagtttcactctgtcacccaggctggagtgcagtggtgcaatctcagctcactgcaacctacacttcccgggttcacaccattctcctgcctcagcctcccaagtagtggggactataggtgcctaccaccactcctggctaattttttgtgtttttagtagagacagggtttcaccacgttagccgggatggtcttgatctctggacctcgtgatccacccgcctttgcctcccaaagtgctagtattacaggcatgagccactgtgcccggcccaaagattttaattttcatgaagtctactttacccatttttccttttatatgttgtgctttaggtgttaagtttaagaaccctttgcctagtcctagttcccaaattttctcctatgttttaagcccattgtcccttccaagttagtttttgcaggtgtggagaagactttggtggagactttttctttctttcttttttttttttttgcctgtggatgtctgatcactctaacaccaattgttgaaaaggctatctttcaacaaagctatcttgaattaattttggcatttctgtcaaaaatcagttgggtgtatttgtgcaggtctctttctgggttctctattctattggtttatgtgtcaattcctttgctaataccacacagtcttgataactgtagctatataataagccttcatctgtatcctgacattcttatttggaatatttgtgttttctcattctttgatgaagtttagcttgtgattatcctattttttaaaaaaaagacccgaaattttggttaatttgacccacctcatttatttctacatctaactttattttcccctttcttatggttttgctgttgttcttcttctagctttttgagcttagaattttaaaattttaatttttcatttttactaaaataatgaaaaaggctatgaatattcagtccgaccactgttttaaatatgtctcataaattctggtatgtagttttttgtttgtttgttttctgagatggagtctcactctgtcgcccaggctggagcgcagtggcgcgatctcagcccactgcaacctccgccttccaggttcaagcgattttcccacctcagcctctcgagtagctgggactacaggcacacaccaccacacctggctaatttttgtatatttagtagagacggggtttcaccatgttggccaggctggtctcaaactcctgacttcaggtgatcctcccaccttggccccccaaagtgctgggattacaggtgtgagccaccgtgccttacctggtatgtagtgttttcatgatcacatgtacatttttggaatttctattgctttaattttgaaaagatttttaacattattttccagttttattagactgtgatcagaaaatatttctttgtaatatttctattttatgaaatgcattgattatcacctaacacgtgaccaacttttgtgaatattctatgtgtacttaaggagaaggtatagtagattccccatctactaataggtaattcaaggaaaaagtatgaagtatgactgtattagtctgctctcacattgctatgaagaactacctgagactgggtcatttataaagacaagaagtttaattgactcatggttccacaggctttacaggaagcatggctggggagacctcaggaaacttacaatcatggcagaaggcgaaggggaagcccgcgtgtcctgcgtggctggagcaggaggaagagggtgaagggggaggtcctgcactcttccaaacaaccagatctcctgagaactcactcactatcacaaaaacagcaagggggaaatcctcccccatgattcagtcacctcccccaggctcttcctccaacactggggattacagtttgacatgagatttgggtggggacacacatgcaaaccacatcagtgacaaattgatttgtcaaggaaattgattatattgtttagggcttctgtgtccttacttattttttgtctatctggtttctcttgtactgacagcggtgtggtaaacacactattcttagtgttttcatctatatttcctacagtttctttctttcattttccttccttccttcctttctttctttcgttctttcacagaactgtcgcccaggctgcagtgcagtgttgagttctcggctcactgcaatccccgcttcctgggttcaagcaatccttgtgcctcagcctcccgaatggctgagactacaggcaggtaccaccacgcctggctaatttttgtgtttttagtagagatagggttttgtcatgttggccaggctggtcttgaactcctgacttcaagtgatccaccattcttggcctcccaaattgctgggtgtgagccatcaaacctggcctatatttcctacaatttcctctcctgtaaaagtggttgtagtcttgtttggtgcactaatactcattatggttatatttttattgtggaatgtgatttttagcattagaaggtgtcataatgttgtttcttaaattatacttattctactttgatatcaagattgcaatacttgttttgttatttccatttgcctcatatgtctttgccatccttttagttttaggctttctgaatctctttgatatggttcggctctgtgtctccacccaaatctcaccttgaattgtaacaatccccatgtgtcaagggtgggaccaggtggagaaaattaaatcatggggacagtttcccccatactgttttcatgatagtgagtcctcacgagatctgatcgttttataaggggcttctccccctttgctcggcacttctctctcctgtcgccatgtgaagaaggaagtgtttgcatcctcttctgccatgattgtaagtttcctgaggcctctccaaccatgtggaactgtgagccagttgaacctctttccttttataaattacccagtctcgggcagttctttatagcagtgtgagaacaaactaatacactctttttaaaagtatgcctcttatatataacatatagttggatctttctttttaagccaaattgaaaatttttttattttcataagtaaacccattcacttttatttatatgtccaatatgtataatatcttatataataaatgcaatgtgtattatgttctacttgctgtacttgtctttctacatgatgcattttctatactcatttaatttctttttatatataagaaattctcatttttagtctaatgggtacctttgtactcattacctttaaaaatccctttagtctcttactaacttttaccatttggtctttcagttgttaatggagtctcttgactcctacctgttgcttatacaagcatcactgagcttattctggttttgtctttcctttttttgtttcctatcattttgtagttgacaaaacatatataatctatgtatgattctcttaaccttagttacacacttaatttaggtccataattaaatatattaaatgttccccataagttcctttgccaaagagtccctagtcatctcctggttggatgaagttaattttctagaagattccttcagaggcgcctgtgggtacatcactcaattctcccatattttaaactcttattctgtacctctgatttttgagggtctgcttcgctagatataaaatctttgagttttatgaaactgctgctccatccttgccccaccttctaagttgtttttgagaaggctgacaactgtctctgttgcccttatagtaagttatttgatcttttcatttacaagcgttgaggatatttttcaaatgcatcgttgaggtttttaattcagtttgtagtgttatgacacagttcctccccctccaccttatggttgggattttggggtaagtgtcgtattctcattttagttttttttctttcatagtcttctacagatgaagaccacttacatcgccacattgagtggttcgtgtgatttttagttcaagagctccctcttctgtcagtgcagcgaagtgcagtttctttatgactggtttttgggggaggggcgggaggagttgagggtccttggatgtatcattattttttgttttgcagaatcctaaatgcccacatctggcttctccctccctcccctgcacatttgccaatgctgcccctgcctacctttaaatcacttccttctagtccatattctggtctatctggattcatttttggtattttcttccctgtaggatgtactttctctttcttcaggtaattgtaatttattcctaaactctccatgctcgacgtctgccttcattggcttttggacccatcttatcctcttgctctttataaaagttctgggtgggaactcaagaatttgttaatttgatgtttatagtgtctcttttttccagtcgtgtgaaaggtgtgtgggatttgtgtggttgtttttgttcttcttgttgatctgtgtagttttcagaggatgcgttgggagatttgagtttttgtggctatcattaccttggcgacctggaagtcccttacgtggcattttaggagacgtgtgcagttatatcaatttcaagtacaattgtaactcaagcctgttatgaacaccatcttttcatgttaattgtaccataaaagaatcttgaggatatctttaaaaggtctgctctcttacgaaggtgaagtgtctcccctgtaagcttgtttacaccggcatctgttcagccagccctttttcatagacacttcagccaaatactggcgtgttttccgtttctgtgtttacggttggactcaacgagccttttactattgtggcatatgggagggagcgttgccattctgctgccaggggtgagtgtgatctggtggctgttacattgtgtatatgcgagtaggtctctatcaagaagggacccgccatgcttacctggcacgggagatataccaggatcctgaaggtggtactcccagggtgaggcttatccattgtgcgccagatgtgttgacccttgtgatttccccaaatgtgggaaactcactgcatcatttgtggtagtgggggactgtgtctgtgctctctcctgacatttgaattttttcttaaaaaaaaaaaaaaaaaaaaaaaaaaaaaaggagacacaccatcttccatggactgaatatctgtgtttctccagaatccatgtgctgaagccttaaccccagtgtgatagtctttggagatggggtctttgggagggaattaggtttaggtgaagttgtgagggtggggccccatgataggattagtgcccttataagaagaggaagaggggcctggtgtggtggctcacacttgtaatcccagcattttgggcagctgaggcaggaggattgcttgaagtcaggagtttgagaccagcctgggcaacacagggagaccccatctctaccaaaacaaagaaaaaagaagaggaagatactagagctctctccctgctttgtgaggacacagtgagaaggtggccgtctgtaggccaggaagggagccctcaccaagaatggaactggctggcatcttgatctcagacttcccgtctccagacctgtgagacataaatgtctgctgtttaagccacccagcctctggtactttgttacggaagcctgagctaactcagatgtcagccaaccatatttttacagcattctcatacaaagcccgaaaccatagtcagattcagcgctgcgtggcttagggaatgcgccacgcctgactcattgcagggggtcaagaatgtttgtgagatgaatacatggagtatctttgttctggaaatagaccacctatgaattattatagtagagaaatcccaggcctcctcgaaggacagggaaaacctgtaaagtgtctgtactttgggcccagaggaataatggaaagaggccaggcacgctgggaaatttccatttacaaacccgccttctgctgggttgagtctcgcctgctgtgggctcagggatcctggcctggcctattttttctctgggtggataccccattcccgggagcgttcagatccctgaagacagcttctgtctcctccgagaccactgctgagtcttgtcacctggtgttcccacagtgccaccctgtcttctcttgttctctgtgggttccagaaaaagggaccacctcggctctgtggctttggatctctccagaggagggttaaggcctcagatagcttctccaatgggacacagccaacatctgagctgcattttcaaaatgagagccaatcttaggctgagtcggacagggagaaaggaattgtgctcgggcacccaggtggcacctgctgtcccctgacctggcaccacgggcccaactttgggttttaacttcccacgagtgcctggacatggagaagaagtggtggagaggatgaggacatatggggagcgatctccagggtcactgaggtcctgtctcctgcctcccgctccctagggccctccagctgggcccaggaggtctccctcccacctggttgtcagtcagcttctgctgtgccctcacggggaattcctcctagagcccaccaggtgggagagccagggcagcaagcaccgaaggccggcacggcaccagcacagatgaatggcccggctttctcagaacccatcccctggaacgctggaggcagtgcaggaagggccgggttctatgagaggaccttaggcagcaggaatactccatgacagcagagatgctggggccttttccccagagccttattcttttttttttttttaatctttagacagaactctcattcacagcatttagttacttgttcattcattcatcattcattcactcaagcacttgatgggtattgcactctcctaccttgtgccagagactgtgtgagactcggagagttggtaacacacccagagtcttgccttcgggggctttcacgagcagagccattgctccggcttttgggtttccatagtgtgcattagcctttgaaggcctccaggaagtccctccagaatcagacctgttccattgtgttcactgagaattctgcaaatttctttggtgatgggacttgattcttctttatatggtaccaggcagaccagtgaatgcgtcgtgaaacacctctccaggcccgtggaatggggtggggaacgctggggtctcagtgtgagcctggcctttggattcagacagtgctgaattacagtctcagccctgcttcttgctggctgtggggctggggccacatgaaccggctaagctttggctttctcagaaatagtttggggataatgattcctgcctagtgggaagattaaataagataaaggaatggcaaagttttatcccatggtcagggaggatggtgactgccttgtgccatgggtgacccctgccttccttcagagggcatgtgcacaagctggtgcatacacacacacacacacacacatacacacacacacacacacacaggcttcctgtagtcctcggttgcctgggaggcagcagtgactctgccttctagaagtcgtctgaactgtctgctttccaaacaggggcgacaggactgtgactcgaggtgatgggttgctgaactgctctgctgccagacacattttgctggcttctcataatgtcactgagatctgggaaatggaccaagcacgatttccagctaaatgaaacactttggggccatcagctaaatagatgatgcttttgagaaaaccccatgagcattgtgtcagacaggccgtgggaccctgcaagcctgtctttttctgtgctcgtctgggtgatgagacatcgcccgggctggttccatgagcacctctggctgtgaggacctgcgtcttctgtctcaatgcacctgcggggaggctgagatttgatcctcatggaacattcaatcctttctgcatctcgctgtcttcctgccctcctctttctcccttcctcttgcctgactgttgactacaaaataggatattatttaggaacgtgtccttgcctccctccctggctctacatcaccccatgacatagtggctgtgctcaggcggagagtgagttatgtttctgtgggcaggagtgggtcatgagtcctgagtcctccctagacagccccagccctttctctttgttccaaggggcccagccaccatattgattgtttcatccctctgcactgcccagagctgcctcctggagcacgctctcttctttcctgatggcaacggtcccacctgatggcaatggtccctgggccagaggatgcccattggtcttcatggagagagcttgggtcaggcccacttggtctccaatcctggcttcgccgcgtgccagctctgcagtggtgccagcttatcctgctaagcctagcttcctcttctacgtgggtatatctgcctcaggtgcagctgtgaggatccggggtgatgctcatgaggtgcccggcaccctgtgtggcacagaaatgaccagaaaataccaactcacccaatgccaagtcttcactgtccttaagatctcaaacctttttttcttgatcttcttcccttgatgaccaacgctcttgttcctctcgcccttgcgggccaccccctcatacatctttccttgggccacaacttaggcctttgccttgcctttacttacctgttgatccacccacccacccacccacccacccatccaaccattcatttcttgcttcattcatccagtgatgtactgaatgtttcctacatgtgtatgtcaggctagggtgagcaaagcagattcagtgtctccctaccctaaacttagtgcaggagaggatagagacaatggaacaggtgcatgtgcgtgtgagtatgtgtatgtgtgattgtgtgcgtatgtgtgtgagtgtatgcatgcgtgtgtgtatgtgtgtgtgagtgtgtgatgggaggtaggtgctaacagggagagtcttgagaaatggatactagggtcacctaacagggtcctgaggggtcaggaaagcttcatagaggaagtgactcttacctccttgagcagatataagcaacctgaggccaggggttgtgctttctagggcctcagaacaccagcatcgtcaacaggtgagtgcctgccatttatatgaggccctgggtttgcaaagagggatgaatatgcaacataaatagtaatgcaaagggacagttaataaatacttgtccgatgaattcatggatgcatgtgccattgccaggcttatatttgctaagcaatcttcccagcatgtgttaaatctctgactcaccatgaataaggagcttagaagagctcatttgagtttccacgtggttcatgaatatgcaagcgagattccttttaatctcaaattttattttattagatgtatttacatgtatttattagttctcaggtttaccttggggcctatgggatatttaacgaaggtatcatcccatcttcactgcagttgttagagggcggggtggaagattgctgaataactcgatcaccccagatgaccagagatcttctgggtgtgtaatgaccacagactaatcttaatcataatcactaccatgaacccacatgacatgcagttgtataaaggatggggcaccttaacgtttgtagcacctttacataaagccagagtgctcaagccatcctggacctcacccgatgggagggagaatgatgctctgccaggtggaggccttaggtcttgtcagtctccttttactgcaggagaggctgcaggcttagctggaaacataatcgctgctcaaggtcaggctgtgcccagtggccgaggcgcttggtgagctttccactggatggcctaaatttgcaccgctctgcaggctctcgtcccagttggcaagggcgccacagctggatggctcagcgtccacccaaagggaagtggaaaaaccagcagctggctgaatctgagaaggttttcatgttcccaacgagatccaagagcaaaacagttttctgaaactattttccacttgctaaaattaaggttattattattatttttcaggaatctgctgtgtacgggttttatttttaaatgtcatcatcgttttgtacaggagcacaaaactcatgaattccgtccctgctcaagcggggtcccaggttggaggcgtgacacccgcgcctctccgctggtgtcattgattgctaagggcaaggctctagggttagtggggacctgatgaaagcccacctggggctcttgatgtgggagtgtttggtggatatgcctccctgccccgctccccagggccctgctccgtagctgctccatgtcgtctggatggtccgttggcaccctgcccaccgcacttcagcttcccttgctgccacctgcatgggctgctgccctgatgagtctcgggtcacatgagctgcatccttattgccgcagccagcagatggcagaaagcgccttgaccccatcgtctagtgtctccttgactgagatgaggaggctggaggagaggctaggaagagtcaggaaggggctgtaaggggccagctgggcagggcactggagcctggggcaaattcttactgatcttggcagatctctttttttttttgagatggagtcttgctcttttgcccaggttggagtgtggtggcacgatcgcagctcactgcaagctctgcctcccgggctcatgccattctcctgcctcagcctcccgagtagctgggactacaggcgcccaccaccatgcccagctaatttttatattttttagtagagacggaatttcactgtgttagccaggatggtctcgatctcctgacctcgtgatccgcctgcctcggcctcctaaagtgttgggattacaggcgtgagccaccgtgcccggccagcagatctcttttattacccagaaagacctctactgtcaccctttccctccccaccaacaatatcctgggagccttttctccgagtggccctgggaattcttcatttaaggcattggatttcccttggaacttccctttcctggggttgtgggtggggtgttgctgagaacacctgggagggtccatcaacaacccatcaagagtggcgaggccggcaccccagtgcaatgtgccagcggggttgacagctaccccagaggaaagggtggaagctcagacacttagcaggatttcgggggttcacttctctgcatcagtccctctttggagaaggtcacaggcgcatgatcatagacttttggttggctcagagttccctcgacagtggcatttccagctcagaagttcagggtctagtctccctgcaggaagatggtgagtgacagaaacacatcccctcgactgttccagtgtggctcctctgctcatccctacagggttcctgccagcagcgaacctttccgagccactgattcctcatctcaggggttgggatcctagcatccccttttgggggtatcctaggatggcagatgtgggatggcctggcgtgttcagcccagtgcctgtccacagccccttgaggcaggtgtttccttcttgccttctctggctttgagttcagttgtccccacatcccctgaggatccaaaaggggctttttaactctgctcaatgagaactttccttgaggccaaacacgtgcctccaaagaacccacttttagggggcatgcaggccaaggtttattgcagtaaaaggaggtgacacaaagctcactgcctccccctcaaattcccgccccgccacctcaccctcattgcctgcccctcgtggaattacaatcatctgcttgttatttgtgatttccacttgccttcaggctgttccaggcaatggctgagtttcatcacccttacatccctaggactgggtgcagagcaggtgccccgtgaatgcttgctgagttcatgctgtaatccctgtcctttaatttcatttaaattaacatctttctctctgataaagatagaacaggctcattgaagaacattcttaccacacagaaagatacaacaaaaagcaaccaacttcacaaacatcctctgaagtcccatttcccagagatagccagggtcaaggttttagagaactcaatgcttccggacttttccttatgtacacatagacatataggtgctgggtaagtgaagaattctatagaaatgagatctcaccatgcattccattttgcaatttttttttaaataatggagctctttccatgttaacaaatagagatatgcacattttttctaataactatctactattctatcaatatcctgtgattcatttaccaaagcagttaactgaagccttttttattttttattttttttttgagatggagtctcgctctgtcacccgggctggagtgcagtggcacggtctcggctcactgcaagctccgcctcctgggttgacgccattctcctgccttagcctcctgagtagctgggactgcaggcacccaccaccacgcctggctaatttttttgtatttttagtagagacggggtttcactgtgttagccagcatggtctcgatctactgacctcgtgatccacccgcctcatcttcccaaagtgctgggattacaggcgtgagccaccacgcccggccaactgaagccatttttaggggttttccacactcttcctatcataaactaggctgtggagaatgtcactctgtccgtctctgtgcccctgtccgcccaaattagtgggaccaaccccttttacaggacaccaaccccatttataagtagtttacaggatgctactttgcttctgtgaacttatccctttgttttattgtttttcgtttttgtgagatggagtttttgctcttgttgcctaggctgacgtgcaatggtgtgatcttggctcaccgcaacctctgccttctgggttcaagcgattctcctgcctcagccacctgagtagctgggattacaggcatgcgccaccatgcctggctaattttttgtatttttagtagagacggggtttctccatgttggtcaggctggtctcgaactcccaacctcaggtgatccacctgcctcagcctcccaaattgctgggattacaggcatgagccattgctcccagccgaactcatccctttgtaaacgtcaagtttctcctgtgtgggccaatgttcctgggggctgcctgggtttcctaaaatgggggtaatgatcttttatgacaaggggcatcctgaggagtgaccagtgactgagaaaacctggtagtctctcttgctgcaacaggattgtatgctgcgtgaggacaggaagggctgtttcttctagcccctcccctccccaggactcctcacccagggcccctgcacatggggactcggggtggctgctgactgcaagaaagaagggccaaggcgggagccccaggctggcagcgctttgtccctcaaacctgccaaaggttgtcgccaggctttgcactcatcttctcagccacctagctcccctggcagtaaaacattattttctatgaaatgatatgtctgacatttaccaaatttttatgtgacaatttagaaggaactggttgcattaaacagccttattaatattgcagtaacatgattggggaacatcatggctgttagaccacagggctctgatttataagctctggaggcacagaggtctccattgaccaaaacaccttcagctcaattcatgtatggttatcgaaatccagagatgcagtcctgtgatcacgcagcccgtcaaaacaagggtggtgttgcgagctcttcaagaactccggactcagccgggcatggtggctcacgcctgtaatcccagcactttggggggccgaggcgggcaggttcatggcagtagtcaagtggggctcgtgcatgtgagccctcggcatagctcctgactctcacttcgtgctcagcaggtgtgggctctcactgcggttccagcagggccctgtggtctctgttcccagccccagttaggaacacactggagatacttttggagactcttctagatctgcagaagaccccaagataaagggctgtggctctcccaggggttttcagccctctggggacagacatgtggagcaaactgtaatgaagcaagagcacctacaggggcctcggaccggggatggcgttgcggcacaggaggggtgagaacctgccagcagagcaggaggcagtggcattcgggattggccctgaggaaccaaccaggatgctggactttggccaggggatgaagctctgggtttgaaataggagcctcatgatccacagctgccttggggcactttggactaaggtgacagtgtgtgctgtgacaccaaggccttagggcacattgtgctgctggagggggatgggtttgggtcagggggcttaaggatgcatgggaaggggccacagagcaggctgagcccagggggagggctctgcacacagcccaggaattcccttcacagcagtacagaaagtgtgtgcgtcaggacaggcatctccctggagcaggtggaggggagcccagagggcagccccgcagagtccaggaggagatgatgaggccaccccagggacagcagggcctggggcagaggagggagagtggaggtgagagcagagggggctgagagagctctaggggacaggggttgctgtccttccatcctccctgggccttctgcacggctttgccctggcactgtgggccatttcccagatttgtagaggttgtcaaatgcacccctgttcccagggagccgggaaagtgagggcagatggtgaagtgttgcagggctggaccacgaggcagctggaggccaggacaatggactgggcagggttgcagggccaagtgcagtggtgagagcaggtgagaggaggggaggggaggaggggggtgtgaaggggagaaggaaggagggcaggaggaggggaggggaggggaggaccagaggaagcggagaggaggtgggggggtgaggaggggaggattggaggatggggatggggtggagagggggagaggagggtgaggagaggaggggagggcaggaggaggggaggctaggaggagagggggaaggagaggaggaaggagagaaggaggagaggggaggaggcaagagccagtctggagggagcgagcctgtgagccaggagcacagagggcgggggttgggcctcagcgtccttcatgaagaactcaattcttcaatggcagaggatgtttctttttcctctggttataaaacagttgatgttctttatagagaagttgagctacagataggtaaaaagaagaaaatagcccgcatagtcccccggctccccgatgaccattggtgagaagtgaggcctggtattcacaatgactcacatccagatgtttcttcttggggttttgagaggccggttgggctgaagctccaaggaatgacctgaaggccctggtgaagtgttcctggggcgctttcaccccaaggagctctgagcagccggagaaggggctgaggtatgtgggcctgtgaaggacaggagcacccagaaagccggttcctagggtgtccccccccaccacatctggggaaagcccagcctggcctggctcctggcccggccctgaagcctaggtttgaaattgtggcttaatgatccacagctgcgcttttggttgccagcgccctcctgaaaaactaaagaaggccttagcaatttgagagagctctgggaagcaggaatgaggccggggtctggggaggagggtggaagaggaagaaagagtctttgagggcactggcaacccccagctctgagcctgtgccctctcccggctttcttgggctcctgggtgctgtggatcttggctgggctgctgctctgggctgaccccccccccccgccccgcaaagctctgtggaaagcgccttacctgcttatctcccgccatctggaacatcctcctgaatctctgcctcatcgcccatcatctgtaccaaaagccattcctctgattctagtgttagtcctggcagagtggctgcagttggctgtcttaggtgtgcgagaaaatcattgtttagccaaggaggtggagggtggagggttatccctcaggctcttcagctcgggagcccatgccggagagatctgggaaagcatccttatttgttggcccaggtgaagagcagccaggcagggcagccaaggtgactcctggacccagccccagcccccgggagccacgccagttggggagatggcatgagggactggcgcccgcaatgtctctaggagctgttggctgagggtggctgaggccctcagtcctgtcttgttgggggcacacagtgggatcctctctccttgaacccagagtcactcagcaccatgctcgtggctgagggaaccagtgtacagagggaccccccaggagcctggagggtgtggcagcaaataggagccatggctgcatccaaggtggaaggaggccaactgggtcacatggcaagagggactcccaactcagggtgcagtcgagtctgatcgtgggatgagagccccggtggctacctccctaagtaggataagcagcccccgggggatctgcccaggcaacctcctggccccttgacgtgggcctgaagcttggaaatagcctgatggtgtccaggcaagggctgaggaggaggatagcaggagagtccagggaagccaagcaggctggctcagggggccgttgcaggcactgcgtgaccccagcattcatcacatactggcttaatgtgtgtgtgtgtgtgtgtgtgtgagagagagagagagagagagaggttttattttttttgaaagagtctcgctctgtcgcccaggctggagtgcagtggcatgatctcgtctcggctcactgcaacctctgcctcccaggttcaagcaattctcctgtcttagtctcccaagtagctgggattacaggtgccaaccaccatgcctggctaatttttgtatttttggtggaggcggggtttcaccatgttggtcaggctggtcttgaacttctgacctcaggtaatccactcatctcagcctcccaaaatgctgggattataggtgtaagacactgcacccggccgagattttcaatcaaagctgctatgtggctccgatgagatggagatgacagctcccctatgcggcagccagacctggggccaagcgcagcctccctcgggtcactgcttggcctctgacatgtgctgtcctcttctgtcaaatggggatctaatcctattgaacaggattgtgcaggttaaaggaaaggcttcttatagtgcaaacaaagcaagcatggcctctgccctcacagagacttcttggagctcaaacagaacaaatgtggcctctgccctcatggagaccccagcagcagggatggctcagcctgccaactttcatgttgggggtgcatgcgatgccggggaggacttggctgggagacaccacccatcggaggctggttttgttctccctgagtgggtggtccccgcagagagagcggggcctgttagaggactccagggcagaggtgccttcctgatccaggaccctccagccctttgtctctggcctgtgtggctgggggacaccacgtggttggccagcagatggagggacagttgcctggaatcccagtctcagtggctgagcaaggcaccctggactccccaggtgtggctgtgctgcacacggctgccccggcttctcagcactcatggccggctctcgcttccccggaggcaccgacatctgcctgttcatcccagttgtcctgtttgctttggaaccaggagcatgatttacgtccgagtgcgtttttatgttttgcaccaaaggttttaaacagttcctagacaaaacaattctattttaatgcacagaattcctatcttgggttatcttctttacagccatatatgttttattagtttatttttattggcctatctccttgctagaacataagctccctgaggaccagggcacacctgtgtagcactctgttcccggtgcctaccacggggccaggcacgtagggagcctccagaaacaggttgagagggtgcacagaccggtgtttgcaggggccggctgtttatgtagctctccctttgtggcagctactctccgcccatctttctcttaatagttatggattatggaaaagaagaacaaagcgcattaagaggttcccctacatttgatttgaggaagttttcatccgaatggctccattgattggcctttcgcgtgcagccttattcccttctcacaaaatgaatattgccttgtctccttgagaaaaattgatttcagccagaaaggagaagagcaaactccctcctcctgctcttcttttttttttttccctcccaccgagacggaatttatctcttaggtaggtggggggtagaaataggaataattggaccagaagctaattcccagagattcattgtctcgaaagctcccaccagaatgtgagaagcttgccttgaattgcatgctaatgataaatgacaactctaacagaccgtcacattgagatgtttagtccttcctgctaggagatgacacattaattttctctcagatttacattggattcttaataaaatatcggtgttggaatatgacaagtgaggggccacggaagcaccaggcaccatttgggaggcatggactttggccggaggagactgcggtggggctgaacatgagccaggcgctgggtggcattggagcagggctcccatcactgtgctgggatggggcttacgtgacctggctgcaccaagcagcaggaatggctgatcctctttcttgactatagtgttgaatgcaaagacaggtgatgccattaattctctctcatcttaaacccccttttctttggcttgtcactgaccaaatgctttcagcgtaataagtgaagttttctatttttaagaaaagttgctgtttcttgattaatttgctcatttgatgaggacttatggagtgtttgctgtttacaagttatgaaggtagagaggcagaagcagcagccagacatgccaagtctaagtgatcatcccacttccctgcttcaaaacctccagttgcttccatggcctcgagagcaatgttcggaattctcggaggatccacaaagccccgggatctaacccctctggacgtgcagttccctttgtctggaaggcgcctctccccgttctttttggctgacttttactctctttaatccctcggcctactatcactttttcaaggggccggggaggtgggggtcataacccctctgccctggtctggacccagcctctctgtaggatgctgtcaggtgccctctgctttttcttccttgcgcttaccggagttgcactctccaggttaatttatgccgtcttacattttatgctacatttgtattaagattggagtcctcgcttttccttcatcgctgttaatacacgtgtacccttggttaattcgtgtctctcatcactcttacagtaaaatccaccctggttcaggagcccagattacttggggtgagccgctctctcgccccgtctcctgcccctgccctgttctttgtctgccagcctctgccaagcttcctctccaaacctgggcctcgccacgctctctaccgaaagcccttccagggagccagcattcatgtccttgccttcgcctccgcttccacccagatgctgcgtcctgggagaggcctcttggctgcccattgccacccactcacagctgttctcaaacccactcattcgctatctctggtgggtcccctttccctcctgcagctctggggcctgcccagggcgggcctctgtgcgtcattgttcttcctccctaccggactgcaagctgtgcagaggcagggctgtggcaccctcagcacccggcgtgaatgctcagccgtgatagctgctcagtaaatattaactgaacaaatcagtgaacgtcagcgtagagtttcaagccgaggccctgggagccctgggaaggtgccatgaaggaggcgttcctccagtcttgctctggagcgagtcttggtcattaccatctctccaaatgggcagcctcttcttttcagggacctccagagacaatttatgtgaacaaactgtggcttaacgatcttgggaaattggaaaatacaagttgacctttttttttttttttttagatagagtctcactttgtcacccaggctggagtgcggtggtgtgatcatagctcactgcaacctccacttcccaggttcaagcgattcttgcacctcagcctcatgagtagctgggattaaaagcacctgccaccacacctggctaatttttgtatttttagtagagatggggtttcaccatgtcggtcaggctggtctcgaactcctgacctcaggtgatcctcctgcctcaggctcccaaagtgctgggattacagtcgtgagccaccatgcccagccaaaaatacaaattgatttctgactctgagttctggaagccctagccacccttcatcctgttctcaactctccacaaagacattgtggcccttagagatggaatctaggtgtgtcccgacccgccaggttctcctcttgcttggttgttcgggatcagccttcctagggttatagcgaggattcgatgagactgactgcatgaaacactagctacaggatagtgccattggctatccttgcttttattcagaaaaatgaggccgggcgcatggctcacccctgtaatccagcactttgagaggctgaggcgggtggatcatttgaggccaggagtttgaaaccagcctggccaacatggcgaaacccctgtgtctactaaaaatacaaaaattagctgggcgtgtttggtgggcgcctgttgtctcagctacttgggagggtgaggcaggagaattgcttgagcccaagaggcggaggttgcagtgagcagagatcatgccatggtactccaccctgggtgacaaagcgagactttgtctccaaaaagaaaagaaaaatgaaagcacacgctgaatctctgggaacgaagctcttcggaagcaccagcttctgggccctgcccattgaacacggcaaaagcaggagcaatcacggccgtctggtggcttgtggggggcttttaggccgacaaatctatctagtcgtttgttctctgataagaaaacctcttttacgattttcaatttgcccttattttaatgaaaagaagctgggattggaccgcccaagaaggagctaatcaaataaagcaaattggtgctaccttctccttgtccttattattcgtatggctctagctggaatgtattatgagaagcaattggttttcatatctggcagattgcagcctgggccgggcctgtcagccttctcttccccctcttttcataaacagctgagagtggccgggctgcggggtgtgggggaggacacggaatgcttgtaaccagttttcttgctccttgtcccccaaatcgtgaagacccctgtaaacaagtcagaggaagtctccaggttgaaagttagtaagccagttccttcctgtgagattcgggctgtcgccgtggcttcttgaggttccatgtggcggtcctgtcaaccttgctatgtgcaaggcatcaattactgccctcgctgggtttgtgcgagggagagataagcagaggagacgttccttcatcgcactttttccctccccttgcaacaaaaggaagaactacaatttaaatcaggctcagcccgcccttgctctgtatgaagtgttttgccatgggcggttcttgggctccccaaagtactatgagttgttgtgactgtagaaggggaggggtagctggggcgtgccagggatttgaaacaagacatcaggagggggtgcagtggggcaattccctggttctccccttaccggctgtgcgacgttggggaagttacttcacttctctgtgccctaagccttctcaccctgtaaaatgaagatagcaatacccagctactaaagtgactgtcagattaaaatggaacatgggtgtaaagggccctccccggcacctggcacaaggtccatgcagaataaatggcagctcttctcatggtcgcagttgtcctggttgttactgacattttagtccaggccacgtacctctaatggtgcatggaaatcaggccattccgtgttggaaagatcagaaagaaaggtgcaggtgcatgaaatatgtaagctgcaataaagggtgacattcctcattttccaactgcccactggaacagagattctgcactggcctcaggaatagtgtccactcttctaggacactgcaggccctgtcttgtcacgggagcctgattgacatttggggtcagggctgggaggcagttggaactgcatgaactgcctttccctccagccaggcccttccctgtgccttgtggcaggagcgataggaccaaaggcattgggaggaaacagtggagctgacctagggtttgggttccagctggaaaaagagttctttagaagccatccagatactgttcctggagtcccactgggaactgggacatcatctgttcttaaaggggtgctgcaagtaacagatcttatgaattcagaggagcaatagccggtcaacctgaacagagcttattgcacaaaatctgctgcctccgggccagggctgggggaatgggctgacaggagaaagatccaccgcaagtccacggctcactggaatagcaggctgggtctcagttgtctgcacagatgaaattggtggttgttgaggtcctggaaatgatcagttagtgacagagaaagtgggggtttgagggagaggggccatgaaccagacctgttttggatgcattgatttctaaagcaagacgctggaaagagtgtctacactttttattttgcagaattaacctagtcttcgattcaatccccagttgctccataaatttctacttaatatccacacgcaaaacgtctcaagaacacatcacccctctgatcttcagttattaatcatcttttatctacctaatttgaaaaagatcactccctaaagtgataggtgagtctgtgagctgcaagtgtttggagctggcctctcccatgggtgggtttgccggctacaccttacaatgcaccatttcattactctctcagtcccctcattgttactccccacaggggaaccctacaaaaagaggacaagtctgttagttacagagaacatgtgctatatgacaggcagcacaccgggcaccttacacacatcctattcactaaaacagagagaccaagtaatttgttcaagatcacacagctcttaaggagctgagctaaaatttaagatacaacctagatctcactccaaatctcataatcttcttttaaaaaacatactattatggaaaaatttcaaacatctacaaatataaacagactagcataatgaattcacatatacgtatcattcaactttaatatggtcagtcttctttctttttttttttttttaaagcaaaaacattttgctatggaaatactggatggttttataggattcaaagggagagatacatctgaagcttgggcacagaatggcaacagggatgagactcggtggtttagagcaaatgggctgaagtcagatagtctggatttgaatgttgactctcacgcttactagtcctctgaccttgaaaatttgcttaaccactcagtgtactcaactctaaaatggatataagagcagtgcttcctcataggtagttctgagcattaagcagttaatgtacgtgaagaatagaacatggaatgaccaagactcgctgcagagcaagactggaggaattccttcatggctccttcccagggctcccaggggctcagcttgaaactctacgctgatgttcactgatttgttcagttaatatttactgagcagggccaggtgtggtggttcatgcctataatcccagcactttgggaggccaaggcaggcagatcacctgaggtcaggagttcaagaccagcctgaccaacatggtgaaaccctgtctctactaaaaatacaaaaattagcggggcgtggggcatgtacctgtaatcccagcttccagggaggctgaggcaggagaattgcttgaacccgggaggtgcaagttgcagtgagccaagatagtaccattgcactccagtctgggtgacagagcgagactccatctcaaaacaaaacaaaatatatttaccgagcagctatcgtggccgagcattcacgtggggtgccgtgggtgccacagccccacctctgcacagcttgcagtccagtggggaggaaggacaattttatatcagtgcccgctatttggtaagcactcaataattgttgtttctttgaattcttcttgttattataccatggtcagtcttatttcatccatactctcccattccttccctcaacattatttggaagcatctctcagacactgtataatttcatcagtaaatatttcagtatacttctctaaaagataagttctcttttaaaaaaatacttctgcactacactgatcactgttacaaatgaataataattctaaatctcattacatacccagtcactgttcaacatttcggttgtttcacaaatgccatctttcattttacagtttgtttggctcagacagtatccaagtaaggtctacatattgcaattggttgattatttctttgactttttcaggctatatgttctcattccagcacactcctgctctttttttctctcttacttactcattcttcctcagagaattggttaaagaagccaagtcatttgccccgtagagtcttccatagtctggattttgctgactgtatccccatggcatcatttacgataccatgtcccagcgccctctgcagattgtagaaagtggaggttagagcaagagttctcaatagcttcaaggtcaatttttttttttttttttttttttttgcagcaaaatgtacttccatcaggggatgtcttagtccatttgtgttgctataatggaatactacagactgggtaatttataaacaatagaagtttacttggctcatggttctggaggctgggaagttcaggagcatggcgccttgtgagggcctttgtgctacatcatcgcgtggtggaaggtggaagggcaagagagggcaagaatgagagaatgagaatgagagaggaggagggggccaccagactcacttttattaaaaaaaagccactcctgtaataactaactcactcccaaggtaatgacgttaatccattcatgacctaatcacctcttattaggcctgacctcccaacagtgttgtagtggggattaagtttccaacacatgacctttagggggacacatccaaaccatagcagaggacatgtactatctggttgtctctcttttgtgatgtcagccaccattgatgatccatgcccagatccattaattcattagggatgacaaaacaatgatattttaattctctcatttcttcttcatttattggctggagtacttttatagagaaagttctttctcctcctatttggtaactcaaaagaacagtttgtacaggaaaggcaggatatgtggcctaattctccttttctttttttatttttttagttttcaaaataatgtattgggtcactagcatcttccaacaatgagcaattagttttttgtttgtttgaggactattatgaactcatagatttaaacatatttaatgtatttcagtcgaatgttgatgttcaaattgtcccatctttggttagtgggagcctcttcaagttggttccagagtctttttttttttttttttaattgagatggggtctcactctgtcacccaggctggagtgcagtggtgctatctcggttcactgtaacctccgcctcctgggctcaagtgattctctcacctcagcctcctgagtagctgggaccacaggcatgtgccaccacactttgttgtagagacagggttttgccatgttgtccaggctggtcttgaactcatgagctcaagcaatctgccctcctcagcctcccaaagtgctgagattacacacgtgagccaccacacctggtctggagtccttttcatattagcttaagtcttccatacagctaacatcatacttaatgatgaaagactgtatgcttccccctaaaatcaggaacagggcaaagtgttgattctcaccgcttctattcaacattggactggaggtgccagccagtgcaataaagcaagagaaagaaaagcatccacaatgggaagaagaaagtggagtcacaggtgacttaattatatatgtaaactatcctaaagaatctacaaaaaaaatttactagaactaataaataggtttagcaagggtcacaggataagatcaacatacaaaattcaattgtatttctatatagtacaaatgaacaatccaaaaataaattgagaaaacaatttcattcataatatcttcaaaataataaagtgcataggataaatgtaagttacaaagtgtaaaacccatatattgaaaactacaaagtcttaatgaaagaaattacggatttacctgggtagaaagacattccatgttctgcaattggaagtggttggaagactcaatattgttaagatggcaattctctcaaaattgatttctagattcagtacaactccaattaaaattctagcagccttttttcctcagaaattgtcaagctaaccctaaaatatatatggaaatacaaaggacttaaaatagccaaaacagttttgaaaaagaagaacaaagttggaggacttatagtcccggatttcaaaacttattataaagctgctacaatcaagatagatagtattggcataaaaatagacaatggaacagaagagaaagttcagaaataaaatcatatgtttatggtcaatttattttcaacaaaggtgcaaaagcaattcagtggagttgggggtggagaaaataggctgtttaaatttaaaaaatggtgctgggacaattggatattcagtgacaaaaataaacttgacctttatctcacaccatatgcaaaaattcactcaaaatggatcatgacctaaatgcaagagctaaagatataaaagatatagaagaagacataagacatgtttattaccttgggttcggcaaagcacccttagatgagactaagtactattcataaaagaaaaaattgataaattggaacttaccaaaggggaaaatttttactcttttaaagaaaccatcaagccattaaggaaaagagggacaagttatggattgggagaaagtatttgcaaatcatatgtctgataaaggacttgtatctagattatatgtaaagagctcttaaaactcaaaaaacaagaaggcaactcaattaaaaataggcaagagattcaaatagattcaatgtctatctgaatggctaacaaggacatgaaaaggtactcaacatcattagttattagggaaatgcaaattaaaaccacaatacactcactaggatgcctataatccaaaagacagataatgtcaaacgctggggaggatgtggagaaattggaaccctcctccattcctagtgggaatgaatggaaaatggtgctgccatgttggaaaacagtctggcagttttatttttatctaataagatgtaagtatctttcacatattgttgctgggttttcaatcatggttaagaaagttttctccactttcaggttatagagaaattcacctgtattttcttgtagggtaggtatgattttatttattacattgaaatctctgactgtttagcatcagtgctgctgtatgatgtgaggggtaaacccattttggtattttccatgtgccttctaggtcccccaatttcacttatgaaaaacttgaccccttcagccaggcgtggtggctcacgcctgtaatcccagcactttgggagggtgaggcaggcagatcacaaggtcaggagatcgagaccatcctggctaacacagtgaaaccccgtctctactgaaaataaaataaataaataaataaataaataaataaataaataaaaattagccgggcatggtggcgggcgcctatagtcccagctacttgggaggctgaggcaggagaatggcatgaacccagaaggcggagcttgcagtgagccgagatcgcaccattgcactccagcctgggcgacaaagcaagactccatctcaaaaaataaaaaataaaaaaaagaaagaaaaacttgacttcttctcccactgacttgagatacctccttgattgtgtatactgaatttgtatgtgtaagtggaattatttctgaaatttctattctgttccattggcttgtctctgcatgtgtaaattccatactttttaagatataaaacttttctcatacgtgttaatagctggtaacgctagcccctatgccttggtcttcttttgggaggtttatttggctattcttagtgcttcttcctttcaaataaactttacaataaaatgttctagatccagaaaaaaaattactgatgggattctcattgttatgacttcacatttatagattaacttgggttttcttctagggtttttatggttttaggtctaacatataagtctttaatccatcttgaattaatttttgtataaggtgtaaggaagggatccagtttcagttttctacatatggctagccagttttcccagcaccatttattaaatagggaatcatttccccattgattgtttctgtcaggtttgtcaaagatcagatagttgtagatacgcagcattatttctgagggctctgttctgttccattggtctatatctctgttttggtaccagtaccatgctgttttggttactgtagccttgtagtatagtttgaagtcaggtagcgtgacgcctccagctttgttcttttggcttaggattgacctggcaatgtgggctcttttttggttccatatgaactttaaagtagtttttttccaattctgtgaagaaagtcattggtagcttgatggggatggcattgaatctataaatttttcaggacataggaatgggcaaggacttcatgtctaaaacaccaaaagcaatggcaacaaaagccaaaattgacaaatgggatctcattaaaccaaagagcttctgcacagcaaaagaaaccaccatcagagtgaaaaggcaacctacagaatgggagaaaatttttgcaatctactcatctgacaaagggctaatatccagaatctacaatgaactcaaacaaatttacaagaaaaaaacaaaccaccccatcaaaaagtgggcgagggatatgaacagacacttctcaaaagaagacatttatgcagccaaaaaacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttagtgggactgtaaactagttcaaccattgcggaagtcggtgtggcgattcctcagggatctagaaccagaaataccatttgacctagccatcccattactgggcatatacccaaaggattataaatcatgctgctataaatacacatgcacatgtatgtttattgcggcactattcacaatagcaaagacttggaaccaacccaaatgtccaacaatgacagactggattaagaaaatgtggcacatatataccatggaatactatgcagccataaaaaatgatgagttcatgtcctttgtagggacatggatgaagctggaaaccatcattctcagcaaactatcgcaaggacaaaaaaccaaacaccacatgttctcactcataggtgggaactgaacaatgagagcccatggacacaggaaggggaacagcacacactggggactgttgtggggttgggggaggcggggagggatagcattaggagatatacctaatgctaaacgacgagttaatgggtgcagcacaccaacatggcacatgtatacatatgtaacaaacctgcacgttgtgcacatgtaccctaaagcttaaagtataataataataataaaaataaatacataaataaattaattaattaattaacttcggaagattgacattttaatgatcataactctacctaaccaagacatgtttttgcatgaatcaaaacctactcttgtgtctgttagaatatttttagagtttttcttttaggttttgggaatttcttgttaaatgtatgcctaggcatttaattttgtttttctgtagtaaatggggacttccatcatttcatcaatctatctagtcaatagtttatattttaattatttagccaagatatatatatatatgtgtgtgtgtatatatatatatatcacacacacacacatacatacatacatacacacacatacatacaatgtctataagctattggctgataatctataagccaatagcatatagatgtttcatatatttctgtcttatatataatatatattatacagttttactctgtgtaatctacgcagtcttactgagactgtattatatatataatacatataacagatcttatagaagatgtatctataagccaatagcttatagatattatatatatacgatatctttcttggctagataattaaaatataagctaactttatacccatttctttactgttataatttgtagtaggtttccattgatcccctgacctttttgccatgttgcactgagcgctattggttttgctcgctattagtctcttagataaaaggtttccttggctagatacctccctagtgagaataaagctccctgttgtccccgtatttttcttgacatgcctctgcacggctgcagtggaggtctcggaaggtttccctgtggctgtctcacaccatcagccttcgttcagcttccccagaaggagatcccgagatgaagacttgagtgtgaacagtttatctgagaagccatcccaggaaacaccagtcagggcatgtggaagtgaaagaggaggaggaggaatgcaaatgaagggccattccccctgcaagtcaccactgtgggaactggagctaacaagcagaggggagtttcacatagggcactcagagcgaccccctccaccgggcagggaagcctgagattgccccagagtgaccccagccacagggaaaggaagcctgggattcacccatgaaatccctgtctatcgggtaaaggatgctttcagggtggtaatgatcacccagcaggtggagcagaacggagactggccccacagcctgtgctagcccagcagcctcaggggcaactctggagtcagaccaactcagcgtgtatcctgcctgaacactttgtggctagaatggtttgattatatgctgggaatgataataatacctacctcatagggtgggtgcaaggatgccaataatatggatcatagttaagggttataggtataagtacggatatagatttaggtgtagatgatacagacacgcaagtggcgtgccccactggtaccgggcacacagtaaatcaacaataactggaagtgggtggcattattaagttgcaggacttccatgcctgccccatgaagcttctgttatcctgtctgcctgcaattccattcctgttttcctgctcttcttgtggggaggggggctatcttttatgccatcatgaagtgtgttaaagccctcccctgactgggccctgtggtctagcccacctgtcattcgtcccagagcaggaccccacttccctcctccttcctctgatcccttcccaccagctctgacctgcttttttttttttttttttttttgacatgctttgtgccccaggccagagtgccgtggcacgatctcagctcactgcaacctctgcctcccaggttcaaaagattctcctgcctcagcctcctgggtagctggaattacaggtgcctgccaccatgccaggctaattttttgtatttttagtagaggtggggtttcaccatgttggccaggctggttccaaactcctgtcctcaagtgatccacctgcctcggcctcccaaagtactgggtctgacttgcttttgattcttttctgggacggcagtacggcctcattttctttgccttgggggcacgtgggcccttctgcagcctgtctttctcctttgctgttcctaggaccctgagttgtggtaagggccttccccatcacacagagccgaacaagttctaataaaatcagattggtggattaaacactattaggttgctcattattgcaagttaaaatgatgattccatttattaaggccatttaagctggacacttaagttccctgtgggattgtatcctgctgaaagtgccggatgacagggctactctcagaatgccaaagggcgggtcaccagaggaaggtgggtttcctagggtgagtgcagttgcgattctgactgtgtacatgacagtgtttgagagagtcctctctctgtgggtcataccacttacgatgtgggaacggtttgcctgagtaccctgctgaggttattagtcatatttagaaagggcaagggatggaacaaatcacagttcatgtcttagctcacaagaggctagattggatcaacgtccagtcttctccttggatggagtatcttcattctccagtcacagaaaacccatccacagaagaagacccggcattgccacactctcatgagtgtcttcattctttttttggagagaatgagccacacgcagagcccacctgtttcattaaacaagttcccttgcttattccttaggaagtggtcctaagcacagtccgtggacctcaggcaccttctaatgggtctttcaggggcggggagggcttacagcacggtgaagattaaggacaaacatctagagaggggctgaagcgggaagaggctgacatcgttggccccacatgcaagcctacctgccatttagaaatggaagtgaattgtaaggtttccaatgcagacttgtaagcaggagacagataccagcgggtgacagcattgtgacaagcgcgtggagccatttcctgattgttttagtcgatacagacttagggaggaaaccaacactgacacaaaccaattgtgccctgatcgggaaacaatgaagtatcgggagtcgctgttgaaagtctgtaatttccagcggaattgctgtttagtcatcatattgccgctgaatgacatagtggggctgggtggaaactacaattagctgcagtcaccctggtgggactgtttttttccccccagacaatagaatatgaagccatcaacagccaatgttctgtgctgcttgtgaaatggcccattgttcgtagcaagaagaaaagaaaggcgctggagggtcttgccccagccctgcgggggacagatggctgacttatggtttcctcgcctccgttgtagcagagcaacatacaagccaggctgaagaagccccacttcatttgccttatttgtgtaaagagctctctggccgtggctgagagtgaggtggcaagcctgcactggcctcgtggtgcgcagaatcgctggcattcctcttcccctgctgcacgttcaggtgcagagtggtgcagcactgcgtggggtgctgctagattttgggggagtcttccttgacgttggatctgcccacagctactgaaactttattctgaaagtggtttatcacagcacttgccctcagctgctagaggggtttagttctttctctccttggggtttccaaacccaaatatgtgacctgaccaccgcatctgcagatatgcacgtcatcagcctctcctctctgtggtggacgcgtgttttctttttggcaaattcaaggttctttacctttttcatcatcacacgaatgaccatctaactcttagcatttagggagcaagccgctatttccctgagatgctctggctgtggactgaatagatgactttacctggcagtatctgagacccctgacagctgaagcctaaatgggaaagaatcgggtacttagcttgcttgagaagcaagaccgcagatgctctttcatatctagcagtaatctaaatgcaggcaatgaaccaacagcatttggcctcggtgaacagctctgccatcggtctgttcttaacatagtcatctagcgtctgcgttaaacttatttatttcctaatgctgggtgatggattaaaagatgtgtagaaaatccttccacaagagataagatattgcaggctgccacgacacccctggctctttttgctttctgtctctgttttgcctacttttcagtgcagagctcaggcccccacatcgtatatcctgattactttgtggttattactgaggggatgttttttaagcctatcattgacacatttaattcattaggtaccaaatccaaagcaaattttggctggccataaaacatggttaatccagggagatgcaataaaaggtgaaaaattatgttccagcaaatgtggaatattgcttttctgtagagacttttactggtcgatgatatctttcttcataaatttttcttctacttggtactcttggtaacttaaccatttgttgtttccagaccacagaatggctcaatgatactctacaacaggaagaaagtgaaatacaggaaagatgggtattgctggaaaaagaggaaagatgggaaaacgaccagagaggaccacatgaaactcaaggtccagggagtggaggtaaacagcagaaaaggttcccttggtgcacaaatgtcatttgcaggctgcagtggagaatggaattgcttggagtaatttgatgcgagtcacctctgtccaaagaatttttgtttgccaagaccctggtttttgcttttgtttcgtttttctaccttcttaccctatagtctccattcaagttttcagtgaaactggattgaactaaagcactcctgtttcttgggagtcattgctatatagatggggatttgcaagtttcctgtggactcatttgttgtatttatcacggaagagcctctggatgcattgagagtttgcaaagtgtcagggaagaggggaggcagcgtaaggaacttccctcttgaggtgaccctggcctccccctgccaagctggcaggcccctcacagagcctggcttcaccccctccaccgacaaaccctgggtgtgtcagccttaatagaggtttgagatcattagatgggatcacaggtgtgcatgattcttgcatggttggggtcctgcagaaacatcttgggatcttgggccgacttcgggttttggcccttgggtaaagactggtttccttgctgttgttttcaccccacagactctcaaccttgggcagccatggagaaattcccttattcctctttgccatcgtttgagggcctgagccatgtgtcacagccgtagagggggagggcatgagtcaaggtgaagtcttggcctgctggttaactagcatccacttccctgcgttcctaactggtcctgggaaggaacttcccctgggaacagggaaggcattgccttgggcccggagctgagaagctggctcgtgatccacctgttatttcgaacgggtcaaagagaggcattctggagtctgttggtgtgttgagtttgcgagcatacaggatggatagctgggaccataaacccacttgaattcaatgtgttacccttccacgccaatgttttttgtgacatgctttgtcatgatgactttttccgtataaatcatgtgcttttatggctgttaaaaatagcaccaaatggcctgtattatatgacctcacagagggatgacttttgttttatgttttttttaaatacctaataacaatgctttatggagatgcaaaaagaaaagcctctatccaagaaattccagttcctgcattctcctgtgctcagtgtttgcacagtgtggtttaattgactgcacagaacattaaaatgcagattcccccaaacacactgctctgggcgcacctctaggacggtgaccgctgatcgtacaaaggcattagccatcatcgcagggagccaaaggagggagggcttggttcttcctgggaggaccctcatctcctacgctggagggagaggtagagagtgaggcaaggctgggtggggcccccgaacaacgaggctgctcgcaccgggagtaatagggctgcgggaattcaaactggaagtcacggcagctcctgtgcccgtaggcccctggtatatttcatctttagtaatacgtacatcaggaacttctgctcgtgagtaacagccgggtggaattcttcctcagcagcagctgagaagccgaggggagaaaacaacccacagtgttcgttttctttcctcatgttataaattagagttgtcactggatggaatcagaatgatttatggctatttgttaggccatatttgtgtttggagttatttgtgtgctcatacttgcaggcaacagtctgtcccctcagaacttcgggaaagggagacgggcaggatggggaggggtttccatgacctcctaacatggatggcagtgtgggcagcgggaagagccggtgacacgatgcttgctttgggttctcagagagaggccacctactatgatgcattatgtggtggccttgcccgtgagctcagcgagttgtcccactgagccactcagcagatatcgaccctgtgtgcctactctgtgcaaggcactatggtgtcagcagagagaacaggagtcatattctctgccccacggactcatggtcaagttgaagaggcttgaagtacgtgagggtcatcaatagtgctgagacgcagagcagcctgggcttttatgataagcatcccgggagtgcagagtgggctggaatggtcagagacacttcctaggtcagatgggatacaagctgagcccttaaagtcgggtgggactctgtgtgtgtgtatatatgtttgtgtgtgtgtgtgtgcgtatgtgcaatttacatattgtttgcagtttaccttttccactctgcattgtggtctgagctgtgtctatgttgatattgaggtctcttcatcccttttcacaatcctatagcattctactatataaacacttgagccgtttccctggccatagcccccactttagattcctttcagttttttagcattataaataacacttcaataagtgttcttatacacgtctttttgggcacataggcaacctggacccagaattgctgggttataaggtctgagcatgttcagtttattagacactgccttatggctgcataattacatgcccaccagaactggcgattacagttttccccacatcctctcgcttagtgatagatgagagatggtacccccttttatttgaatttgagtttgtcttaattattagtgaggatgagtgccttcttatgttaatgggagcctgttgctatgaatggtctaccatgggcatggacatggatttttaaacagccctgaagaaggccttttcagacaagatcaacccccacatctcaccagcatttctgctgcattacctctgatctggaccaagggtggggaagcccagggggtgtgctctggcacagtgggtggttggtcctttccaccaggaaattgcaacagggatttccatggggctttgtacctcacaggaggagggggcttctgagtttggactctgcgtccgtctttggtggattcaatcaggtggttcccatagactcagcatcttcatcacgtcaggcacggcgccagccagctactcttctgctggttggggtggacagtcctgcacagggtcttggagctgtgatttttctaccaccggggctgttttcctcagttcaggggcatgataaagatatttggatctaccgtttaatatatcacttgctataagccttccctcaggccaggaaaacttccagccctgtttatggaactgttcagccatctcgcttcttttgttctcagaggctggggccctctctacacacggcaattcaaaggcacattgattttctcagccaggcacaggatgggggcagctgcttttgaagctgacgagctgttaggtccatgattagttgtcttgtctgcaagccaaggagaagctagctcgataaggtttccagggatgacaaaggttggcaggaaggaaaaagagggtggttgcgatgtcactgtttcaggagatgaaatctcagcaggtctggagttggccctgcaccccatacagatttatgccagcttctttggtgcctgacagtgtggaggagctttgggagtgggagactctcagagagcgaagagctggatgtgaagcatcaccctggttccggggtcactgcagctttgtggtcggatgagctgagggaggttagtcagaggtgatgctgttctctgggccacactggaagaattccttccaagttcatgatacttttctctggccccagaagcttgtggggctgccttaggtcctgtgtccgcatctctctgctgagagtgctgggtgtcccagaacccaaggcagctctgggctcttgtcctctccagtttctttgctgctgggttcccacaacagatgggagccacacaattactactgagacagtcatgggcttacacatttcctatataccaggtatatcatctcattgaatcctcataaacacatccatgcaaagtacatggtattatacccattttatagatggagagattgaacctcagagagggtgtctcttgccctacgtcatacctcagtcagtggcagagctggtacttgagcctgggtctgcttggttctaaagctcaagctcttgccattatatcagttccttcggggtactcgggtggggcctgtagacttttcagatgaagtcagcacctatttatttagcacacatccttccttcatccactggggattggaggctttctatccacctagtatggcaataggtgctgggatgcagtgatgtaaagagaacgtgtggtcccctatctcatggggagactaaaaaaatcaatcatgcaaccctgatgcagggttttgagggctgtgatagaattacaaggccctgtgtgggggatgcaggaggggaacctgaggccgacttggcctgaaggaagtgacatgagcataaggaagtggggtgcggtgggagcgggtcaagtgacagaggagggctgggaaatattaatgaatagagtctgttgagaatcagccaatgtgacttgaagcaacaggcaaccagaatcgtgatgggtcagtatttcccccaggcctatccagaccaggtcttatcctcctagcaacgcggccctctcggctcttaaggcgtgacttgccatggatgttctgcctttggaaccagtgggtggtcacagcacagaggctgttggtttcatggctgtcacatgcacagagacagccctgtccactgagcctgttctgtggcagaaggaaccccctagcctggaccatctttgggtggaaacaccagcccctcacgtctgactgtcattttcagatgtgaagagaacacacagtgttgctgatgtgtttgtattgcctgtaaacaacgaagagtttctttgacttcttaactgccttaaagctagaagcccggcattaggatggcagtggtggtaatgaggttatgttttgagacttggcctcattagaagtgatgttctttatttgggcacttaggccacatataaaaaaaaaagaaagcacctcttttaaaataggaatgatattgtagttactgcattaggaattaacagggcatgaaataactgtctgccctgtggcaatgccagatcatttcagctccgcttgcagccataagataaattggtatcttgcttgcagccactggaaaacattttaaatagccagccatgaacatgtatggtgcccaaatcaagtttgaaaaacagcaataaatagataaagtggaggtaaggtgcctaatgaaatgaatgaggggcaggagctcacagaaggcaaacaaaccagcagggaggcgctgcgtgtttcacatacaatacgtatttctacttttagtaaaaaatcatgtgtctcacgaacagaaaacccaacaccgcatgttctcactcataagtgggagatgaacactgagaagacatgggcacagggaggggaacatcacatacctgggcctgtcagggagtcgggggctaggagagggagagcattaggagaaatacctaatgtagatgacaggttgatgggtgcagcgaaccactgtggcgcgtgtatacctatgtaacaaaactgcatgttctgcacatgtacgccagagcttaaagtacaattaaaataaaaaaataaaaaattataataataagaaaattaaattaaaagaaaaacatgtgtcttcggtctgtggacagattattttactccattaccctccagcctcactgtgcacccaccagtccataccctaccgtattcctcattcagaagctgtttttttcccacgtctaggtccacattgtcttagcctcataacttctgattctcccccgccccgccccaaggctatctcccctgatcttctttagccagaagtgatgatttcctcccctacattgccgttgctttccatctgtacccttcttaaggaagtgttcaggttgccttcctatcagccttgtccagttcaaaaaagatacatcgagtatttattttctccctgctagaaatcctgtatctggtatccaaatctaagtaacaaggagtctccacagagtgtctacagaatctaccccacacgaccttgctctgggaagtagatttgcccagtgactaactgcttccacagttacacttcctgcaaacctcaccccaaccctgtgattcagtcctggcagatacgtttatcctcgttggttgtgcatctgggacttgaacctaggtctttggtttcagaagtggggctgcccctcctgtctggcttcaagccctgctggttgaggtgtcttagtctcatgaccgtttctagtacagggagcgtctgttcaggggcacctcagggaatctcccggggctctctgctggcttttcatcatctgaatttttgtgcctcgttctgctggtatactaacaagttaaaacttaatttcctgttacctggatgtgttttggtagaatcaattcaggagctcaaatccatagttcttccttaatttctaattacttggcatccctggtgacatgtttctacccaattcatataattaaaaatttaactaataaataacattaagctagctccattttgaagtagcaagagcagccctaggccgggcacggtggctcatgcctgtaatcccagcactttgggaggccgaggcaggcggatcatgaggtcaggagatcgagaccaacctggctaacatggtgaaaccccgtctctactaaaaatacaaaaacattagccgggcatggtggcgggcacctatagtcccagctactcgggaggctgaggcaggagaatggcgtgaacccgggaggcgcagcttgcagtgagctgagatcgcgccactgcactccagcctgggcgacagcgagactccgtctcaaaaacaaaaacaaaagcaaaaacaaagcaagagcagccctttctgtttgcatctgctgagttcacaaaggcctggcagggtgctggttttgcttctccttctgtcttagccacatctagttgctatcacaaaagatcatagactgggtggcttaaacaactgaaatttattcctcacggttctagaggctgggaagtttaggatcaaggtgcaggcggatttggtgtctggtgagggcctgtttcctggtgcattttggtgtctggcgagggcctgtttcctgggcattttggtgtctggcgagggcctgtttcctggtgcattttggtgtctggcaagggcctgtttcctggtgcatagatggccatcttctcactgcatccttacatggtgggagggcaggaggagctctctggggttccttttatcagggcacaaacaaaccccattcagaaagccttcactctcacgatctgatcacctccccaaagccccacttccacataccatcgcatggcgggggcgggggttggttttcatcatatacatgttgggggaacacagattttcagtcttcttaaggctctctcttccctaactacagccaaatgacaagagcagcagtaatcacagcatccttttttgaacttttactgactatccagtcctgtgcgcatcatcttatctgcatcatctcattcagttacttggtaacatccctatcaggtagatactattgtcatcctcatttcatccacggtctgcaagacaaagacacagcaggtccctcgctgtccacttcagtggttgggagttggtccccaaacacactgcataactggctgtcactcctcagttgcaatttgatccaagagctgttgagtcctatacattcacacgagagctttcacttaggaataacaagttgtttatctcctcccagcatgaactgcccatttccatttgtcctgaagccgtagcttccgagcttccacggcacacccactctggcagcgagggtctgtgcgtactcttgctacgcaggccagattgtatgttgccagatttagtatgtacatgcacagacatgtgtgcatacacacacaagggagaatattgatgcccagttaaatgtgaatttcagataaacaacagtttttttttagtacaagtatgtctatattaaaatattgtccgttgcttttgtggaactcacagtttgctgggcatcatgtattttatctgacaaccctccaagcatcagagctgttcctttgaacctttgcagacagaggtttgtctgttttggatattggtcccattgaagacatgaggaagtgagttggtttatctccagacacatcattgatgtggggaccataaaaggcaggaaggacactggccattgctgaggagaagacacgctagcaggttgctagcaaagccaaatgctgccagggctggggactttcgtgctccctctgaaaagtgagtcctggatgtttctcaaataccaaaacgtgaggacttccagatacccagatctggtgccgttagatgctgcaacctggagaaattcaagccttcttctgccactggtgttgggggagaagcttgttagtaaaagatgtgccaggaatatgtagcaggaagtgtgattgtagtttctgccttccttgtatctctggtagatgacaatacatacaatattttgtaatttcctttttaaaacttgatatgagccttattaagctagaaactccctgatgaaggtagagcagcagcatatcaacttggtgtgctgaacttgtacttaattattatcataatagtccctcaacatcactgcacgttagcccataaggacaggaatggaaattttagcatattcagttacaatgtaaacccttgaataccactgtcgaaattcaccaagggccattctctgtttggtccccaacacacagcagggactgagtgaggtattacccaggtcacacaacctggatgtttgcaagcataatttacagcctcacccagaaaccgggcaggcattggaagaccataatagatacttttccccttggtaagtgaccagacatggttatttgccttgggtgaagagtagctctggccatcacttgactgaatcatcaaatattgatcctctctgcatctttcattgctggggaacgttgctggggaagtttcctcccgtcattggcggctgtggcttatgtccgtgtgaatttatgctcagtcagcacgaatctccaggcttgtcctcggatagtcgcggccattcactttagttggcgtggattaggcaccagcagagggcagggatatggcttacgggctaagtaggctcataccactctgcttcccacacgccggggcaaaaatcatgaggaaaacagggtgtaaatgaagggctcttttgccaccagtaggagctggggagaaaaattttaccaaacgagttaaagaaggaacgagctcctcacgcagcagctctggtgaggctgctttgatggccgctggctccggccccttgtttccttctgtgcgggtgtgtgggtttctggctgctgagcttccctgtggatgccctccctcactgcaaggccggagtggaagagggaaagcaggtgatttcatgaaagagcgcctttctgcttcatgaggtttttctcctggacagatgaaataaccttccacgtcctccttgcacttcgtaattcaacagcttgtaactcgcgcaaaacctgagaccggcgcaaatactgaagcggtcagtattgcttcttgctaccctcagtgtggtccaaagattggtatgttcagcatcacccagggggtattagaagtgcagaatttcaggccccaacccagatctacagaatccaagtctgcgtcttagtatgagccccaggtggttcacacacactttaatttggaaaggattgggacacgccattctgttgttgccagtagggtcctgcctcagtgccttgcccccaggcaagtggttatttatttatttattttaccttgtcttaagagaaaagtccaagggaaaatttcacaagttgctctggcaatttatgacttgacttcaagcacctttagaaaatatcgaattgaaatctccaatgatatggctggagcttatcattctttattctgcccttggcaatgagcgatagagaatagcaggtttctgaaatcagaacacactgagtggcgatgactaaacagttccctcagcctttgttctctgggtgaaatggtcctgttcttccatcctttagctcctctgaacggggaacttgcctgtctgttcactgctatagcccagtgcttggcatggcacctagtattgagtacctttggtgccaaataactacatttttcaaaagaatgaaagattttgaatgaatggacctttaaaacaaagggccagacagtaaatcttttcagttttgcgagccagactgtccgtcccaacaattcaattctgccattgtagcatgaaagcagccataggcaatagtcaaggaatgggcgtggctgtgttccaataaaactttatttacaaaaacagactgtgggctggatttggaccatggatgtagttggtccactcctgttttagattatggccacggtttctagaaggagtggggtgctctgtgtatgtcctgctactcatgtttacagccgcctgatgctattcatactcagcttatatttctgcaatgaatgtatacttttatttacaacatacctggtgaggttagggtttcttctttaatgcatgtagcataggcttgtttgtttcttcttgaattgtcctcagcctgaaaacattaggcaatgtctcttgcaaaggagagtttgaatgtgggaattgagaaatgtcctgtttctcttaaaagctcagggcactgcttcatggcattgtagagagggcagggctagtcccagtgatacactctgtgttctcctgtctagtggggatggctgagccaatggcatgtgtccttgttgagaccaggtgggttaaaggattggggtgtcacagaagataggctgaaactgcctgcatctttaggcgtgcagtgctttgaatgaagcctgtatgttgctggatgcaacagagtccccctagaatagtgaccgatgggagggcacagatgctatttgtccatgtttaagtatttacatgacagcacgagaaaactggagaggctctctttcatctttgctgccacaatttacctacagtttatgatggatgcgagaggtagacatttatcacaaaagtgtaagaaatgttgactcttcatgaattgattacttagaatgtattttattaaagattctaggtggcatgtgataaactgaacctctgctggtttgcagcttaatgattcatgcatctgtggtggtgataaggaaatcaaagattcggtttgccttttcagagaaagaatatggattattattaaatctggaatgggcctcttgagaatccttccttagggagcgtacatatcaatactttcttctcgatgtgagaattctaatgcttcacttatggaaacataaattccacagcaagtggctgcgggttccttccttccctctggttccttacatcctttgtgcgtcgaggatgcgtttttattccttagttagtacctggcattcatcgttctttagtctccatggttttgtgtttctattgataacttttaatgctaagagctctgttgaggtctatgttttgcagcagctgagatgctggtagagaccaggatggtgtatttgcctgtcatcccattggcttgaaatttcctaacagattgggttaagtcttggaaaagactaagagtaactattagatctcagatttccaacggaagtgaggtcagctcacatgggatgtagaatgttaccctgaaccaattcatgcagaagccaacaaggccgccaagcacatctagtgagttgcatctggaccaaggacagcagatcagaatgccccgtttcactaggctttgcggatggtggaggtggaggcattcctgttctcaaataacagagtcagggagggctttgctgaaggcatccggcatgtggcgccccagccatcacctcaggacagaggatgcaggcggagctcccaggtaacattcaatgatgaataacaagcccacaggcttacagtgacattaacgaggtgttggcgttgtctgatagcttgagtttcaaaatactgtgtgacttctttttctttcaaaaatatcagacagaggttaaatactgtaatcttttccataggagactgtgggaaaataaattgggaaaccccaagactccttgttttcccccagattccttacccgtctacatgctgtgcagcagaagcaacgcttaatccttttatatgatgtggtgccctcacactggtattttacttaaacccttcattttgttggatgcttttatacatggaattagacctaattgtcaacataatgccatattaagtttagtttcccaaaagagtaaacactgaactgctcggcaattatttcttacacacagaatctgcttggccttccatggactgatcagtccatgaacaagtgagttttgctgctgactgctcattctttcatcactgtgacatagttcaaagagtcttaaatgggccgggcgcggtggctcacgtctgtaatcccagcactttgggaggccgaggcgggcggatcacctgaggtcaggagttcaagaccagcctagccaacatggtgaaaccccgtctctactaaaaatataaaaattagccgggcgtggtggcgcaagcctgtaatcccagctactcaggaggctgaggcaggaaaattgctagaacccaggaagcagaggttgcagtgagccgagatcacgctgttgcactgaagcctgggggacaagagcagaactccacctcaaaaaaaagtcttaaattatagcttccacctaaaaggtgggcagaacgaggctgccttgatcattgctttacagctggtggggttgctctgttctcatcaaactcatttcccctttgcaggaaactcctaggacaccccttcaagggacaccagcctgggcgatgccatttcttgttgttgcccaggttgcttctgtcacaccagcacctagcacagtaaggcttggtgtgtgtttcctgaatgactgaatgcacgtctgagagctgctgctgcagcacttctggtgtctgatgaagggtggttgcttcctcccagtgactgagcagatgcgtgtgttgacattggcagagaggtcgggtgccagcagcctccttccaggtgcagaaccgatcacacttgccttttcctggaaggcggttggttaagtaaaccttattgaagtagctcccctcccagattaatgaatactttcagacatgatatgaaatgtttggaaacgagatgcgacacggtattttggccgcattttttttttccctttcataacacctggcaacaagattctcaggctaaataccagacaagtgtgcgcttcattatgtatagtaacttcgtctataactttttttaagccctccagatggaagcatggtataaatgtggagaggctgagaaggggaaatggaaataaatgcactaagaaataaagaatctgttttttatactttcttttgcaaatagtgtttgccgtgacatattgtgaatggactgaattataacaaaaccagaaatgaaacagagctcgggggtagggagagcaattgttacacttactttaactgatataatgcaaagcaacgctttttacactcaattagtttgtacattgtgttggacacaaaccagaatgcagaacatttttgggttttgtttttacatgattaagggagatgagatgaaataaattcagtgaattatcctccgtttcttttaggtctgagatgtttttgttctgttgttcctcacccctggtattgagtgcataaccctttttcccgggtgtaaggagctagagagcccaatatttgaaagcccagagatctatgggctttcagtagagttccttcttccactttagggccatctttggctacataaacaaggacacgaatcagagctatttacatctggcattttaccatattctgtgcttagaatatcagaagaggctagcaagcatgatcgaagccaacagatgttagtgagcatttaggcagcaaaagtatttccaaggctgtatatttcaagatccttgcttaattcattttgcttaattatactttcttgaatttttaatgctcctaatatgataatattaagaattgcagtgtgtggttatggattgctcatttcaatatatgttagatatgaggggatgtgtgggttaatgctgagagccaggaacagatgaacttgggggtcagctcagtgtctttcctgtgcacagctctagttgtctcctctgggaggggcccaggaagggcctggatgctcctgcaaaggacgcttctgcaaaggatgcagaaaagcattcctcaaactttcatgtgcagacaggtgccctggggattctgattcagttggtctgggtggggcctgagatgctgcattgatagcaagtccctggtgcagctgatgctgctggtgccacggatcctactttgtgttgtggaagtgaagtcagttgtattctacaaaggctgctgatcaacaagtaccacacacaatggaagagaacaagtgcctgccgatggaagccatgcctgtgatacctggcacatgcagtttccttctggcgcaggagttgtggtcaaggaccttggtcagactcttgtcttttaaaaagatcatccctgctttcatgtgtgcaaaaggaaagccacgtgtgtagagcactcggtgattctgtgttttgtattcaaaaccacaaacactaataagaaaacaataggagaaacctgttaggtataatatccaattataattatttttactccaaaaagcacatcaaataaataatgcagtttatgttacttctagaaaatgcggcagcgttagttaatttacataaattatacaactcattatctttgtttataaaaagacttagcaatattttggcttatggatctgaaaggggaaaaaatatcgcagacttcagttcagtgtaattttcctttcctgcacggccacctttttatttatttacagaaagagcatctgtttgacagatccccttaggagtactgccctttccttttgatgaatagaatgccttaagtttgacttttgtttataaaaagccaaataaatacaagtgaattaatccaagcagcaagagaatgctctgagtagcagtcgcggcttccttggctgacaccagggcctgcaggggtggggagggagcctcaggggccagggagccgggtttttctggcctcgtgcttgtcttttctgctgcagaacttctcaggcagcctcgagttagatgtgccagtgccacccactcagggtcagctcctgagcaggtgaactgttcctgcgctgtcccagccagcagccatgagccacatgtggtggtgagtcctggaaatgtggctcatccaagtgccatgagtgtgagacccacacagcttttcaaagacctagcatgaaaagaagccactttttattattttagctttttaatttttttttttatttgagacagagtctcatctcactctgtctccgaggttagaatgtagtagcactatctcagctcactgcaacctctgcttcccgggttcaagtgattctcctgcctcagcctcttaagtaactgggattacaggcacctgccactatgcctggctaatttttgtatttttagtaaagacagggtttcgccatgttggccaggctggtctcgaactcctgacctcaagtgatctgcccaccttggcctcctaaagtgctgggattacaggtgtgagccactgcacctggccaaaaagaagccactttaaataacccattaatatttttgtggattacatgttgaaataatagataaaatatattattaaaattcatttttcctgtttccattttacttctctactgttgctactagcaaagtttaaacatggctttattatatttccactggacagccctgggcctgccctagactaacagagaggctggagacctagattactcttaatcacacccattaccaagactctgattcttccactggtcctgcgtcaggctctgactcataatgagaaacaggatacggctcagtgacaagggtagggcttgtttgatggtttgcttggagacttgaaaggcacctgggagaacaacatagtgtaagaaagtggagctctcttcccttgacagtacttggctgttgcttctagcttaaatattaaagtctctgctggtggatggaggagcccagctcccaggttgtttcaaagtggaaactggtgaagcctaaatttgccttcattgcttatgcagatccagtagattggcaagagaacaagcctgccccgaggcaggtctgcagagcgggggcgtgcttggcagaggagggaacaaggaacatggttcagttgcggccagacctaggcctggccatgtgccagggtgcctggactttggacaccggtgtgttcagagtgtgatctgatactagcaggacttctggctgggagcgccactgtgggtccaccacagggacggcctgggaccccagagccctttccctcataagacttgggagttagagacaaagggatgtctgccatttatcagttgatggttaataatttaattcttccctgcatccatttattgaagaaacataagtccacgatgtgccacactttgctaggcactggggatacagtaatgcacaaaacagataggttcttcaccctctcgaagctcccaacttgtgggagcggggaagaaacagacaggacagaggagtgcaagaagtcccttaggagccctgagagaaggactagaggacagtgtgcaatgcatatgcctagatgacaagtagtggccaggcactggcccttggtgacggaggaggcaggaacatttggcctgtgactaagggaggaaaggccattgctgcaaagagctgggcagggctttcttggggacaggacagtggatgccctaaggctggaaggaccttggttgctctactgccagaaagggatctgtgggcctggagagcagtggacaaggagggggcgcggtggaggggccaggacccaggtggcacagcaggatcagctgtggtatagatcttggattctgttctaagtgtcatgagaagccactgatgggatcgtagcaggggtctggaaggcagtgggggaggttctggacaggtaactttgctttatgctgagtgatgctggatatgtcccttagaccctctggctgttggcttcttcatctatggagtggaaaggctaagagagtggaagagaggtgggccagaatgttctccgaggttccttcctatttaaaagtgccatgatttggagagatcccagtttttttcccttcttggagtagagttacctttatggcttctgggatggattttagatggcttcacagtgccagcatttctgtgaagtcatcaattcatatccatgagttctttggcttcataagataaaagaagacagaatgcacaggactgtgttggaattgccatggagtgcctaggttttcactcagcagttccatggtgagacctgtgcattggtaaagttttaggagctttctgggtcaatgattctgcacatcagcaggattgatcccctggagtttgtgcctctattaggggactaagagggcccctgtagccagaggctccagaggctctctgtagcagtgtgccagatgcctgtgacatactccatatttaactgttcagacctaccagcaggccaagggttttagttcagagattctgagcacctcactttgcagctggggaatctgatggagctcacagaataaacaaatctgtggtaggctgaggggccctgtgatgggcttttgtcacatgctgatgagtcatttgctgagatggcaaagggattggttgtcatgagggctgctagtgaacattgggatcttggggccctgacacagctggtgagcaacattctgatgcatgttcccctgcccctctcagtgaggaagccagctgagcatctgcacaaagcttaagaacccaaggggtagagctaagtgctaatctgactccctcttggacacctataaaaatgtccagaggcttccaatggccatggcaaagtaactggtagtgaacttatcatcccacccaaaccaactagaacactggacacaatataggaaacaactattgttggataatggacagcaggcaggaaggactgtaatatctaagaggaggaaataaacaagctctggctttctggctggaggcattttccagacagtgcatgggggtgagtggcaaccaggcagagtacagcagtgtagcaaagttgaggaggtgacaactagagtttggggaggctgagacaaatggaatccatagggtagagtgctgaagagtacagaggagaagggggggtcagcagagaaagaggtccagaaatctggatagaagatgtccttgattctttggctaaatactaagctgtgtatgcatcatgaaactgtatgaggttggtcaaaagacaaccactgtgggccagaagctaaaacttctcagggttcacacagaactgggaaccactgtgagccagaagctaagacttctcagagctcacccagaactggcagatgttcaagttcaaactagtcggtgtgaagagatgctaatgaacacctgggtattccacagagaccccagaatgatcacatcttaataatggagctaaactctccctggagtgaagacaactccagacctaccctaacaaagcgtataaacaaatcaaaatgagcaagctgatctgcaaataatgcaagtgcctaacaaagctaaatccaaaattctttaaagtaagacaacgaaatccacactcaacagtatatcattcacaatgccctgcattcattactaaacatataaggaaacaggaaaatatgacctatatccaggagagaaatcagccagtagaaagaggacccaaaataacatagatatggaattaaaagacaagagcttcaaataatctattataaatatcctcagccatttaaaggaaaagaagaacagagtgaggtgagaaccataatatataagaagaaccaaagagaattctttgaattggacaatacaatatctaaagtgaaaatgtcaccagatgagttatctattgatatgtaacaaataaccacaaatgtatcagcttaaaacaacacacatttatgatctcacagtttctgagggtcaggaatccagacatggcttgactgagtcctctgcatcagggcctctcacaaggctgaaatcaaggtgtgagccagggctgaggtctcatctgaaggcttgactgaggaggacctgctgctaagcattcttgattgttttacaaaatcagttccttgacagatgttggatcaagggcttcagttcttagctgactgttgggcacaggccacctttgttaccttgctatatggacctccaatatggcaggttgcttcatcaaagagtgcaagccagaaagataatagagaaagtttgctagcaatatagaagtcacagttttttgtaaccttattacagaagtgacatctcatcatctttgatgtatcccatgagttggaagccagttatcaatatgcccagaatcaacaggttgagattacacaagggattgaataccaggcagtagatttcatttggggtcattttagagtctggttatcgcaatgggattaataccagattagacacagtggaaacaaaagataagtgaacctgaagataaagcaacaggaactgcttaaactgaagcactcagagaagaaaggtagggggaaaaataatagagtgtggtagagtatcagagaactagagagcaacatcaaatgatctaacagacatataattggaggcccagaccatgaggagtgggtggcagaaaaatagttgaagaacaggtggtcaagacttttccaaatgtgatgaaactaaagagtcacagatcctagaagcaggagaaatacaaagaagagaacatcaagaaatataatcaagtttgctaaaaaccagcaacaaagaggaaatcttttaattaggcagagaaaaacacattacaaagataagaattaccactgatttctcattacaaacattgcaagctggaagacaatgcaacatctttaaattgctaaaaggaaaaacctagaattctatattcagtgtgcatattcttcaagagtgaaggtaaaataaagacatttttagaccaaaaaaagtgttgctagcagatccatactacaagatatatttgctagcagatctatactacaggatttatatatatacacatatatatacatatatacatatatatacacatatatacatacacacacacacacacacacacacacacacatatatatatatatatatttttttttttttttcttgtgagatggagtttcactcttgttacccaggttggaatgcaatggtgtgatctcggctcactgcaacctctgcctcccaggttcaagcgattctcctgcctcaccctcccgagtagctgggattacaggcacccaccaccacgcctggctaattttttgtatttttagtagagagggggtttcatcaagttggccaggctagtctcaaactcctgacctcaggtgatccgcctgccttggcctcccaaagtactgggattataggcatgagccactgtgcctggcctacaagatatattaaaggaagttcttcaggctgatagaaaatgttacaggatgaaaattcctatttacataaaggaacgaggagcactagaaatggtaaatatggctggacacagttatgtgctcttgtaatcacagatacttgggaggctgagggaggaggattgtttgagtccaaaagtgtgaggacagcctgaacaacatagtaagaccctgtctcaaaaacaatggtaaatgtgtaagtaaatataagatacttttattcttggtttaaaaacactttcttgaaaatataattggccaaacacttatgggaaagttatagctcttaatgcctatatcaaagaagaacacagatcttaaacaataacctaactttatatgcaagaagttagaaaaagaaaatgaaacccaaaatcatccaggggaaagtattatggactggatgtttgcatatccccccaatttttacatgctgaatacataagccccagtgtggctgtgtttggagatggggcctctaaggaagtaattatggttaaatgaggtcatagggatgtacccttgatccaatatgattagtattcatttaagaagagacaccagagagctcactctctctgtgagcacagaccgaggaaagaggaaaggccatgtgaggatgtaacaagaagctcgccacctacaagccgggaagaaaactctcatcagaaacaaatttgctggcatcttgatcatggactcctagactccagaactatgataaaataaacttgtgttgcttaaggcatgcaagatgtggcattatgttatagcgtcctgagcagacaactatagaaggaagtagtaaagattcgagtggaaataaatgaaattgagaatggaaaacaatagagaaaatcaatgaaaccagaagttgatactctcaaatatcaacaaaactggtaaactgttaattacactgagaaaagagatagatagatagatagatagatagatagatagatagatagatagatacaatacccccaaaactgagaaaagagcttaaaaaaaagatcagtagatagataatatgagaccccaaaaagggagaaaagagctaaaaaagagatcaatagatagacagatagatggatagacagacaaataaaagacccaggtgactaaaatcaggaatgaaagggagaacatcactactgaccttctagaataaaaggattataaaaagaatactatgaacagcagtatgccatcaaattagataacttagatgaacaaaatcctagaaagatgaaatgactgcagtttactcaagaagaaacagagaatccgaatagaccaaaaacagagatattaaatttaaaattttctgacaaagaaaaaccaagggtcatatgaattccctggtgaattctaccaaacatttaaagaataataacacaaaatattccagaaaatagaagaggagggaacatttcaattatatctatatacatgagcaataaacaatttgaaaatcaaattaagaaaacaattgcagttataaataatagcatcaagaagaatataatatttagggatacatttttaaaatgaagtttaagacttgtaaatggaaaactacagaaatattcttgaaagaagttaaagaagatctaaataaatgaaaagacatctcatgttgttggatcacaacacttaatattgttcagatggcagtactccccaaattgatctacagattcaacgtaatctttatcaaactatcatctggctttttaaaagaaattgacaagctgaacctaaaatttatatggaaatacaagggacctggaatagttaaaatctttaacagaagaacaaagttggagaactaaaaattctcaatttcaaaacttactgtaaagctatggtaatcaagtcagtgaggtattggcataagaatagacgtataaatcaatggaataaaattgagagtccaggagtaagtcttagcatttatggtcaattgattttcaacaaaggaccaagacaatttaatcatgatagaatagtcttttcagaaaggttctggggcaactggataaacacatgcaaaaaaaaaaaaaaaaaaaaaaaagaaaagaaaagaaaagaaattggacccctgcctcataccatacagaaaaaataattcaaagtagattatagacctaaatgttaagagctgaaactataaaagtcttagaagataacatgggaataaatctagtgactttaggttgagaaatgatttcaatgtttaacattctgaggaattcttagaacttaacaattaaaagaaaaataatagaaatggacacataatttgaatagatatttccccaaagaagatatatgaatagccaattaacacacgaaaatatatttaacagcatcattaatcatcagagaagtgaaaaccacaacaagataccacttcttacccactaggatggctataacaaaaaaagagagataatagtaagtgttcacacacgtggagaaattggaaccctcacacactgctgatggtgatccaaaatgctggtgctgctgtggaaaacattctggcagttcctcagaatgttaaacattgagttaccagaagacccagcaatttcactcatagatatgtacccaagagaaataaaagcatattcacagaaaaacttataccattattaatcatagcaacaagtcaaaacaactcaaatgtccaccgactaataaacaaaatgtagtctatccatacaatgaaatattacttggcaataaaaaggaatgaggcactgataacatgccacaacgtggatgaacttctaaacgttattctaagtgaaagaggccagtcacaaaagaccatatattatgtgataccctttatatgaaatgcccagaatagggcaacctatagagacagaaagcagattaataattgcctaaggctggaggtgtgtgtgtcaggtagggatgaggggtgactgctaatgagtattaggtttctttttggggtgatgaaaatgctccaaaattagcttatggtgacagtttcacaaggctgtaaaatactaaaagcattgaagtacacttcaaagaagtgacgtttatggtgtataaattatagctcaaaaatatgtttaaaataagataattgattgtctaaaacataagtaataacattatatagaagcaaagtgtgtgacaacaatgatacaaaggaaagcagagggaagtggaagtatattgttgaaagattcttacatttttggtgaagtgctctaatatttgttgaaggtagaatactatgattgaagatatatattgcaaatcctagagcaaactactaaaaatgaagagatataggaataagccaatagtggatataaaatgaaagactcaaaaatattcaaattaatgaagtcaggaaagaggaatatgaaacaggacaagtagaaaacagtgttagatggtagagataaacccagccatatacataattgcatcaactgtaaatggcttaagcattccaattaaaagctagagagtatcagactggacaaaaaaaccataatactcaatgacatgctttctacaagaaacactttaataataaaggcacaaatgggttagaagtaaaaagatgggaaaaaatagagtgtgcaaatactaaccataagaaaactaaagtgaatatatgatcaagcagagtagacttcaggacaagaactattactcaagataaagagagatattttataatgataagagggtcagtccgttaggaaaacatgaccgtcctgtctatgcacctaattacacagcttcaaaatacatgccaaagtgacagaattgaaaggaagaatggataaatttcacaattgtagtgggagattcttttctcagtgatgcataggagacaggaaatcagtaaggacattgaaaacttggataacactatcaaacaactcgatctaattgacatttttgaaataaatacccaacagtggcagaatatacattcttttcttacacatagaacatttattaatataaactatatactgtgtcataaaacaaatctcattacatttaaaaagattactgcttctctgacagtaactgaattaatttaggattcaatagcagaataaatatctgaaaaattcccaaatatgtggaaattacacaacatactgcttaaggtaaaagaagaaatattataaaggaaactagaaaatattggctgagcgtggtggctcatggatgtaatctcagcactttgggaggccaaagcgggcaaatcacttgaggtcaggagttcgagaccagcctggccaacatggtgaaaccccatctctactaagaatacaaagattagctgggcatggtggtgggtgcctgtaatcccagctacttgtgaggctgagacaggagaattgctcgaacccaggaggcggaggttgcagtgagccgagatcgcaacactgcactcctgcctgggcagggagacagagtgagattccatctcaaaaaaaaaaaaaaaaagaagaaagaaaatattttgaaatgaatgaaaattaaaaccccacatagaaaatgtatggagtacagggaaagcagatattagaaggaaatttatagtttgaagtgcttacactatatttacattaaaatcagtaaatgtaattgatattaacaaaggtttaaaatgtgacctaaacttttacatgtagaagctagagaaagaagaaccaattaaaaccaaaataagtaaggaaaaaggtaatattaaaataagaataaaataaatgaaatagtaagtagacaaacaatagaaaacattaataaaacaaaaagctatctctcttcaaagatcaataagttgaaaaattatagctagcttgattaagaaacagagaaatatacaaattattaatatgagtaaaaaggatgcatcactacagatgctatacacattaaaggtaacctaagaggtgtcagaaaaggatatcatgaaaattttatggaaataaatttggcaacttcaatgaaatggacaaatttcttaaaagataaaaattcttaaaactgacacaaaatggaaaatctgagtagctctatatttattaaattaagtttgtaatttaaaatctttccccaaaaagaaacctccttcatggtgaatttgatttaaaaaaatttaaggcaagaataatgttaggcttaccaaacattttcagaaaatataggatgatagaacacttgtcaggtcattttatgacaccaggatatctgataccaaaaccaggtaaagacgttacaagaaaactacagaccaatatctctcatgaacatagatgtaaaaatccataacaagatattagcaaatggaatgcagctataagtaaaaaggataatacaccacgattaattatgttgattgaaggtgtgcaaagttggtttaacatgtgctaatcaatgtaattaattgtattaacagaacaaagaatattgaccatataatcatctcaacagatgaagaaaaagatataattccatacccattcatgattaaaaaaaaaaacctttcagcaaactagatataggagagaatttcctcaatccaataaaggaaatctacagaaagcctacacctgatcatatatatatatatatatatatatattttttttttttttttttctttttgagacagaatcttgctctgtcacccaggctggagtgcaatggtgtgacgtcgcctcactgcaacctccgcctcctgggttcaagcaattctcctgcctctagcctcttgagtagctgtgactacaggcgcccgccaccatgcctggctaatttttgtatttttagtagaggaaggatttcaccatgttagccaggatggtctcaatctcctgacctcgtgatccgcttgcctcggcctcccaaagtgctgggattacaggtgtgagtcaccgtgcccaggcacctgatcatatttaatagcatattcttgtacttccttctaagactgggaaatcatcaatgtgtccactttcactgcttctattcaatattctaccggaggtcctaggaagttgaataaggccaggaaaagaaataaaaggcatacagatggaaaagaaaggagtgaaattctttttatttgcagacaacatgatcatgtgcatagaaagtgttaaagaatctaataaaaattactggaactagtagatgaatttaggaaggccaaaggaacaaggccaatatttttttgaagtatattttcacatatttgcaatgaacaattggaaaacaaagataaagaaaaatacagtgtaaaataacataaaatattccttgaaatattttaggatcaaattaacaaaatatgtaagacctgtacccttaaaactataacacattgctgacagaaattaaagaagacttaaataaatggagtgatataccatgttcatggattggaagactcagtgttgttaagatggcagttctctccaagttgatctatagcttcaatgctatccctgtcaaaatctcatcagacttttttgtagaaactggcaagctatttttaaaatttacatatagcataagaatgaccaagaatagctaaaaggatttataaaaatcaaagtaaagttaaaagaattgccctacttaatttcaatacttaatctaaagctacagtaatcaagatgatgtgatactggtatcactgagttgatattccaaagaggtagatttcagggttcagtttctgaactttctgaggagccaaactagagaactaaattaatctttccaagcaatggtgtgtgtgtgtgtgtgtgtgtgtgtgtgtgtgtgtaagagagagagactcattctcattctcattctcatttttgaattaacttacagataaactgagtttcccaagaaggccctccatggcagactatatatcatctcctctctatctcccccttctcagaataaaagcagttttttcttctttatggtttgaaaatgaatttatatttattgtagaagacttcagatagtagataaagacaaggaagacattgatataatggcctatgatgtccatctttctgaatgcttttcacatacacacacatacacacactttttttttttactaaaataaggggttatatcatatatgctattttgtatttttttacttgactccatgttaagtgatttacatatttttaaatgactctgtgtgatatcatatacttaacctgttcactgacattagacattgagactattactactatttgccattagaaatcacaccgtgagaaagatccttgtatctttatttatagtaagccctcaacaaatatttatttgaggagttactaggtaccaggcttttcatacctgaacaattgttttctggagaatattcctagaaatgaaatagtagtgctgggttaaacgatataactgcctaaaaattagctccatatggctacatcatccttcagaaaggctgtgttaatttacaactgctctagggatgtttgagaagtcctgctgattaacaaacatgccccaccccacaggacttggcgcagggtgggggccacacctggtgcctagtgttattgacttagtgatgggtgaaaccttttgttcagcaaaagtcatttgtaccacatcaccatggggatgtgtgtaaagcattcatctagctcatggaggggaactgtacagctcactctagtgtcttctcagagttctgtagtaagttttccaacttgccattctgccatttattaactacaacaataaaaaaatggaagctaccctttactacaataagtgcttttcaggcattatctgaattttacaacaactctgcaatgtttcatcgatgagaaactgaggctcagaaagtttaaataatttccaaggtcacttagctcgtcacagatccgtggatcaaatgccagggtccagctctttctctaagtccaatcctgagtttttgacttgaacttgtcagtcttcgttttctaatcatcctgattctggggttcatttactctagaaatatttattgagcaccttccacaggccaggaaggggaatagtggagagctgcgttgacaaggtcttggccctcacgtagcttccagtccggtagaggagatacaatttaatcatccaattgtatgaaaaaactgtgattactgccatagaggaaaagtgcaggaactctaagatctgagagcaggaggatatgatctaatctggggatcagagagagaagctctgaagaagtgatgtttcactgaggttgccagttaatggggctggggagggccatgaggagaaggggaaggcatttggtgggggaaagggatatgcaaaggccctgggggcctgaggaagtgtgtgctggaggaaatgaagggtgggcagttcaggtacttagagcgcagagcctgagggggctggtgagcaggtgggcactgaaccccgcagtgcacctatgtgaaagtgtttggaatgtaacctgagaacgatggggcccatgaaagcttgtaagcagggcagtgtcatcctctgattattgtaaaaacattgcccacgcttctgccaggcacatccactggggtgggaggcagattcacatgggagggatgacttattggttaaaataggtggtcccagttctgtttctcttctccttatttttcttttctggtgagtttcttctccctgtgctaacattctgggcctcaggcttaagtaagaggcagatggcccgggtcttggagcagggaagccaggggaccggcagccccaaaagctgtcaatgtcataagtcatccttgcagagccgcagccaccttctcggcagaatgtcaagcagctcggtacggggagcagctgctctgcatggctctgagcattgtcagaacaccataaacaaaatggtcaggtttctgcagagataacctcctggcctccgaccccatgcggcaccgtgccgagggccaagctctctcttcggcatctgtttttggtacttccaaagcccacagtgtggggctttgggacgttttcagcctgaatgctaaaatgcctggaatcaaggcaagaggaggactttgagagttggcttccctgtgtctgttccctggaatgagaagaagcctgagctacagcctcaggttactgctggtggtccctctagaccaaaaaaaaagaacttgccaagagagacccttagtatccagagtcccctcctctcctggggttggaagggagagcaggaagagggagtggcctctatgccagccaggtccagagcgggagggagtgaattgcaccagggaaggagcctgctcgttgctggtagaacttgcagcatccagacagacctctcagccctctttggatgcctttatccttgcaaatgtcagagatgctggctttgcaaaaaccaaaaaccaaaacccagtaaccagtcttcccagcctgatgtgtgtctgtgccctttgcccacctgggcactgaggcaccaaggcacctggcctcacactcatttcctttgccccatctggctcgccagtcagcgagaagccctctggttttctgaattgcgcccaccagggaaggaacactgaagatttcatctagtcagctttcccttggctcatttgaggaagtgctagaatgcttcccaagctccctgcttatagggtaagaccctcctgtcccaagtatgacatccctggggttagtaaaagtctatgaccttaagaagaggtttctgcagaagcagcttggctctggctgtgcactgctgagtgtaatggtggcaggatgctaagggtgggcccagggtgccacgtggatgtcagaaagagcaaccaagggcaagcccttcttggagaggcagcattataattgccatgtggcaccggtttgcagtcactgttcaggtaattgctttgtaattgactgcatcaccttcttcctgtttaataaatagcacaaatgaaaccaacccgccagtggtgggattgtaattcaaattccattgactatagttgcgcatttttcatttagcatgtaaaggcagtttctatgtaaattatttcaaaaggttctccatggactaatgacattagcgtctggaaggataggaattgtcatagtaattgataggacaatggcgtggtgcatcatggagaaagaaattggcgctgtaacttgtacactttttaaaaataaagccaaattaggagagaactgctgaaaaacaaaaacacatatttcataaacaagaatccaaaatgtgacacatttgttttgacttaaagagccaaattatttacaaacacagaattaattattccattgatgaactttctgcagaaaaattatgagcactggcaaatatggacatattctctttttattcacccaaccagccactttacctaaacaaagggtacctctatgtctagttcccctactggcagcagaaattatattaaagacattcgttcagtttgaaaaacacagacttgtaactttttttctttataactggcagaatattaattctgcaaaccaattcaagaatctctttgaaatgtggccttttgggtttcaaggttgtaggtatatatttaataaattgagttgctttacagttaatatgtcaaaggcctggtctgccacatggagaaaataaaagttgtagaaacaagagtaaaaccttattaccaggtaggtagatgtcctgaaaaattggatttcatccccttgaatttgaatctcttgtaaattaaatattcagggaaagagaagtcaaagcagcaaagtaggaaaacaatcaaaacttgaaaacgagcatgttcttaaatgaaagaattaatcatgctaaattagaaaaagtattaaaatagttttagattaatgcagactgtgagtatcaatataattgcagcagcttaatttggcataaaaagcatctaatgaaatattttaatatcactgtccattcaatttaccagcttgaatttcacggggtattaagtggtttttaaattatcattgcaaaattttccaaatccatgtggattttttttgttgttgtttatggaaggggaaagaaattgtgtgtgtgtgtgtgtgtgtgtgtgtgtgtgtgtgtgtgtgtgtatgattaatgagtctaaatccaaatttctactttgtggaacgggtagaaaccaaccccctgttctttcccattgtgccagaaatccatgttcctccgcttcttggacctcggccacccagggccagggctttctgtgtcatcctgaagaatgcacagctgctcccaaggagagtcaaagagcagagaggagccttagcagctatttagttcagccctttattttgcaatgagggagatgatcactccaccttcttatagaaagagagctttagggagcctcatttcttctggattttctgactcatagactatattaaaaatacctcagtacactagagaggaactccaaatggcaattgtcgaagcacgcttgcccagggatcctgcaggcccaaccacctgtgtcgcctgacatggcatttttctggttttccagtagctccaagactgggttcttccatgcaccccatctgctcttgcccctctgcccaagtccagccttctctctcctccaaaagtctctttctcattgcctgtagctctcacctctctgataactgcccccagatctggaagagcagaatcaccaggccagcagggaccagcgactgccagtttactcaactggacgggtggtttctattcttcatctcagctgaatttctgggtagcatttgatgacagttcatttcagcctctttcctgaaactccttttctaggcttccttgacctagaaatctgagtcttggtgacctctctggccactccttctggatctaaagctctagaaggactccacgtgaaggctgagtaaagaaggatatgccagaaaggagagttggggctgccctccctcagggagcctgcagtgagggagggaaatagattgggcagggggtggcagtgggatagaggtgactgtatttacacaacactgggggacagagggatatgggtttgttgcctatggccatcaggaacaatgatagttttcaaacaggaaagctgcagtcctaacacccttgtgtctcgtgacatagcctttttctggttttccagtagcaccaagacagggagctccaagacaaggacaatatgacaaaatgtccgcaagattcatgtaggatgatgctcattacagcagtattgataatagtgggaatttggaacaacctaactcttcaatgataaggaacaagttaaataaatcatggtactctgcaaacatttgttgaataaataattatataaaagagcataaagaagagtaaatacgaaaaaaaatctctaacctcaccgctgcaggcaaggattttgtgtattctcacccttctccaacctccaccaagatgcactttacacactgccaccccaactacaggagacaccccacctgtgcttttccacataatattatgttgtgcatggtttctcatgtccttgcatatgctttgtgatcccatctttgaatggatgtatattgttctgtggtcagccctcctcaagttttgggcaaaactgtcttcctttcccgctctctactttctccgaggttccagctcatccatacctacagctccagtggtacttgcacacaggtgactcacactgctctatttctgtcccagtcctcttctctgggctccagataggagagtcaaccacccatcccatggtggatgtcaaatgttcactacttgacgtctccccttagactctttggactcccctaagtccaaaccccaagtcatgatcttcatcttcaaatatcttcatttcatgaaaggaagcaccattcattcagttgtgcaagtcataaggctggtagtatttcctgataccttcttagccctctatcacccccttgtccaaataaactccattcccttttcctctgggagctgtaaaatccaaccttttcctctatccatctccttggtcatcatagcagcccaagctaccaccaccaggacatcatctttctacatggactgcttgccccagcctgttctccatgctgcagctgaggggtctttccacagtgcagaccccatcagtccctgctccgttcttagggtgagatttgtggctctctggttaggaactaggcatctggagccacttatccaagttgagtcccagttcctcttcctctccctacctgtggggcttgcccctgtgctcccgttttctcatctatgaggattagtgagtcaatcacagccactgtccttagatcagccctgccacatagaaatgctgtttcggtatttgctgctgttcttcttcttcttcttcttcttcttcttcttcttcttcttcttcttcttcttattattattattattattattattattattattattatttctgagaaggagtcttgctctgtcacccaggctggagtgcagtggcgtaatcttggctcactgcaacctttgcctcccgggttcaagcaattctcctgcctcagcctccccagtagctgagactacaggcccgtgccaccaggcccagctaatttttgtatttttagtagagatggggtttcgccatgttagccaggctggtcttgaactcctgacctcgtgatctgcccgccttggcctcccaaagtgctgggattacaggcgtgagccaccacgtccaggcttgctgcttttattttgctattgttatctgtaaaatagagactgtagtgagaaacacatgggttaatatgggcagaatgctcacaagtgtgctaactgcagagtaagtccttcatgcgacgtttgctgtggctcctggcattccagcctctcctgggccgtgggcttcttccttccctgtgcttaactggatctgcagttcttgtgctcgccacatgcccacccaccacaaggcctttgcacgtgttctgctcctgcctggaacactttcctcgctttacctccttcttgcactcttcaggtcgtaactcaacaacttcctgacctcactgatggggccacttctccctggtggggccacttctccctggtgtctggtactccttcctagagaatccacagaactcgtgcaaggaaggatagcccagtggagggagccctccgctttccagctccatatgtggggacaagacacaactcaagcagccctctgggaaacccattggtttccaagaccctcccacagggtgcttggtggcctctggtggctggccctccaaggctccttttggtccggcggccccagtggccatgcgtcctagagagagatgttcagcctgatgggagagagggatccaaggatagattgtttacaggcagctcacttccatgcacccctgcccctatcaccactgatgatgagaaaatgagtcagtgagagcccatttcctgttctttgttttcttttaatttgagagaagatggagagaatccttgtcaggtaattacaccccagactggaaggtattggagcagctttccagccaagtctgggactcgcactgcatttcatggtgggtggcgctgatgcaccttcgggaagttctgcgacgtgcaagctgaccctggccatggggctgcctctatgggaacattgtagcccatggcactattcacttgggcctacggatgatcagtggttctcgccaaactatctgaagggagttcccagtgcctcgcctgtctcatggcagctcctctgaacagatgctcaaaagctgcctttttttctttctgaaatacagaccacagattctatggtctttaaagagctgagctattttaaagatgttggtacaacagaaccctctaacctaaacatcacataaggggaactcggcgcacaggtgaaccagctccaagatctagcctatctctttattctaaaccagagattcacatgggcctgcttttggggtgaaagtagggcccctgagcccataacgacacctgtgtacctggcagccactatgattaggtgtcacctgtttggagccccactgatggctgaaatccccacctcaaaaactagaaccaacaggaggctcatgataggggtgaccatgtacatttctaaatctgctacaaattcccaggccacatgtgtcctcttttcacagtgtagaggccaggaaagagacctgcccgctagcatgctttctctaaatcagctgtttcagatgtacccaccaccgggccaatggagcctgctgtgtgccaagcaccatgccagattctgaagactcagggaccagcgccacatggtctctgttcttgaggtgtgcacagcctgcgtgctgaggggatgagtgagcctgctggtggggggcagagaggaaagacctcacagggagattggcatgtgattgggccctgaagggtgaggaggagcaggtcaggcagagatgggcatctggtggagttgatggcacaggtggaggggcggaggcgccagggtgtgccacgtgcttttagagctgccccagcaacgattcttgatttgaggtctatgggtggtcctggaagatcgtcatgggggtcttcagctattggtggcattttgaaggtccaaacagagatcttccatgacaggtgcatctgtggccgtggcatccaatctcttctctttgggctggaatcatgaacgttcagggtcgtcaccctcaccctgctgtcatcctctgaggctggggagatgtacctgtggctgacgttaatgcacagaatcattgtagtatcaatgcaggattttggcagcaatgcgtttctataagaagtggagatatttggagctgctgggctagagtacaggtgtcgtatctcagagcatgttaggctaagattgtaaagggtcttaaatgaccccaaatatccctgcctaacagtcaacaagttagagatttggggagctattgaggctgagtggaaagagtgaaaatcccagctctacacttctgagtagtaagatatcaggcaagttatttaactttcctaagcctcagtttcctcctctgaaaatgaggacagaggtgctctgaggactccagattgttatggagagtttagctcagtgccttccatcgacttgacactcagtaaacagaagctggagctactcttacctctatcactgtaagtgtcaaaattgtgatggtcactctgagacttactccatcagtaagtaaattaactcatctgatttgatctagcagagatcagctgcctggagcaactgcaactttttttggaagatcagagaatgaggaaaagctaagttatttttatcaggaaacactcggcaaggagaacaggcttggggtagagagagaggtgctaccgagagggatttcagcaggcggggcagtgtgacctcagtgagcagccagggggagacagggcccaagggcgcccctgtgttctgcagaatgcatggcagtgtgattcagggagaatatggccatcattgtgaatttgttttaggtctcaaatcggatgtcatctccctgtgatggtgtggacatggggcgatagtcatctgagagggaagacctctgagcatcacattctcatgagatttgtaactgctcttgggactgagttgagctattctaaccaagttcctctacctttctccctttccttcttctccttcatcatcatcaccactgatatttttacacgttgtattggtcaggctaggttaggccatgtgctggtaataaacaagccctttccttcttcttcttcttcttcatcatcatcaccactgatatttttacatgttgtattggtcaggctaggttaggccacgtgctggtaataaacaagccctggaatgccagtggcttaacaagttcaagtttatttctcactcacattgcaactcttgtgaggcaaatgctgcatcagagtggttcccctccaggtggtgactcagggatcctggctccttctattgtgtggctccaccatcctagagtccttgtttctcatccctgaggacagggaagagagtgaaggtgttgtagcagccaggcctggaagtggcatacatcaattttaccttcatttcattggccagaactcagtcccatggccagtctaactacagaggaggctgggaaatacagtctttctttgtccaggaagagaaaattatccagttagtttggtgactagttagtttctgcatgtgtgtattatctcacttaattttctagagaaccccatggaccaggtgctattattatccgtattacgtatggataacttgaagtacagagaggccacctgaccttccctgataagcagtggagccgggattcaggaataagactgtgtgactctgaagcccacactcgtagcgctctgcgtgctgggcaccgtgggggtatgagaatacacggcacagttcattcccacacaaagagcttataatctagagtgctttcctaacaggaaggggttgctttttgtctccagagcactttatctctattttactttgcattgtggttatttaattgatctcctcaactagacttgaagtttcagaattaatgtcagacgttcatctctgcattgtccatagcccaaaggatacttagtgaacactggttgaatgttcaaccaccagttcaaccacactggttgagtgtgggccgttcagtcaatagagagtttggggttgtgggcatggaagaggagaggcaggcaggaaaagactcaggacagggcagtgtgctggatgcaggaaaaccaagggtgaatcaaaagttgagaaggaagagttggtgaattgtgctatgagcaacagaagcatactggggaagaggactgaaagagagcagtaaccgtgagatccctggtgcccatgcaaagcccaagaagtgatgagcagaagccagaaagctagggctggagcagagagcagtgagaggtggctgcagccagcacaggcggctctcgtgaagcatttggtattagcgggagagttggggaaggaggatcaaagtcaggatgagtctattagtctgttcttgtattactacagagaaatgcctgagattgggtaatttataaagaaaagaagtttaattggctcctggttccacaggctgcacaggaagcatgattctggtatcttcttggcttctggggaggcctcagaaaacttacaatcatggtgtaaggcaaaaaggaatctagcccttcacatggccagagcaggaggaagagaggggagggaggtgccacacgtttaaacaatcagatctcatgagaactcactcgctgtcatgagaacagcaccgaggaggaaatccgcccccatgatccaatcacctcccaccagaccccacctccaacactggggattacaattcaacatgagattgggcagggacacagatccaaaccatatcagtgagggtgggagttttccagcctcttgtgtctgagcaaagggaaatgagcaggaggggtgagaatgaaaaatagagggagaaggtgtggtttcaagatccagtcccagacgacaaaggaagacaagaggatgagataacaggagaaggactgtccttggagaggaaggggcaccctgtcctcggaggcaggtgagaaagaggaacaggggctccatttcctcatctataaaatgagatgccccggtttgcactctcaccttcgtgtgtttgtgggcatcctgggttgaatagtatcctcccaaaaggcatgtccaccctgaacctcagaatgtgaccttctttggaaataaaggctttgcagatctaattaatcatattaagtgaggtcatgctagatttgagtgggcccttatctaatgactggtgtccttagaagaacagggacctttggataggacacacagactcagggcaggcatggagagactgcgtgaagacagagatagagactggagggatgtgtcttcaagctgagaaacacccagaattgacacaagactggaagctggaagagacaaggaaggctcctccccagagccttcagagagggcgtggtcttaccaacaccttaatcttgaccaagccttcagagagggtgtggtctttaccaacaccttaatctctgccaaggcttcagagaggatgtggtcttaccaacaccttgatcttagacttctggcatccagaactctgagacaataaattgctcttgctttaacccacccagtttgtaagcaataggttatggaagccctgagagactgatatagtggggaacatgtgaggtgcattggaaaatactgggaattgtacaattgccatgaaaatgtgcagcatttccatcagaatgattatcaagtccatcgtgtggacatggcctggcagagggaagggatggggtgaggaaactcggttctgcctttgacagtgccttcctttggcctggagctttttcctgcatcatattcagtccctctggatttaggtgatgaaaacaccatgttctctttccttacgggttgcccctcacctcagcagaagcagtgcatgtccctgagttttagatttggaaagagagatatatgtggagtagtggatgttactatatgtcacccagctttccacctgggcaggggacacctgccttcagtgagagtaactcggggcctgggatgttcactagaaagttccatacctctgggtctctgttgggccattttgcatttccaaattatgtgttgcaaccaccccccccatgcacgtattgcttttatcttcctgcgtgtattgacacacatttttagtgctttctccgcatataaactgactgctatctttagctttacttgctgcgacgtaaattattctcattttattattattaccatcatcattttcattatcacatgatgccagcaagtgctgtggctctcggggactctccgacagatgacagtcatagaatgaaactcccaatgaatagaaaacccctaacatttattccatcgatacttttaccaacaagtctgaggttccttttaactttactgtcctaaaatgtccctcattttgcaaatgaggaaatgggggctcctgggggggtgaagtgactctcacaggatcactcagctctcagtggcagaatgggaactgacccctggtttccccctgcagagtgcagtgtcttttgtgtgggatgaaacatgctcccaatcccattgccacattcctcttctgagtctgccgggactgctgtggaaggtgctcagtgaagcactggtgggtgggctgccatatctgggttccttgcagtgcacctactgaaagcctagaaggaccttcactccatgacagacacagtacccagaggctgggaaagttagggacgaagacgggcagagacaaagggggtgctggactctggcaggatcatccatcgtgctggagtggggaatctccctagagtgtatctcgggagagtgccatgttgttagggagaacctaggctatggagtcagcctgacccagttctgcgctggagtagttacgtgaaaacagtgggcctcagtctcgtcatctgaaatggaatttcagtgcacaactcctaggagttgttcagagatgaatgttaagtgcctggcccagagcctgttcccagttggctgagctttcctctgtgtgcacgcccctcatcacaccagcaaatggtcagcttgtcttctgggccctagcgatgaattaagcgctgctgggagatcccctctgggtgttgcttcagctgcctgacctcaggaggctgatatcacagcaacagcactcactgggctttaagccttcacatttcttttactggcagaactggaagggcagagagcctagcccaggagtgggtggccagtgagaactgggcagccagcctggctccactccattggcggcattgcccttggacagttttggttgtcacccacatttggcttcttagctgaaactctagaggtacattcctccttccaacaactgtctggaaacaggaagtggtgcagggaagaaaaccagatgccagcttcccccgctgttttgactgggctctgtaaatggaaacagctgagaatactatccaagggtgcgtgtgcccatcttaaagctggtgtgtgcattgcagggaggatgctgggtgcaaacatactctgacgtttatattgaatattttagtttgcagaaattcgcaattaaatctactttccacctacactttgaaaaatccatttatagaaaccaaatcaaattggagatctaaggactggtggccagaaatgaaatatttttaaaataaaatatatggagattgaattgctgaagcgctggcttgttctgcggcttcctgggatgtgagctagagggaaggcttattggacagagccttctctggggatcaattatgaactactcttacgtcctggcagtttcaaaagggaaaaaaaaagttctttgaaagaacttatttagcaggcagagccaatattctgtgttttcttgaagccaccttgtatttcagcttcggtgaatatgtgtgtctcctgtggatctttatgggaattgcttgaacactccggagaggctggatgtggcattaaaaccacctaacctttgctcccccagcctcgccattcatcctgaagacttaattatttctcgaaagatgatccatacgggtactgcctttttcttaggaatgtgagcccagatgctgaattccccactctccgtactcaggagagagaagctcagactcagctctggcttaaatttctgaattgatccctgattgaattcctcctttgaaaattatcaagagctgcttagttttttcccagttcctatgagggatgccaaatccttgcatgcgtttctgcactcctctgcacccacggaccactcagagaaaatgcaaccattttgttcaagtgagttcttattgcccttcatgggctcagttccctttgagaagacaactgatcccatgccacgtgtttcctgcagcctcgcttccgcctttaggaagcaggcagaggaattcctacagagcactaggccaccccagcgccacctcccatgtcacaccaggcagaggttgggtgggatctctgggaaggcatgtcctccctgcctcctgggaatcctggggaagaaccaccctaggaagtggcaagctccggcggggtgtcctactccctgctgggtcactggagcttccagagcccaggcttcgttgcttttctgctgtattcctgccccctttctactgctttccagtggacagggacggggtggggctgccttcctgggaagggattgcgctgcagaagctggggctggtaaaggctggggagcaaatgcagaccttgtctgggtgatgagagaccgccactcgtctccaggagctcccgccagaggcctgctgtgacaagggataacgtgctggcaggccacttgtccaagagaatcattccttcctgcacctggacactgtttcagggctggcatttctctggcactcggtgtgagcaaagcccatttggtcgtttgtcagtgaagacagaagagtcacaatgagccgatttatagagtacatggggtgttgtggggcagaggcccggatggctccatgatccatgtgcatgtgttcccggttttgtttgtcatttgctttcttgccatccactgggaaatgtatttatcactacagtttgtataatttggtggtctgttttcatcttttacaagcaaaatgcttggtatttcaataagattgaaggggggtggaaatagattgcatcccacttaggactctcagtgggggagtctaaacatgaattatcccagcttaatgcttcaagttattggggttcccctggggagcatcttcttggttcttgtaatgttgctgcctcccgatggctgcccagggtttccagctctcccgtgcccctcgcttttctctgaaaactcggcatgccccggggggcctctttggagcctgttggaggagattttgtagtaatgagcatttggcttttgtaatcctttttctgcttcgtgctagcagcctcgcacttcccacctgttaaagcttgcaaagatatcatcggcaggcattttcccaggggaagcacagttgtgtccaaagcccagaataatccaggctttcctcatttctatgcagagggcgttagttgatcctggtgccctcaagagaaggtccctccagaacaagctcaccctccatcacaagcactgatgatgggggtgctcaagctggggcagggagaggctgagaggggataacccaaggtggcaggaggctccctcggtggtttgtggtggggctgttctgttcagccaggatgtggccctttcaggggtttacgctgtttaacactggctgagtgtcaggactggggggctatggatggtgagcttctccctggagctggctggtagggaagttcagcagctctctggatgttatgaaaccacggagaggcacagtcaccttaaaaggacagcagctctcactggctgctagactgcctctgatggaaggtgtctgcaagacaaaggagaggctgcgggcagcagtgtgcgggggacaggtgatcttggccagcatcctgcttgctcatattcctcggtgagaccagctctgcagagaaagggctgcttcagccctattcacccaaaacctcaatgtagaaaccacccactttgctctcgttcagcttccagagggaatgctgtcagtgacacagcattctggtccctggagtagtgggttcttgacattaacgaatgggcattgtgattttatccttgtgccttatgaacttggttaaagatttgacagtcactgtcagaggctgcaagtcatgcaggggcttctgagcctgcaggtgaggaccagcccagaccagggtgaagtctcagagagactctccgtggacccttcaccaaatggcctccaaggcaaggcccttgatcacaagtgtgtccctggttctccctggtcctctcgcatctgccccgtgactcccgactcccctctgcacttggtctggtctccaagatcgttctgatgtggactttcctccttgtctatgctggcagacctcaggaggaatccaccacctccgctttgctgccaggccaatcactgatagcatcaagcacactggcttgaagtcagacttcaggtgttcaaatactgactccaccttcacttacatctgactcgggcagttatgtaaccttctggctttggggttttttttgttgtaaacagggaccctaatggcatctgcctccctggagttggaagctggaacggggcaacacatggacaatgctgggaacagtgcctcacacatgcccgtactcaatgctgtcatgggacccattccggccctgtctcctacattgcatctccatctgtgatctttcactcagtgccccggggttgagaactaaacccctctactcattctcacaagcaggccttttcctcttcaaccagattgtaactccctgaggggagggcttgttgtgtgtttcctttggatctgcacagtggtacttagcagcgttctaggcacctggtaagggtttgagtaaaacagactgattggatagttagtgatgctgggaatctggagtgtgaattaagcagtatattccaaattacttccaggcgttcatcatttcagtatcacacggccacatgggaaaatgcccactgtgtgaaatttattcatcagttcaacaaatatttatcgagtactttccatggcatggttttggttcctgaagattcaaaaatgaacagacagaaaatatccacgcccttgtcacttacctgcagcagactgacagtggtcagatacaatctcaagaggtgatcagtgccacagagaaaatagagcagggtgtattggttatctatctctgtgtaacaaattatccccaaacatagcagtttaaaacaatgcatatttattatctgaccatttctgtgggctggggccaggcatagctctgctgatcctcccactcagggctccttacaaggctaccgaaaaggtgctggccagggccgtggtcattgcaaggttcaactgagtcaaaatccacttctaaactcgatcatggggttgttgggaggatacagtttctcatgagctgttgaactaagagctcaggttccagctgtttggtgaatgccatgtgggcctctccatggaacacaacaggaaagcttgcttcatcagagtgagcaagtgagaagagccagagagagtgaacacgccagggaccttgagtcaccatcttcccagtaaagtaagtgccattaggaaccccactttacagacgaaaatggaggcccagagagttaagtattttggccaaggttacataactatgtaactagtgagtggcagggccgaggtttgatcccaacctgtttggctccagtacttgtgctcctaactaccacagtggaccattgctctgccttttagttgcacacactgtctgctgcagtcttcttgacaagagaagatgatgactcaggaacttcagcagtagtggggatgggaagaagtgggttgactgggaatacattttgaagagattgttgctagaacttcttgataatttgggtgtgggaataaggtgaaagaaagatgttaacaatgatcccaaagttgggtgcctaagaaactgagtgaatgacggtgctattcctcaagatagaagatgatggtagtggagcaggtctagggggagaataaagagttctgttttggccacgtcaagggtgatgttcagatgtagatgtcaagtggcccattgaatacatatgtctggagctcaggggagcagtcagaccagagatacagacttttgtagtcattaatcacggatgaccaccgagagaaagagtataaaggagagaaaatgactaaagacttagacccctgacacctaaaacatttagctgcctggacaaaaagggagagccagcaaaggaaatggagacacagggggcaagaaaaccaggaaagcatggtgacctggaagccaggtgaagaggggcttccaagaaggaggaaatggttagctgtgccaaatgcttggtgagaggggatggaggaccaaatggaaaaagaaagctacaaaactgtattttcagaaatgtcctaattttgcaaaaataatttctccctgcccaaaaagagtaaaaagctctttgagtttgttaaatctgtagtccaattttaatccatgaacatggtatatctctattctagatattttagaagatatgtggtaggggagtgtgggttatgttgttttctataaaaggtgttgaattttgttctggcaggtcagttaattactggcagatcctcttggtctggtcaggcttggtttgaatctttattagagttggtccatttttattttgcccttattcctaggctttggcctttcctgtagggtatagtccttgttcctaaggcctggccttttggggaacaaatgcccaaggtactcagcaagggttctctcgtctggcttggccagaattcaaagctctgccagctctgcatgacttctagtatctctgcttagctttcagtcttataacagctatggagttttgccctgcatgtgggcagttctgccctcaaccaagtactcacagggtacctccaggcagacttctagggcctactttctgcacaagattcttctctccagagcccagacctgtaagttctagctgctttagcagccccaaactcttgatttttgccttctcctataatctaggctgctgtgccccatcgtcctgcataatgggccaaaaggctgggcaaacatggggcttatcttgtgtgttttttttctggcagaaccacagtcctgaactgcctgttgtacaatccctacaaagagtagcctcagatatttttgtctagtttcatgattgtttacagcaggagggcaaatccaatcctagtcacttcattgtggcaggaatcaatatctatttggtttaatgtttaccattccttcccattccctataccagctcatcacccttgtcagcggcagttctatatatgtttgtagtcctttcagttgaaataaaattgagtcaaacaatttataatctgaaatgaacaaagaccatgtaaattcttttcagttgcctttttaggctggtatctgtctgtagaggactcccagggaaggattctcaaggaagactcaatgggaagcctttggatggcaagctacagggctgagtacgagggtggccttcctgtgcggggtgtaggattagcatcagagaaacaaatcaggaatccctgggtataacagtaggggctgcattgtcattttagccttctccagagatgcatgatccaccccccaccccgcaggtcttttcctctctatgaaagtcactgacaagttcctgtggatcccctggggtccccaggaatgtatttctactctgagggccagtgagtatctttttcttggccatgagccatgaatagaaacgggacccttaatactgcctgacctgccacatgcagccctctcttctgggactgtctacacaagtacatttccaccatctacaggggcggaattccggtcatttgctacaggggaaattctagatttttgtttctaaagggccccaggttaccaaggtctcttgtatattagaattttaccacttctctctgggggaattaggtatttatcaatacattttgtaatatatatttaccaaattgtttatccagcaaacttttattaagcaaatgccaggcattgtgttaggttctgaagctctcccagttccttatccagggccccaggaacgcactcagggaccatttcagacacgtgggtgagtcagtccctaatgggctcagaagagaatcaccaaaatgtttaagacagaacagtcccgagcagccaacatttcacccttccttcctctctcttcccttgccgaccagacccaagggttttggactcaactgtttccttttgtagcaatgagctaaggaggctatttgctttgactaaggggccaagatgatgaagtcagatgtcctgagtttgcatcttgcctctccactgacttgctgtgtgaccttaagcaagtaccttcccctctctaggtctgcttcctgaaaattcaaagtctctgaaaattctgttttaaaatatgtgctggaggtggggagacctgattccctgcctagtgcttccttcgttttcatggattctttattaagcagatattacttcttcataataaaatcgtatatgaaacaatgacttgatttctttatatgaaacatactttgtacatctaaaaatgttgttgaaatcatctgagcctctgagcaagagcttcgcctttgactctgaagccagtgctgtcagcagtttctcccccttaatgtaatgctgtatgtgactcaatatgaactaagcagggggtgggaggtacagaccaccccagtaatccaggctttctctggaattctcccacttgtttatagtctgggcaatttgcctcctgctgctgcatgactcagactcggagagcttccaacctcgcaatgagccagcggctccccggagtcagacgctggcccttgtgtctcaggctcctggaaccttccgattaagcctccacttccatctcctccctggccacattcaggcagcaatgccccaaccccacacagagacacacgcccaatcagtgccctgtacaagcagggactgtgggtgagagggtacaaggaggtgttccaacccctcactgagacaggatttctagcccctctctttggtttgtgtcattttgctttgaaatgtaagttgacttctgatcagggcagatctcagttttataggaccttgtgtaagaataagcaatacaaaataaggaacacaaaatgagacctagagtcttagaaggggcccgtgcaaccagaggtgccccgaaagcttaagtgtcattgacttcctagcaaccctgactgtggtctgattcctttaagatccagaacaactgctccctgtaccttaagtaattatcatttagaataaagtcagaaaattgcttgctgtctgtttattttagaatcaagcagcttctgtataatttgaatttgagatagcattcttaaaaaaaaattcccttcgcaataaagcaccagattgaatgtccgatgagtcacaaatgcccttctgaaaacagctgcattagagggactcactcagaaaacatgattttccttcctccaagggtctcccctagaccctggcacagaatcaccctggtccccactctggtcctcccttccaggctcattcctggtgcagcagatcacttccacatttactgcatcacatccagcatcaatgtttttaactccatgaattgtttagaaaattgtatagaggccaggcgcagtggctcacgcctgtaatccccatactttgggaggccaaggcaggcggatcacctgaggtcaggagttcgagaccagcctggccaacatggtgaaaccccgtctctactaaaaatacaaaaattagtcaggcctggtggtaggcatctgtaaccccagctattcgggaggctgaggtaggagaatcacttgaacccgggaggcagaggttgcagtgagccaagatggtgccactgcactccagcctggacaacaaagagcaaaactctgtctcaaaaaaaaaaaaattgtatagatattgattaaagcagaaccctgaaagatggtgaatgattggcaggcaatgagaggaagtgtcgtgttgtccgttggtgacatttgcaaactctcctggtttaaagtgattccagagcaactttatttccatagtctgtgttgcactcaaagtaaatattaattccattatgccataaacttttatttatcatgacagcaagtcataaagttctcttactagaatatagcttctaaattgcatatcatagatgagatacaacacacacattggattctagcagcaattacccaccatcctttatgcaagtcggtattaaatgcactttctaaatatgagtcacagtctgagcttatgcagaaaatcttccatggctattacccaggagcccagaaatatgacgtgagggtgacagaggagccacagccagcaggggccagacacaaggatcaaagtgcacctagtcacccggcagtaattcatctgaagcattctttgcatattatgggtctgactttttaaattacgtaaattgctcattagaagtgccttgtaattgccttcacctgcggtattgcgagaggtgtagattttaattattcttttttgatttgtaatgtggtttgactttttcagggtgatagtttggaaaaatacagatctgctctaattgttgtaccaagtgaaaatagatggctctgttgatcaacttccttgactttgtggtggagcgtacaaaggagtcttatagtttcccagcccttgttgatgactgaggggctttgcccgtggggcccggggaggatccctgtgagcctgtagtgctggtgccttgggctcagccagcccctcagatgacttgtgtggagccaggcagtgtgttcatgttggatgtaaccagatctcgggggagtctgctcacctcttccccacagcatggataggacagaaaaagccaaggcccattcatcatctttgaagactgggacagacatgatgagtgctgggggcgcccaggtccggggtgctcctgggatgcctgctgcagagatgcttttctctctagcccacttctcgagggcagcctggcctcctgctacccagcaagtgctctcacttcctgcagcacagaggcctccacctgtccagcccaccctgagccaagctgctctgggctctggaacgggctgcaggctttctcgggcccctgggcctggccccctgtcatccagcacacggaattgatgagttgtgagaccagagctgtggcttcgggggtaaacttccaggactcgttctggctcatctgcagccatggatgaataaaaactcgatcaggacgctggtctttgaaaggcagctattttaggactcacttttggaaaggcagggggattgtttttccaagacaaaattatgcatttgtcaatacagcaaaagcatcgactgctttctctttggtgggggtggggggtctcttgccttaatcattctccatcagaaagctttgctctttgaagcctggctggcattgggcttctgtgcatctgcccacagagagatgctcctcaatcccctcccgcacctggccccactctccctttttggagcagctcacctctcaccgacaataacagggagaacctttgtgagtctaggaacggttttgtcataaagcccccagcccatttcctgtcttttcatcccctgttttatgcatgtggcattctgttccaggccagattgctgtgacatgagaaatacccgaaatatgggctgccacggtggctgtcattaaccaaccactagttgtgcctttataaatttttacacaccgctaaattataaatatgcaatgctgcgagtaatgaaatatgcacctctaataactgcagttagaagatttgtaattctgcctgcatgtgccataaactgggaggagttggggggcttcatctgtttcccatttggagcccctattgtgcttctccccatcccagagtccctcatgagggtcttgcgtctcaaggggaccctttgggggagcctctctcaggtattgggcttccccgcttgatgccttttcttttgttggtcacatggattcaataaacgtggttcactagcacccaccatgtttcagacctgtgcgaggctggcaatctgcagcagaattaatcttccaaatcgtcattttggggagatgaacaaattaccaggcaatgacagtgcagtgtgatgagggcccaaggggaagggtacccaggtgctgtgggaggctagggtgaccctgaacaaattctgtaatctctctgtgtctgtgtcctcattcatgactgaggacagtaccaccgccttcctcttggtgctgctgggagcattatatgagttacgacatgtaaagcatttatttagagtggtgcctggcatacattaagcactcactaaacattaactagtataagcaccgttattattacttgacttcttcctgtcttctgcctcgtagttgagatggtgcctagagcactctcttccttcttaaagagcatggcttcagcaccacaagctttgaattaaagaaacattgaatttttgtccaatacagaaatatcttgtctttatattgatatcaaaaacaatctgttataaaaatgcaaacagtataaaactgtataaaaagtcccccctaaatccaatgtatacatacacacatgcacaaatatgtttatgaagctgagctatactctatgtctcgtttttagccacaactatatagtggacataatttatgtcatacaaattagtacattttaccagcgtaggtgttattttcttacccttttgttggatgattacatcgtttccattgtttcattgatcccacaagtattactgagcagctgctagaacccagtgttctaggtgctggagctgtcctagcccttgttgacacagtctagagacaagggatgagcagacaataagaactagaatatgtagcatgccagatggtcatgagagacacagggaaaaacaaagcagagaaaaggcatgggacgtggctgcaactttaaatccagtggtcagggcaggccttactgaggtgactggagaggaaagagctgaaggggtcaggagccctattgaaatctggggagaggctttccaattacaacagcaagcgaaagcctttgagatcacagaacaacctggacaagtcctaaaagctttgtactaaggcaaagaggccagacacaaaaggacacacactgcattctgtggttctgcttctctgagatctcagaataggtaaattcagagagacagggattagagtagaagttctcaagggctgggggaggggagggagatgaagagttattgcttaaaggaggcagagtttctgtttgggatgatgaaaagtttaggaaaaggagagtggcaatgattgcacaacaatgcgaacgtcctcaatgccattgaatggtgcacttgaaaacggtcaaaatgggaaatttcatgttatgtactttctaccactattttttaaaaagacctcgagatgggagttggtattggatagaacgaatgcacaatgtttaaattaatgaacattctgttaatgaatagttgtttctagtcttttgttgttacaagcaatattttaataatatctgacaattattttatacacatatgtcattttacacttatgtgactatgtaaaataaattatagaagaggacagtttagacgatggactgtgtgactttttattttcacagatattgacaaattgtcctccatagatggtaaattaaattacattccagctaacagtatgtgaaatcatttgtttcctcaagcccttatcaaaacattgtgttatcaaagcttttttttttttttaggtctgacatataaaatggctcttacagttttactttaaatttatcttattaatgaagttgaacatacttcttttctattcagaaatttgcaaatctttgtattagattgttggttttttttcttatcggttagaagatgctctttatatattacagaaattaacttttctatgatatatagtaaataatttctcagctcataacttgattttgctttttaatattttttctagacatttaaaaaagtgtaagtagccaaatttatctcttttctttcatgatctctaaaatgtatgacatagagaggccatttcttgttccaaaattacaaaaaaatgtttttggtattttaatatttttatttttttcttaatttaaatctctgaatgatttagaatgtattatggtagaagggacagtgtcaatatattatacaactttatttttcttctccagatagctgctcaagtgttgccaaactatttattgaatcatctacctttttttcttgctggtaggcatgtgccttctctgttatatactaaattctgaattgtatttggatctatttttggactatctattctgtttcaatgaattgtctgtttatccacatttgattgccacactcttaattattgtagttttctaatacattttcatattcatgaaggaagtccacctttattcctctttttcagaatgttcttggctacttctgcttgtatttctctaatactctttggaattagactgatctaaaacaaaacaaagcaaaaaaccccccactaaaccccagctggtatttttactggagtcacgcccttaccttaccctgaaacctattaccactgatctgttcaccaacaccataggttttgtctttttgaaaatgtcttataaatggaattatactatatggaaacttttgagaccagtactttcattctgctcaacgttgccattcattactttttcattgccgagtaatactccattgtattcatgtaccaatttgtttatctgcttcctggatatataagtttgggatgatcatgaatagatgttctacaaatatttatatataggttttcatgtaaacagttttcatttctccaagggaaacactcagatgtggaatggttgcgttagatagtaagtgtatgtttaacattgtaagaaattgtcaacacatttttattattttgattttgtgtgtattttgttttttggctattttaataggcgtgtactggtatctcattgtggttttaatggtttgcatttctctaatggttaacgatgttgaacaactttgcatgggcttattttccatttctgtatcctcttaagtgaagtatctgtccaaatttttgtccattatttattgggttgtttgtttgcttgctgttgagtcagatatgtgatttgccaatatttttaactagtctgtaacttgtctgttcattatctgaaaagtgtctcctagaagaaaagttttacaatttcgttgaagtcctatttagcgattgtttcttttatggattctgtttttggttttatgtctagcaaatatttgcttaactccaggtcacagatattttctcctatgttcgcttttaaaaagtgtatgattttacatattgcacttagagctaggatccattctgagctaacttttgtctaatgtgtgaggcttaggttgagggttctctgtttttttgtttttgtttgcatttagatgtcttattgttctaataccacttattgaaaaaaaaatcttctccattgaatttgcctttgcacctttgtcaaaaatcaattgtctgtatttgtggagtttatttctattatgtctcttgtgttctattcatttttgtgcctatcacatcaccaataccacattgttttcattactgtaggtctatataggtcttcaaattggttagtcaaatttcccaaaatttagttttcttttaagaaattgttttggctatactaattactttgcctttcagtatacatttttgaatcagtatgtctatagttacaaaaagaatcctgctgaaatttttattgatatagtgttacatctatagatcactttgggggaaactggaaacctttcctatgctgagttttccaatatgtgaccgcagtacaatcagctctccatatctcagattctacgttggtggattgaaccaacagtggatcaaaaatattcagaaaaaataacaacaataacaataatacaagtaaaaaatacagtataacaattatttatatagcatctacattaggtattaggtattataagcaatctagagatgatttaaagtatatgggagggtaagcataggttatatgcaaatactataccattttatataaggagcttgaggatctgtggatttttatatccacaggggttcctggaactaatcctctgcagatgccaagggacaaccatatatctctccatttatttaagtctttaaaaaaattcttgttagtattttgtaattttcagcatatagatgctctatatattttttattaggtttttacctaagtatttccatttttgagctattttaaatggcattttttaagaactggttttcactaattcattgctagtatataaaaatacaactgagttttgtgtgttcatcttgtatcttgtgaccttgctaaactcacttgagttctaggatttttttttttctgtaaatttcttagaattttttgtgtgggcaatcatgctatctgaaaataggggcagcttttcttcttgctttccaatttacaggcttttatttctttttcttgccttattgcactggctagggtttccctacaaagcttatgtgagaatggacagttttgccatgttcctgatattagagggaaaacattcaagtctttcaccattaagtataaagttagttgtagggtttttttggtagatgcccttcatctggttgagaatataataatgttttttcttctttagattcttaacatggtaaattacagtgattgatttctggatattgaagcatctttgcattctcaggataaattccatttggccatagtatattcttcttttatatgttgctcaattttattttctaatattctgttggtgatttttgcatttctgtttctgagggatattggtttatagttttcttttgtggtactgtctttggttttggtatcaagatgttactgatctcataaaatgagttgggaaatattcctgactcttctgttttctggaagagtttgtgtaaaattgatactatttcttctttaaacatttagtaaaatttgtcagggaaaccatctaggcctagagaattttttttttcagaaagttttaaactactaattcaatttatttaatagttacaggactattccagggttgttgttgtttttttttaaatctgggtgcattttggtagtttgtggttttcaaagattggtttatttcatctaagttgtagaatttatctatgtgaagttgttcactgttttcccttatcttttttatgtctgtggagtctaatatctagtctctcatttctgatattggtaggttttgtcttctttctttttcctttgttagtcttgtggagaagtttattaatcttatttatcttttcagcaaactagcttttgctttcattgattttctctatttttttcattttcaattccatttgtaattcattcttattttactatctccttttggcctgctttgagcttaatttgctgttatttttctagtttcttaagaaggatgctatattattgattgaaacctttcttcttttctaatgtgaacatttaataagatgaattttcctctaaacactgctttggctgtatcccacagattttgatacattatatttttattgtttgatcagttaaaaatattttctaatttttttgacctatgggctatttagagagttttcaattttcaaatatttggagattttcctgttatctttctgttattgatttctaaattaatttaatcatcagggaacatattttgtagatttcaattcttttagttattttaaggtttgttttatgactcaagacatgatcatggtgaatattccatgtataattaaaaagaatgtgtattctgctgatgttgggtagcgtactctcaactatcagttggagttggttgatggtgctattgagttgttctatgactgatttctgtctactcattctattactgactgagagagaagtactgaagcttccagctatagttgtgggttcgtttagttttcccttcagttctttcagtttttgcttcatatatttgaaagttgttattatgtatgtacatgtttaggatcattatgtctcttttattattaagcagtgtctctttttatcatggtaattttctttgctctgtagtctaccttgtctgatattaatatagccactcaaactttattttccacagcatttgcatggcatatctttttccatccttttacttttagcctactcatatcattatatctgaaatgcattttttgggaacaacacatcgttgggtcatggttctttgctattcattctgacaatctctgtcttttcattattgcagttagaaaattttttttttttttttttttttttttttttgagacggagtctcgctctgtcgcccaggctggagtgcagtgacacgatctcagctcactgcaacttccgcctcctgggttcaagcaattctcgtgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccgccgcgcccggcctgaaaacttttattcctttgtttttgttcctttgtttcctctttcctgccgccttttatgttatttgaacaatttttagtattgtattttacatattgtgtttttttactatatctctttgtatagttttttaatggttgctctatgggttacaatacattctttttgcaatctacttagaatcaacatttaccacttcaagtggaacatagcaagcttaacatcatacagattcctttactccctcaccccttatattttagttgttttatatatcatatatatatatataaaaccccagtaaggaatgttataatttttgctttcaaccatcaaaaatattttaaactacttgagaataattgtctattatatttacccagatctttattagttctgttgttcttccttctttcttgatgttccaaacttacttctggtatctaattttccttccatctgaagaacttcttttagaaatttcttagagcaattctagagaattacttgtctgctggcaactaattctcttagttttccttcacatgatattgtcctaattttactttcattcctgaaggatatttttgccgaatctagaatcctgagttgactgacagttctttctttcatcacttaaaaaatgtttcacttctttctggcccctgtaatttcagaggagaaatcttcagccattcaaatcattgttcccctatggggtcaataacttttttctgtaaagggccaaatggcaagtatttttgtctttgcaagccatacagtctatatcacaactacctaactgtgccattgtctcactaacacagtcatagatactgcataacagaatagttatggttatgttccaataaaactttatttacaaaacaggcagtgagccaaatttggcccaaggaccatagtttgctgacctctgcctggaaagtaatgtgtcgtttttctctggctgctttcaagatttttctttttcttttcttttcttttctttctttctttctttctttctttctttctttctttctttcttttttctttctttctttctttctttcctttctttctctctctctctctctctctctctttctttctttctttctttctttctttctttctttctttcttttttttaagacagtcttgctctgttgcccaggctggagtgcagtgacacgatctcagctcactgcaacttccgcctcctgggttcaagcaattctcgtgcctcagcttcccaagtagctgggactacaggtgcatgctaccatgcccgactaatttttgtatttttagtagagatggggttttgccatgttggccaggctgatctcaaactcctgggctcaagtgatccacgggcctaagcctcccaaactgctgggattacaggcatgagccattgtgcccagccaacaagattgtttttctttgtctttagttttcagtttgattctgatgtatctgattatggattgcttagatttatcttgtttggagttcactgagcattcagatctgtaggtttacgtcttgtgccaaatttttgaagtttttgatgattatttactcaaatattttatctgtatcacaatccttttcatcttcttctaatattccaataacacagatattaggccttttggtatcatctcatagttccctaggctctgctcattttttaaaatcttttttattctctcttattcagattggataatttttattcaagctcactttttcctgtaatcaccatttggctctgtagcccactcagtgagttttctgtttgggttatggtaattttcagttctaaaatttccatttggttctttatattctctacttattttctgaaacatttcatttttccatttgtttttagagtgtttacccttacttcttggaacatttctataatagctgcttttaagtctttgccagataattctaccatctatgtatctatttctatgaaagttgagttttttttttctagttgttattatgccagccaattttggattttattctgtgcattttgaatattatgtgatgagactctaggtcatgttgagatctaaaggagaatgttgacatttttgttctcataggtaatccagccaggtgggttcaggctgcaggtttcagcctgaacttttgtggactgtgctttcaaggttagttctgttttcaaagcctttgttgtcctgtgtgtgggacctaggggctgtcctgtgtgtgcaccatacagtggccagtctggggtgtgggtgtaggttatcccgtagttcagttctcaaagtctttggcatgctgttagcatcagatccatgcatatgctgcttgaggttgagcccaggagtttataaacaattttgtgagattttccctctccaccatctccttgggcctctctttttcagtcatctggccataaagctgggattttagttaccttggtcagttgtacagatgccatgactgcacccacatctgggaccacagcagtaggttagagagaggaaagaaagcaacatgagttctccttacctccttgggatcaaaggtctaactattgtgagagagtttcccttctttcatggttttaggcacctgtgggcctcactgttgctgccatcaccacccaggattgcctgggggctgcagtgcaagtgaatggataaaagaaaaaaaaaacaaaaaacgggatttcttctgctctctttgagtgtccagagcctgttttcttgctccttgagctgcaaccagagcttaccgtggctctctttctacagtccaattcccagtttcaggctgcctggagtccagactcagggatgaaggaggaataggaagctcgtggctctttcaggggtgtttctaattctggtcttcctccttaatttgcctgctcctatgtacctttcaatgtcctcagatttgctgcttcaacatcagtccaggttttatagctgcattcaggatgctcactccatcttgcctggaaccagaactgcttccatatacttttgctcactttccaggtgctgtcctctctgtccctaactgactttcagcagggtttgttctcctttgggctgcttccaaaagggccttcttttctttgatggctttatttatttattttttccacttccttcctgagctctgccaattcatgttttattcccctttgatgtgattttgtgcctttcctgagcttttgtgtctctgctttgagtttttgttttaaagaagcacttgttcattattgtttgaagttgtggtagtgtttggtcaactatttttaatggctccatgacattttcttggtgagtatcctacatttatttatttctatctcgttactcctttttttctgtgtgtttatactaattggattatggttcctttcttgtgattcctgtctttcgataaagtggatcccactctcccaccccccagaactactatgaaggaatttcttacgggttgtgatctagggtagggcctctggctaacatgaatttcctctgaatcataaaggtccttagacacagagctgtgtctgtatttgtgaacctttccctatctccagccaacagaaatcagcagctgcagagacaatactaccaattcaatttctcttctctaccatctcctctttccctctcccatatccagttccctggaccagcctatgagtcctggcggtactctgctgccagtctatgaatcctgttttcatttttctgaacagaagcttgttggttttgtgcctcggggcatgtgctcactgttttgatgaactgcactccacggctttgcctgagagctgcagcggtagacgtcctcgttagggatcttcctgtaaccctgttagacctttattgcattggtcggcccttctccagacactgttaaaagagattagagataatttctggacatcaaacctagaattggtatttttctttttctccttagcattggggcaggggtaatttcctggaggaaaaaggagtaacatcatatttactccactatatgaaagtcagagtttgggtatatttatttttaaaatatgatacatattatcaaattgccctcaataatcttagatgtccttataattttctttataaatttaacctgatttactaggaaagaagtacgtagggagacagacagtgcctgtgaaaaggctggaaggcaggtttggaaggtgggctacttagctgcagccatcggtcatccttggaaggcagcgagaaagcagtgcggagagggcacatcagagctctcagaggcacagaagggccactgaatccagggattacatgttttgaagacagttttgcatcaggaatctagattcccacccacagcaggccaggcaaccaaccctaaaattcttaagagacgattatttgcaaaggcagaaagttcatcccccgggagggatccattcctaggctgaacaactcagttaccagcaagttctcacacaaatgtgaagtctatataccagttattttggtcacttggtgctgttcttccatccagagcacccctggaatctgttcctctctacacatagggcaaccgtttgagtactgaagcagggtcctccagcagatgaccttccccaaagccagctctgcagaggacagcagttctgggtgagcacaccctgtattatctgggtcaaaggccacagctcccagtgtgggacatggaaggggtccagggagggccttgcaatgggagccccagggtttgggattttggatgctctcaaatgtatccttgtgggtggagacagtccatttgcattccatgtagattcatgccctgtgtatcatggtgctgtttgtggttcccaactgccatctccagtccaggcattattaactcttttttatcatggaacctgagtgtcttaaatgatggttcccaataattctaaaccaagtgagcaaataggctgtgatggaagagacagagggagctgtgaaaaagaacaagagcagagcttttaaatcaccatgtgacaaatggaatcgtgacttaggtttcacaattgaggtggctgatttcatgtgctattgacaaatctttcacatttctgacagttacagagttccccctctggaacataaagtctacattcatggaggtcagcttcaggtacaccacccctaaggcctgacagtactttgctgtgcatctgagatctggcagaaacagcctctgaccaccagaaaacctaacttttcttccaagtcccaaagagattacaaaagttttaatcatcctgggactgtctctggctgaaggatagatatgaccttgagacattgacaagaagaatgattagattcagtgaaaaagagagcagggatgaggatgttgaaggggttttgactcaagggtcagtgaagggtgcagagaagacaaagagtgaatgagaacatgtctggaggctcaatttcattgccccttctcctggaaagcaattggcagctgctgacttgcagagcatcacttggaccagggttcatgttgaatctacccacgcaccttaggactttgtgcagctggagagagggttgttcggggcttggagctgcagaaacattattcctgttgtcagctgaagaaaattgtctggatataaaggataggccttggcctgactctatttgtcggggaggcagaacttcacttggcattttcttttctatgcaaaggatttgagacctaagagagggaagagatgagggaagaccttttcgccttctccatttctttccctgaatgtagactggttcagcagctcagggtgaagcctgggaaacaggcctggcttttaccgtggtgaatcacttattggctgggtcaacatggacaactctttaaactttcctgagcctcaaatgccagatgtggggattctgttctgtaggaccttgtttttgtgtcctgaggctgccttaacaaaggattgcaaactgggtagccagaaacaacagaaattattgtcttatagttctggagtccaaaaatacaaaatcaaagcgtgggcagggcaggctccctcgtagcctttaggggtggatctttcctggcctctcccagcttccagtggctgcagtgatccttagtgttcttggcttatagatgcgtcactgcactctggtgttctccctgtgcatttctgccttcatgccatctcctcctctgtcttcatccattctcatgctgctgtaaagacactacctgagactgggtaatttatagaggaaagaggtttaattgactcacggttccatatggctggggaggcctcaggaaacttaacaatcatggcggaaggctaaggagaagcaagcttggaccttctcacatggtggcaggagagagaagtgtggagcaatgggagaagagccccttataaaaccgtcaaatctcatgagaactcactcactatcctgagaacagcacgggggaaacaacctgcggtgatccaattacctcccactgcgttcctcccatgacacacagggattatggggattaacaatccaagatgagatttgggaggggacacagccaaaccatgtcatcctccctgggtcttcacatggcctcttctattgacaccaggcattggatttaatgcttaccctaatctgatatgacctcttcttaactaattacatcttcagggcctctatttccaaataaggtctcttttgaggttctgggtgaacatagattttggaaggactctattcacttggtatggatcctttaaagattaaaagagataacacaagtgaagtagtcagcagaatgcttgacgcacggtaagtactcaataagtggtatttattgctgttgctgatgttattgttgcttgtaccattcatagaatcctttccaggtggctgtactattaacatctagtgttcgtaacaattctgttcgttcatttagtcgcagatgtttatatgcccagcaatctgctagactgggggatgcagaaatgaaaggcctggccttttgttttcagggagttcacaatctggggaggaggcagacacacacgaacagcctgtgctgagatcctcaggaggggagggtggccgtgcccagataggatgggaggaagatgctctgggggaggcctcctggacagatcaggaggattctcagaggcttttgagctgaaacttgagggtgagttaggattccccccatacaaatggggtacagcagtgtatgggagagcggcagagagtaagagagcacctatttgttcactcagtggccatgtggggcctcaacttcgaagcaaattccgtcctgtctgccaggggtgaggaggtggtgcagaaacaaactatcaagatgtggaccctgttcttggaactggatggacaggaacctgctgtagggagcacagcccctctggagaccaacactgtgaagggaagttgctcccttgccgggggtacagggaaggaaggcctaggatggggaagggaccacagcaggcctgcgggagtaggaaggaggccagggcgaatccccaggaggcgtgtggtcctgggacagcccacctgactctgatcttccccatcacttagtctgggacctggaagctggcagcagcttaggttagttagctgttagctgtggctgttgaaaggatgacaactctgtgatccacctgtgtgacactgaagaagtcactcaacctctctgtggctccctgtcctcatctgcaaaatggaaatgatgatagaatcactgtgagggttcagtgaattaatacgtgtctagcccatagaacagtgcttgccacagtaaacactgcttacaagtttgctcgtgttgttatctaagcaaaattcccaatcaaagggctttgaaaatgagctggcaatgactctttgtcggtgctctctcagttgtacttgatgcctttagacacaggaggcagagaagatggcacaggcctggaagcggttgagctggatgacatccacacgcaggtgtcctgtctgagcctgtgccctgtgtcggtgaccagtcaactggcatatcctgaatggaacacagccctgggcaacttaacaaggggctagagggcataagtttcaaaactctttttggggatatttataagagacacttgcattggttaaaaaaaataataattgtaaagtgaccagagctacaaattattgatcttctctgttcctttcctgcctagggcacatttcttgatcctttttaagccaaggggagatgtacttgctttgcctattgaggcccttcctaccacccaggctctgatggctcaggtgccttccctatggatggcctggggaaatgggcaggtatgtggagctagcatgcttgaaagaaagggggtgggggaagatgacggcaaggctgacgtcagggcccagtgtgccagtgcagaagcagggaggccccatccctggctggaaatttactgcagctcagagaacaggcctgtgttcctccaaataaggcagaaattttcctgcattgctagttgtacaaacacagggaggcactgagcagtggcaggtggcacttggagattttctgaatttcaggcattgggtcagcccgtaaaggcttccctggggtatggtggacttggtcagtgactggttggctggaagtctctctcctgggtggttacctggtatataatgaataaaatatagcactggacaacttaacagggaatgggaggcgaaggccagtgagtttcacagccattttcaggggatatttacaagggacccttaccttggttaaagaaaaatgtaatgtgaccagagctacgtatttctgatttttcgcctccatcttggtatccaatgaatcacagctaatatgagctctgactgtatgaaaggggttttcttagttgaccactcagctgagagagctaccaaatcagaattccacaggagaggatggttgggttcctcagctattttggaggatgacataaaatgttgcagagggagaacccttctctgcaatcagacgagattttcctcattgttctgcagggcctcacatgttaccaatgaaagccagctccctggtgccacgcgttttactcattgctggatccctagggcctagcacagtgcctggaacatgcacgtgcctctgggcatattcagtgaatgaatgaacaagggaatggaggtgggtgaaggtggactgctagggaaaccgggaacatatgaaggcagcacgaaatcgtgtgtgttggggtgaaaatggacgactggagtctcagcttattgaattgtgggtaatgttcattcaactagtcagtcaaaggatattttgggaaacttcttataccagatacatttcttgccttcatggagtcctcagtctaggggaggggggaaggcagacactgaatgaccagctacatgattaattacttatgtacatttgtggtgggcacttcagaggaaaggtgcaggggtgagaaagtggcatttacatggagatctgaaggaaggttgagggtgagatagtgatatggtttggatctgtgtccccgcccaaatcacatgttcagttgtaatccccagtgttggagagggggcctggtgggaggtgatttgatcatgggggcagattcccccttggtgctattttcgtgatagtgagtgagttctcatgagatctggttgtttataagtatgtgacatctccaccccgcttcctcctgccccggccatgtgaaatgcctgttcctgctgtgccttctgccatgattgtaagttccctgaggcctccccaaaagctgatgctgccatgcttcctgtacagcctgtggaaccgtgagccaattaaacctcttttctctatgaattacccagtctcagctattttttatggcagtgcaagaatggactaatatggctagtaaggaggaaacacatactgggcatcaggatataatcattcattcattcactcattcagcaaataattactgagcagctaccatctgtcagccgcattccaagtcctgagaagattcaacaatgagcaaaataaagtccttgctctcaatgagcttaaaacaaagcgtaaagtttgtgcgtcttttgttagatttattcccaaagagtggatgtttttgatgctatactaaatcattttttttttccttggcatactaaaaattttgttatttattctatggctgccaatacggagaaatgcaattcttttgtgtgtgtgggccttgtacccagcatccttgctaaatttatttacccagtctaatagcttatctgcagtactctgggtattttctacatatacaatcatgccatctgcaaataatgaaagttttattcagtcctttctgatctttatgctttgatttctttttcttgctttattacactgagtaggctctcccacccagtatcaagtagacgtggtaaggtgattgtaggcattcttgtcttgctcttgatctcaaaaggaaaactttcaataattcacctttaattacgatacttgctgtaaagttttagtatgtattctttatcagattgaggaagttctcttctatccagcttttctcagagtttttgttttttattgcaaatgaagattgttatctgttccgtatgaatgaaaatgttttctgattgaaatagaagagatcacagtcatcgaatcagttggccatatgctatgtatctgaggctgtaataatccactctaggaaagacatctggctggtgggtgtgattgatcagggttgctactcagttgaacttaccatagtcgataggcatctttcaggatccatctggtttctgcagggtctacgttggtgaattaaagacatgatgaggaccactcccctgcttcctttagatccttaagggtggctgtcatctccactatccccctgggctgtgctgtgtgtgtttttttttttttttttttttttttgctatcttagccagcatggtgagagggataatttcagagacttttgcttgccttttccctcatgtacctcacagaccaagggcccaatgtggggctgtaccaactgtcaagaaggctaatcccagttacacattcaagaagaggaaatgaccatcagttgggcccatgggctcagtggatccattgtaatgagactttgggcaggactccatttatgatcaggctcctaatccaacagggggcctacaatgacacctggggtctctgagtctcagatcaacttggactctgtgccaaaccatcctcaaaatacttgggtctttcccaatgcatagttacccaaataaatggcagtaagccccttggtgaaggaatgggggaatgagctcattgcatgtacttgctgcggaattgcagggtcctttctcttgggcacctgcccatctctttttccaacaagttgcaggtctaaaaactgacttgggtccagagattggtaagggattgtgaatttttatggaagtgactgtcatcagcctcccaggcatccaactttgatttcttctactcaacaaggccgttggctgccactctgaccttgctgctcattttggtagttgtggctcctgacttctgatggttaagcactagcctttaccgttttggggtcctattgcaccattgctatcagcaagtcaggttctctgtcagcctctccttctgtcagccctccatccctggccagcagaggggagccactgctgaacttctcagtgatgcttggccctctcactggcacaatccttatgaccctggagaacagtgtgctgtttggtctttcctgtggaacatgctcatccccaggtattctgggcatacatggtagatccattgtagcatgcccaagctcctaggccctttaatcccttcttctgcaagctgtcagggcttttctgacatttcagcatctctttttgcatattttaggagccatcccagtagagagttcacaccatccccagggatccctaccatggtgttggacatcaggagagtacctcttctctatccaattttttggtcaggcccacttgaccaggcttcctcagagtccatccccctttatcctccctccttcctggtagcacatgttggctagaacttgcacctccttctcctttcttatcaggcccagcacctcccctgctgggttacaccaccacgtaaccctaggcccaatagttagtagggaaattgggaacatatcttgagtcgaggcaccagttaccttgcaggagagagacctctgcactgttttctagagcaggggtttgctagctctagtaggggaggggtggatgcttctgcaggcctggaagatttggaagagtctgaagaagtcaaattatttgggggcatttgcacagatgtccctatcccctgtgtgggggttatcaattttttgagcccggtgtctgactctggcataacaaacctgcgttggttgcctgtctaacctgctttgcatctctgctacttgatcggttagatcctaggcttggtcttgggctttgtcggccccacaatcgaaggctccctggctttctcatttggtttccaattgcacattaattgggctgtttctgatctttctgtaaagcggaggtcagtgaacattttctcaaagggagagatggtaaatgttttaggcttactagccatatgatctctgttgcagctactctgtctttgtagaaggcagccagaaatggtatgtaaatgaatgcgtgtggctatgttctaataaaactttatttataaaaacagatggccactatgggcaactgtggcaatagccatccaatcccatcatcccaacaagaattctcagacactgctggtggggatgtaaaatgctcaagccactttctgtttctttttgagtcacacttggttgtttgcatttttctaataatttgtccatttctcctaagttttcaaatgagttggcataaagatgtttataacattgccttatcttcttagtctctgtttcatctgtacttatgtgtctgttttgttactaatattgtttaattgtacctttcttcttcttcccttaataagaattaccagagatttgtcaatatcagacttttcaaagaatcagctttgacttcattgatcccttctcttgtatgcttgttttccatgtcataaatttcagctcctctcctttcctttcctttcctccctcttctctttctttccctcccctcccctccccttcctccgttcctccctttccccttcccttttcccttccccttcccttccctccctccctccttctttccttctactttttgtgtgttgattcaatttttcccatgtgtctattgttttattttgttctatttcttaagttattgttttttactcctttttttaaaaaattaaccttaaagtatataacttttttcctcaaagtactactttagatgcatctagaagtttgggtcagtagcaccactgtcacttaattcaatatattttccaatttttacttttatttcttctaagatttatggctttcttgaagtatttcaaagtttccaaatatatggggaggaggagatttccattatatcctgtttagaaaaatcttcctccagatatccatgtggcttgctcccccatggccttcaggtctttgctccgagtttaccttctcaggaaggaaatccaaaccacccaatttaaaattgtaaaattgtgcttccttagtactccctacccctagcctgggatgattctatttcctttattcttctttttttttttttttttttttttttatctttttgagatgaagtctcactctactacccaggctggagtgtagtggcacgatctccgctcactgcagcctccacttcccaggttcaaacaattctcctgcctcagcctcctgagtcggtgggatcctattttctgtttgttatttcccctgctactaaaacactagaacgacctctctagaacatacattcctttgaaggcagagatgattgtcttcttttgttcaccgttgtagccttaatgcacaaagcactgtctggcacttagtagatcttgaataagtaactgttgaatgaaggaaggacacatttattaaaaatttccatccaattgccctgtggtcgtgctttgtgaaatatagtttctctcaaatttgatgagacttgatttatggtccaaaatgtgttccatgtatgcttgaaaaggatgtatgttctgtggtgcaatgccctatatgtttggtcagatttattaattgtgttattcaaatcttttctattcttctccttttgtctatttgatctaccaagcactaagacatgtatattaaaattttcccattatgatgatgtatctgcccatttcttcttgaatttctgcttctgctctatgttgctttaaagattttaaggctatattgttgggtgtacacaagttcagagttgtaacttcctcttgaatatttcatcaatatggtgatcctctttatctctagtaatgcttttggccttgaaatctattttatctgctttcttttgcttagtatttgatctctctctttccattgttttattttaaacatttcatttccttgtgttttcactattccaggtttaaatagcatatataaagattcttaaaaaaaatccaggctagtaatcttctattttgagaattgaatgtatgtactttggctgtaattattgatttgtttgaatttattttttccatatagcactttccatttgttgtgtttttgtttgttttgcatgtgatcttttttctttccttctttcgccatgttttcaattgagttttgtgtttttcccttttccattttaaaatgtctgtgctcatcctggccaacatggtgaaaccccatctctactaaaaatacaaaaattagccaggcgtggtggcaggtgcctataatcccagctactaggaggctgaggcaggagaatcacttgaacctgggaggtggaggttgcagtgacccgagatcgcgccactgcactccagcctgggtgacagagggagactccatctcaaaaaaaaaaaaaaaagtctgtgcttagaagatatcctttatttctatttttcaatggttaccttagaaattccaacatagatatggtaccttaacagggcctaaggttaatctacagtttgaccatccttttgaacaatccatgaccaacccccacccaggccttcctcactctactaatgtgttctttctgtgaagacgttgattatatcttgattttctatacccctccaaaatagacatcattatcattatcattttacacaattaatatttccattcttcccttcaacagatacttattcaacattaaattccacgcactgttctaggaacataggaaacacaaggaacagagaaggcacaggtccccaccctcatggacttgacattctagctggggtgacagattctaaacaataaacatccacgaggaaatgatagaagatatcagaaggggtcatgactgggagaaaaaggtagaacaagatagggaggctgggaatgcaaatggcagttttctgtggagtgctcaggggcggccttgaatggaggctggagggtgccaggaagaagccatgtctgcctgggaggggaaacactgaggtggagggacagccagtacagagttttaaactggagcatgctgagcacgttcaaagacagcaaggaagccagcgtggcagggccagctaggatgctaatgtagtaacccagaagagaggtggtgatgacttgctccagggtgtagccaggtggatggggagaaaggggtcttggacttggcacagatttcctaatggaacagagatggggtagagtcaagcttttttctgcatgtttttgtcttgagcacctagaagaatagagtgggcagtaactgagatgaggaagctataagagaagcagttttggaggaagcatgggagatctgctgtggacatactgcatttgagatgcctcaaaaattcagaggggccactggacccccaagtctggcatttcaagggcagatccaggtttggtttgttgttggtgggtttttttgtttgtttgtttgtttgttttatgaggcagagtctcgctctgttgcccaggctggagggcagtggtgtaatcttggctcattgcaaccgctgcctcccaggttcaagtgattctcatgcctcagcctcccaagtagctgggactacaggcgtgcgccaccatgcctggctaatttttgtatttttagtagagacagtgtttcatcacgttggccagactggtcttgaactcatgagctcaagtgatccgcctgcctcagcctcccaaactgttgggattacagacgtgagccactgcacctggccgacagatccaggttttgtggaccttaagcttatacaattttgagagccttctttaaggaacaaaacataaaattacataaaaaccaaatacaagggagggccagaaactttagctccactagctctgcagagagctgccttacagcagttgaggagaaaagcaaagctggagagataaatgtgtacgtcatcagcagggaagtggtacttctagttgagagattgaattctgtccccctcaaaagacatatgcaagtcctaagtcccagcacctgtgaatgtgacctcatttaaaaataaggtctttgtagatataatcaagttaaagtgaggtcagactaaagtgagctgtaaatccagtatgactggtatccttaaaggaagagggaaatttggacacagatacacagaggaaaaaacgtgaagtgatgaaggcagagagtggaatgatgcaactcaagccaaggaatgccaagtgttgccagcaagcacctgaaacgagataagaaaagattctccctcacagccttcagagagaacatggccctgccagcaccttgatttcagacttaagacttccagaactgtgagagaatatgtttctgttgctgtcatcacccaagtttgtggcactttgttatggcagccccaagaaactaatacaatgagggagtgagtaggaaagaacatcagaatcagccctgaggcttgtcagggacataggaggtccaggaaagcaggtagagaagatatgaccatgaggtaggaaggacccctcaggagaagtgcactgtgacagccaagcgaacaaaaaaggatgaagaaggaggaggtgatatgctgtcttcaggtcacattcaaagagccctgagaactggccattgattcagcaatgaggaggtttttgacaaaagtagttaagtggataggcgggggggaaagtctgttggagttgatttaaaagagaccaggaggaggccgggcgcagtggctcacgcttgtaatcccagcactttgggaggccgaggcaggcggatcacgaggtcaggagatcgagaccacggtgaaaccctgtctctactaaaaatacaaaaaaaattagccaggcttggtggtgggcgcctgtagtcccagctacttggagaggctgaggcaggagaatggcatgaacccgggagacggagcttgcagtgagccgagatcacgccactgcactccagcctgggcaacagagtgagactccatctcaaaaaaaaaaaaaaaaaaagaaaaaagaccaggaggaaagaaatgggagacaagtaagtaaagatgtctgtttttagggataactgcaaggaaagcaaaggaataaggtggtagtgttggagacatgaggagaaggtttttttaagattgaagaaatagcagcatgtttccctgcaggttggaatgatctggtagggagtggaatattgataatattaggatacagcaggcaggaatactgctggaggaatgtccttgattaggtaagaaggagcacagctcatgcatgggaggagggactgtttatgttttctctccattccaccactttatttctcatcattttttcttacatctcagaccttccttctgggatcatttttcttctccctgaagtatattcttgagaagcttcctttctggagtcttgttgaaagtgaactctcaggttttgttttgttattgaaaatatcttcattttattctcattatttcaagattgttttgctgaatatacagtttcaggttgacagttctgtttgtttgtttttttttccctcccagcacttgaaaatattagtccagtgtctcttgagacttattgttacaattgagaaatcagtcgtcattctaattgtcatttctctttgactcctgttgaggttgtctctctagctttgtgttccacattttcactgtgatgtactaggtgagggtttgtttttgcttttcctgactgggattcactgggcttccttctcgaatttggtggctggctgtctttcagaagctctaaaaattctcagacaggtcgggatgatggctcacacctgtaatcccagcactttgggaggctgaggcaggcggattgagctcaggagtttgagaccagcctgggaaacatggcaaaatgccttcttacaagcaaaaaaaaattcttttgctcctgtagtggttatgctcctgtagtcccagctacttgggaggctgaagtgggaggatggcttgagcccaggaggcagaagttgcagtgagctgagatcctgtcactgcactccagcctgggagacagagccagaccctgtctcaataaataaataaataataaaaaatagaaattatcagacaaactcagttatcaccactgccctgtttttctctccttcttgaagtcagatcatttgtattgtactctgctttctgcatctttacctctattttatatgtttcaacattttctctctgtattggcttccttagtaatatctttttatttgtcttttaactcatcaattctctctttgactatctagtattttctttacactgagttttaaattttagttattgtattttttatctctagaagttctatttaccttttccccccaaatctgccttgttggtttggagattctcttgttcccttatcatactttcattttcctcctttcttgctttaaacagattaaacaaactaattttatattatgtttttgataattccaatatctgagtcttggcagatctgattcttaacttttcttctttgtgctggttctcacatatggagaattgagtcctcatgtgcttggttatttttaccttatgaccttgcactccaaaagctgcaccagagacaaaatcaaaatgccttaactccacttaatgcatcttcatccttcctaaatctgcccttaaaaatccaaagagtgtgattatcttcactttactgtaggtcatagaagtgttaagtcaaagaagttgaagtaacatcttgaaaaaaaaaatcccaagctctaaattaataacttaatgtaacttctaattatgttggagttacaaaatttctttccctggatgaacacaaactatgactaaatgttttctaaacaattaaatttaatattttgaccaattaagatgttgcaggtgtgttcaaaattaattattatttttcttaatttaagacgtttttcattagtggaaagaaattccaaaatttgacaccaagcttagaaccaagagattctaaaattcttttaaaattttgccaatttatgtcaaattgtctcacctatgaccaaaaatgctttgctctcaggctttgtttttctgaaaactcttttttatgtttctcccgtggctaatctctctagaatctgagacctgacagctgaagggacttagaggtccatttctccctgaaagctgaccacagaccattcagaaaaagtgatttccaataaataccctacgtgtgtgatggtattgagatgagggaggtagattgttcaattacagaagcgataccccatctcttctatgtgtaaccccaaattcattgctactgaggttctataatgctaaggcttgcaaaactatcacttttacagataatgaaatgaaatcccatttaatgatgattatcccaacacaaagagggtttttccttttttattattatgaaaatacgcaactggcaaaaatacacatgatacaaaaagatatgcagtaagaaggctctctctcccacagaccctccaggcccatgctcatgggtaacaacggccacagatagatttccaggctgttcttggggcacctcagccctctgcttctttcttccccaacactttctctcgggcttctaggcaggcagcagacatggagataggactggtggtcgtgatgcttaaccttgagccattactaccaggaagggagggagagaaacttgggtgtactgagtgccaactgttaccaggctgaaatccaggctctgcacgtgagatctctactccacagagcaacttacagaggtgggaatatagtatggtgaaataacagagggtccaagacaccagatggccagcccccagcacaggcttgtaatagtcgcaggacccggattcagcccgctcttgtttggaccacgcggcaggaagaggcctgacggtgcagctgctgctggggaagagacacgtttgtcgtgcctttcctacccggagctcccctagcatcctcctccttggctgggaaatggagtgtacgcccccttctgaggattcttctggacccaaatgtgagttgaggccagagatgaggaaccaggagcacccacatgtaccatgggtgaaccccaacaggattggggcatttcacctcattgaatcaaatcattcattgcacatttgagttgaccccagtctcggatatctgaattctagataaagacattacccaggacatgtgaacatgtactggaaaatatcaggcaatggttcaatcacaactgtttatactaactggctgttaagttataagagaaaaaagtattaaatgccaacatggttttctgtgttgattctctctttgatgcagggaatggatatgacagtgaagcctggcccgcaggagctgtgtgcatcctatcagccagatactgggggaagcaggcagggctggcctcatagtcacaccaccagagtcaggctgcggccacatcgtagggctttgggaggctggggctgtgtttggttcatggggttagagtcgggtacagtggctcatgcctgtaatcagcactttgggaggccgaggcgggtggatcacctgaggtcaggagttcaagagcagcctggccaacatggcaaaaccccgtctctactaaaaatacaaaaattagctgggagtgatggcaggcacctgtaatcccagctactcggaggctgaggtaggagaattgcttgaacctgagaggcagaggttgtggtgagccaagatcatgccattgcactccagtctgggcaacaaagcgagactccaccaaaaaacaaaacaaaacaaaacacctcagtgaggtcccccatgccagactttcagaggagagcgagcctatggggccatcatcggtttggccaggtacccctgagggcagcagcagccctcatgcgggtctcaggacccctttatacgcttaaaaatgaatgaggatctcacaaagctccatccttattgcattcttttgattatgtgggttacatctcctaatattcactgtatttgcattaaaactgaggaaaattaaaacaagagaatacacaagcactgcacattccatgagctgccagaccatcagcatcatcacatccagtggcgtctggaaaatgctgcagcacacacaaggcacatcacatgctagcattattatgagcagggtctagaaccccctggccatgctttgagaacctctgcccttggcaccccctagagagctgaccgtggtcagaaccatgtgctcagcaagacaggtaacctcatgcctgggtcagcagttcctcttggttttctacctctttgaccttctcaactgcaatggatggggacatggggaaggtggccattgagggctgctgactctgggtaacttacatgtccctcgtccttcttattctgctttggatgatcccacagagctcttttgaggtctttgtattttgacagcaggaggcccatgacaaactatttgggattcaagacttagacgcctctccccaacccgtttgtgcagaaagattggcttcccccacaacataaatgtccacactgaaaccctgtaactccatccttattacacggttccagggagactctgggatcatgcttcacagttgatgtttgtgcaccaaatggaaatgcagcaagagtgcaccaggtctggagaggggctgctggtgtggggcctctgagggggccccgatctgccagtcactctgagttccctgtcaggagactcataaagaaggccagcgaggactgggaacacatgtttattttatgaatgacttcggggaaagaggagaaaaaaaatcctccagaatgtcatccaggaggctgtgttctttttattatgttttgtcggtaaacaaaaaaaatggccacatttaatacttataccagtcctgtgggatttctctgactaatgtaaaatgacagttgtcacaacattctatataaatacaagtctgtttgcaggagccttttctatttttaatgtaaaccacacctaactcgctctgaagaattgtacccttggaatttagagtcctgtctgttgtctattcacgggactgtattgtcttaggagcagcccggaagaaaccaaagacatccagaactttttagtttaacgtgagaattattcacctaattttcccgcagccattgtgttacttaatttattgttgtgtggagctgtatggtgatgtcgctaatgagcgacacagtgtacttggtgagccaatccataatttaggaggctgctgatgatctttgtgctgtctgcaggctgagcaaagcaggcagtaaaaataaagaatatacttacagtttatagaaatgagcacacacccgcagatacacacacacacacacaatacccattactaggcttgcaacccccatggttgcacgaagcgtgagcttgtgtgctgagaggtgcagggaaagctgaccgtaggcttgataagttcacagtggactcatggccactctgttgtggactgtcacactatggagagttggtggaagaagttggcttccatgagagggggcaagtgtgaagccctttatggtctgtttccttgcattcctcagccatttattgctgcacccactccagcgggcatgagcaacagaatcctctttagtcctagtggcaggtcacccagtgactggcattcaggagctaaactgattgatggtaaacttgatgatgtcgcccttctctgcagtttttggacagggatagcaaacatgtcagaggatgactctcaggtgattatgagcttccctgtcgaggttgggctctgcaagctttggcaattgacatgagttgaacctagttgtcattcctgccggtgagggagagacccgcaggggagtcggatctgacacgggaccccacgctgcagagtgatgatcgcataggcacgccttcctgcaaggtcacaggtggaacaggtggagagaacacaccgttctctctgctgtgaaattccctttgcactgggagatttcccggcagaggtcctacatttcggcagtgagaaatgtcaggggctcctgccatgcgcagccaaggcattggatcttcatattggatccaggaagacaactttgtgaaaggaaaaggctgaggggcttaaatgctgctgtcgtcccagcttctagggaggctggggttacagcctccgccatgttgcagattctccaataagcatcccggtgatctgtgtgccttgcaggggcgtggagcctggtgtatttacataccacggactaggtttaaaaatcaactttagatttgctttgccgtttgcagtctcttgaataaagcatttttgtagcctcctcaaaatcctctctctgtgtttacattttaatgggcattccagtgaaatggaggaatttttttttattacttacatttatcaaggaaagaggtggggttggaaactgccaagcagcagggccgcctctctttagactcctggggctctctgctctccagcctgatgtgggcaaattgtgtcacgtagccaggcaagtgggaaggagaggaaaggccattttaatctggcttttaaatatacatccctgagaatttacagaattttaaaatagtactttagatctcaaacatcgctgaaagaaatgaacacgtgtaagaagaatattaaattgcactggtctacgtggaaagtaaagtctgtcacatgtaatgaggtatcattccagaattgtccttttggaaaagaaagggggaaaaaaatcactctccctgccagggcagaggagcccttgactagttcttcatcacaaatactcttggaaggagggtcctaaggtgacctctccattccttggcaacattttcgggacagttttggtttctgtggctgcgtaaggggaaacccctcttggatcttgggcacagaagccacctcctggaggcagtcagttcttttggatgcggaaacggaatttctgcttaccctagcatgtagctaatattaagatcttcttgtgcaaagggctcccctatcacagttgaacatacagtgtcataaaactgggccaaggcagcttccggggctttgcatgtgtggaactgccagtgttttcatctcccccgggggatgtctctcttgttcctcccctgacattcccaggagatccctaattaaagctacagatacggtttaaaaatatactcaccagatgttagtttaaaatgacctataactggcagcagagatggaagaggctgacggtgtctgaggccttccggtcgccttttcctaggctgtcattcggtatgcaaatgaagcccagcagaatctgagagccagctctgccaagccataaaaccaactgttttgaaagcaatgcatcagtaattcttatcacctggcatctggagtgcgggaaagctcccttcctaactagaacatgtcatagcatgacttaggaggaagctctcattttgcactccgcggacaatttaaactgatgaatctgcttgctgaagctcatacagatccctttaggacaaaccattttttaaaccaaatccaggctctgagacacccctgctatgactttactggacctatatactacggagaagagggcttgtttggcagcacagcttttgtgtgtgtgtgtgtggggggggggggggggggtgggggtggggggtgtcagaccccgaggctacccttctggggttttgtttagattcttctgtgcaagttcccaccaagttttcagtgagttagactttcagggtaatcccggtttgccttgcaaagctgaggaaatgaggaatgtcatgggtatcaatatctttcctgagaactgaaatttaccagtagcacattcctatcgggcatttatcaaaacaaacatataggtcaaatgaccgtttactcagcagccacctgtcagtgccttgggacgtcagcagtcccggggatgcccgtcaaagcagctgagtgatctcggccctgaacattgccaacttcccgcctgatgccctggagctgaggctccagcttgaggcttcccagtgctttggataaaaagatgggtctgcacctgagagccatatacatctcgctctggggagaaaacccaggcagggctttcacacagaggaagagtgaggccaggatttatactcagagaggatgggcaaatagcattcacgcgtgtgtcctccagggtggaatctgccaggctgacttacagtgcaggaattttgccagtcagtggaggtagatgtgtttatagataacgttaaaaaaaaaaaaaaaggcaaaaaccaagacctctgcaaccttggtatttgaaacacagaacacgggtttgtgtactaagtaaaatgtggttaaataagattaatctattgatggtggggaagagagcctgtaaggcagattgggtgtctcagaggcataattatttatcaaactaattaaaatgtaaccaccggctcatcgactctggaaaccggctttcctgcccaagaagcagccctctcctgagcacctgtgattttatttttcattcattatcccactgaaacacaaaacaaagacccaaattggccacctggagtggccgctctcaccctctgcctggccatggcctgcctggactgggtgttggggagggatgcatggggacagtgttgttcacagtgtgggtgagtgagtgagcccacctggtcccccatgaagccctgagatgccaggagctctactggctgtggcctggggctgtgtgatggagagcacgtgtgttcatcagcgcccagaggcctgggctattcagttgggccatctctgcagcccagagctgcctggtagggctttgccatggattcctggcttggaggagtcatgattagcatgaacttgcaaacccagaccaggcgaattgacttgggggtgatgagatgcaccagctggtggaagcagcttctctctggccatccttccagaacggagcaagtttcctggcccatagtccctgcttccatgaccaccctggcctctcaggagcatgtacgtgtgattgcaggggtgggcagggagaggacacttagcagagggaagaggcacagggcttgttacataaatgacttgggactgttgagcaggtgcagagaggtctgttgagaaatgaaaggcagagagcctagcccagcaaggccagggcgaggaacctggcaggaggccttgactccttgatcgcatttctctgtttcacgtcccgaggtgggcagggggctgggaacctcccctgcagagctaaccactgggcctccttcacagagctctctcggggccagcaacagggagaaggccatggcccttctatcttcctcactcctgtcctttggagtccccacatgtgtgccaaggaactcaaggccagcggccccctccctatcttcctctggatcatagctcctaggtcccatccaggaagaaagaaaatgaggtggcaggtccagaagcctttttgcttttctgttgatttatgtccctgaggcctctgagcaataactaatacatgacttgaatacgatccctagtgatctgacctctctgggggagttgcttaggcagattacggcagatgattgagcagaatgttggtgagtccgtagtggcctggtggttctaggaggcctggcttagagccagtccatcaatacctatcaccttgtgagggggacggggactaaggacctgtgtccacccgactgccacatcgtcctcttcctttgaggggaggtaagcaccccttgcgaggttaggagagggcgtgtctgataggcattgcagtggttcatttcatctgtcaatttgacccggccgtggtacccagatgtcggtcaaacaccagtcccgatgtctctgtgaaggtattttgtaaatgtgatgaacatttaaatcagcagactttgagggaagtggttgaccctccgtaatgtgcatggtgggcctcatccaatcacagtgtgggccgtgggctcatccaatcacagtgtgggccgtgggctgcatccaatcacagtgtgggcagtgggcctcatccaatcacagtgtgggcagtgggcctcatccaatcacaatgtgggcggtgggcctcatccaatcacaatgtgggcggtgggcctcatccaatcacaatgtgggcggtgggcctcatccagtcacaatgtgggtgatgggcctcatccaatcagggaaaggccttgagagcagaccgaggtttccctaagaaaaaggagttctgcctccaggctgcaacctagaagcgctgcctgagtttccagcctgttgcctagtggaatttggactcaagattacagcatcaactcttacccgaatttccagcccgcttgtccgcccaacaaatttgggatttgtcagtccccacaatagatcgtgtgagccaattccttagaaataaacatgtatatatatatgtattatatgtgtatatatactatatatagctacataacatatatacatatatacatatatgtacatatatattatatacacacaataggactacatatatattgtcctattggttcttttttgctggggaaccctgactcttacagagatggaggtgccacttcctcctccagattttggggcttctgctcttgacacctcagtctccctcctgctttggtactcacccagcacccagtcccgttaggtcccagaaagaaggatgcagaagaagagagtgcacccccttccacagaaacaagtgtacaccaatgacaatgccacctatagagtcatgccaggtaacaagggatgaaggctactcatgtagggccgggacacggctggcacaaagggattggcctagttctggagggtttggagccgtctgcctttgagtacagactgtgcaccaggagcatcgctgagcttttccataaagcccaccatgtacgcaggaatggactccttgtgtcaatgcatcatcaattcatgtattcaaatattgattgagcacctgccatgtccctgatgctcttccaagtgttggagatagtgaacaagacaaagccctgccctcatggagtgcacatgggaaaggcattcagtcaagaactgaaacatcagcgattttcaagttggtgtgtgtgccacgagaaagaaaaaaagtaggataaggtgatgaaactacagtggggaaggtgcctgtgcagcgtagatggacttaacgccaccaaaacatgcacttaacggtggttaaaatggtgaattttatgtgatgtctattggactagtccgttctcacactgctataaagaaatacctgaaactgggtaatctataacgaaaagaggtttaattggctcacagttccgcaggctgtacaggaagcatggctggagaggcctcaggaaacttttaattatggtggaagaggaagcaggtatgtcttacatgcctggagcaggaggatgagagagaacagggaggcgctacacacttttaaacaactggatgtggtgagaactcactcctatgacgagaccagcgagggggaactccgccccctcccaccaggcccctcttccaacattggggattacaatttgacatgagatttgttcagggacacagacccaaaccatactgtgtatttcaaaaagtaagtttacaatgttctgaaatgtatcatggtggtgattgtgcaactccgtgaatatactaaagccactccattgtatgctccaaatggaagaattgtacggaatgtgaactccatctcaataaagctgtttaaagaacaaaagacaaagctaggtgagtgtggagtatttcagatacagcagtcagggaagccctctccaaggagggacatttggtcagaattattgtcatcatttttcagatgagtgtcagagaggatgagtgacttgcccagagtggcaggtctaagacgcacacccaggcatgtctccttctaagcccttcctgccctgcttggccattctgagtttttttcctctcttctcaaagcacgttcatgctgatctcactctgttttgtttgtttgtttgttggttgtttttttgtttttgtttttgtttttgagaaagagttcttgctgtgtcacccaggctggagtgcagtggcgcaatctcagctcacctccacctcccaggttcaagcaattctcctgcctcagcctcccaagtagctgggattacaggtgtgcaccaccatgcccggctaatttttgtaattttagtagagacagggttttgttatgttggccaggctggtctcaaactcctgacctcaagtgattcacccacctcagcctctctgagtgctgggattacaggcataaaccactgcacccagctgatcatctcactctcttctaggcatcttgattttctatcttgtctccagcagacatagtgggaaacagacattcagaacctgacccagggtcccatagccaatgatagggccccaaacaacactctatcccaggaatcagcaaatttttttctgtaaagaaccagccagtaaatatcttgggctttgccagccatatggtctgtgttgcatcaactcaactttgctgttatggaacaaaagcacccatagacgatatgtaaacaaatggatgtggctgtgtgcccataaaactttatttgcaaatacaggcagcaggctgaatttggcccacagttatagtgtgccaattgttgttgtagcttgtcattttctcttctctggaaaaatgccctggagaaggtaagactggagggaggcttaattcttcctgcccccactagcctacccccgacttatgcttgtgtccaggaaaaggcatgtgaagtgcttcatgcagccagattccccagaggagcaatacgaagcaggacccctgtcagatgcagacatgtctctatggagagaccaagactaggggagggcccaggaagtagccctttcccaaatggttgctttctcctatgagcagctaatgtgctgcctgcctgcctgcctgcctccctccctcccttccttccttccatccttccatccttcctggcttccatccgtcacctatccatttatgcattaatttatctctctgaagatagatgaatccatctattcatgcattctttgcttcttccatccatctagccatgtatccttccacctgtgcatccatccatccatccatccatccatccatccatccatccatccatccatccatacactgtctcattcaaaaacatgacttcagagcctactctgcaccaaacaatgaattagaccacaagaattcagtggaggacaggacacagtttctgttctcaaggagttcacaccatgaacaaacccatacgtagtccacaaaccaaaggagtgaacgccatgataaaaatatggtattcataagcctaggctgtatatttatggaaggaagtagcctgggctggccagggtgcttttcatgatacaagaccttccttcttaggccatgccaagacacagccttgatggcactccatcacactgcctcaagacaccagctctctgaccacaaagggtctccgaggtggaacatttcctaaagggctgtgggcagcctgcaccctgagctctggctcatgtttgctgggcgtggagctgcctttcagctgtgcaaggcctccagcttccccatggctggaataggaaagagctccttcccaggcatgtggggaccatgctgaggagtgtctggtggttggcaggtgggggctgccatgaggaagagaagtggagccactgttctcttcccacccacagaagcaggtgaccagcctgtgcagcctgagaagaatgagacacccgccaggaggtggggcacagctgtcatcctgtccagtgaaacgaaaatatttccattctgtttgatatctaagagcaaacaaagtaggtgcgagattgtctctggtaaggaagaatatgccaagctctcttgttggggctctgaattgagctgtcacccagcctggagctggctcccctgcaaatgacgacgaaagcagccccagctggcatttgcccagccatggggtggtggtgaccccagccagcccgggcttcccatggctgccaccagcctaatgcctgcatgattgttctgccgtaaacatcatctgtgtgtgcgttatcttcagacagtctgggctcagcatcttggccagggtccagtgctttctctctccacagaactcaaaatcgtgactgtcttagtctccataggataaatgagaattaagtttcagaaggggctccaggagctggcctcctggggaggagggcaggccaggctgctcttcttcctcgcctcctcccccaccagggcccatcatgctggagggcagataacagtgaggagaatccttctgagtgtaagcacaccatggagtggggcctgctctggcctaggagctgtttgtgtgcaatacctcagggagtcttcatactgaccgtagaaggtaggtgccattatcactgtattttacaaatgcagaaactgaggcacacagcagtttcctcattgaaaataaatgggcatggtctcttttaagtctgcctcttgagggcaatatctgggagcggtcccaggtctcagatggcctagggtggagggcagggtgctgcacccacatgacctcagaagagctccaggctccacgacctgtccagaggcagcaaggtggatgcagagcccgggggtcccctgggcttcctggattgagaggcagtccccctccacccttttagcactgactcagctggcgattcctctcatggttccaggattgccctgatgagccatcatgggggcacagcagcaggattccagtcctttccctgctaaatggtttcctgtgtgggaattgaggctcaggttgtgcctggaggagtgagactgggactgaagcagggctagaggacccaggggtctgggatgggaagaaaccacccccatcatcatggcagggtgcccatggtggcccttgaagagtggtccccacatcttaaaatcctacaacacttagaatcctagaacatagggctggagccatgttagagagcaagtaatttgaccctaatattggaaataaggggagaatagggaagaaggaaatagaacagaagaccttgtctaagagacccaggaggtcattggagagctgtgaccagaaactcaggtagctgaagatggagccatcttgaggccgagggcctgagcactcccaggtctggctggccagtgggcaaactattcacctccccaactgttttctgcaacttcatgcctggccttcaagaggcattttccactttccctgggaccatcaatcagacacggaactccttgctcctattaaggcctgagacaagtgccctctgcaatcagtgggcaccagtcctacagagcatcacacagcgccagccctctctccttttctctgaccctacgcatggctaaaatattgtcctgtggataggaaatgaaaagggtacaaccttacttcttcaaagatcgcccagtctagcccagaggtataataaaaccccaaactttcctttcaggactcatctttcatgagtaatatctttccgtgttaagtggtaggcacacaatggtgaaataaaacacagggctcagcgactccgatggcttggggtgtgggaggggaaggttgcctttatggtgtgagtttcctgtgcctcagctctcctggattgtggggctcatggcacacgggtgattgatgacaacatcactctccatcattcaattcgggagatccctaccaggggcatcttggccacctccgaggccatattgggctggaacctccattatctgtgtagtcaggtgtttgcatttaaaacaaaggaggaattagagtaattagatgaattataatcttcagttcatgacacactattgttgttgtttactttagagtgtttgtttaaacattctaacaaggaatgcccatgacctgctggtcaatccaagaactaggacattaccaattaactgtgtctgccacgggctcttctctgtccctccccgaccttcccacctcccaaaggtcatcacaaccctgaatttgtgcttacatctccctcctattatttcagtcttatgacttataagtgcatccttaaatactaccttgtttactttttgcctgtttttgaactgtataaaaaatgttttgtcccttctgtggtcttctggggttggcttttgaaatttaacattgtgtctctaaatctcatttatgtggttgatgtgtagctagagttcatcaattttcgcagctgtgtaatattcccccgtgggtctctaccaccattcaccgaactcttctgcctttgggcattcagtggtttctagttttgtgttagaaacagcattgcccagaatagtcatctttgtgtctgtctcctaggagacagtgcttgctgggtggtccagttatctactgctgtgaaacaaaccatcccacacaaccacatcatgggtgttgctgtcgggctcagaggggtaactctgatttgttccaccacactcgggacctgagatgagatgattgagggctggacccttggagccggcctgaaggggcctgggcctctttctccctgtggaggctaagacctttgcatgtggtcttttcacctggtcttccctggcatagcagctcagggctcccagagtgagctttccagacacccagtggaagttacaggcttcttagagccaacccagaagctcagaatgtcagtcctaccacattctattgatgaagcaagtgaccaaggctggctggattagaaggcaggggaactggatttcacctctcagtaagaggcatagcaaatgtagttgtctttactggattccatgagactcatgaatattcatttttacaagttaactcaagttgttttccaaagtgatggccaatttatggacccatcagccatgcataagtgatttccagggtctccaccctctgcgcatgaggtcagacttcttaattgttgccagttgagtgaggatgaaagggtgtctgaccctggccctcaccagcatttccctgttcacgggtgagcagggcccctcttcctgcaattattggccatgtgtttctcctctttcctgctcaagtctttttttttttttctttgaggcagagtctcgctctgttgcccaggctggagtgcagtggcgtgatcttggctcactgcaagctctgcctcctgggttcatcccattctcctactcagcctccccagtagctgggaccacaggcgcctgccaccatgcccgcctaattttttttgtattttttttagtagagacggggtttcaccgtgttagccaggatggtctccatctcctgacctcgtgatcctcctgcctcggcctcccaaagtgctgggattacaggtgtgagccaccgcgcccagcctcctgctcaagtcttttgtccatttttctgtcaagttgtctctttcttcttgtaagaattctttatattttcttgataagaatccttcatcccttttatatgttgcaaatatcttgtatttttcagtttgtagcttttcagcttctttaagatgtcttgttgaatagttcttacttttaatacagtcagtgttctcaatatttcacagttagcacttcttagtcttgtttcagaaatccttccctatctcaaagtcaggaggatattcagcattattttcctaaaagctttaaagttttgatgttgacatttgaaatctggatctatctggagttgatttcatctgttgttgttaacccctttggggataaccagtgctgccaactcctttcccatgatcgcctgctgtctctgacacatcagccatggtgggcccatcctgatagcctttttgtttgtactttgaagactttcagagtgacttaggtgagatgatgttgtatccataggaagcttgtttgtaaaccccggggctcactttccacttctctgattctttggggtgccagtcctgggaataacaggctgctagagcccaaactcatgccagagtttgagtgcttacacccccatgccaggtggctgggaagattatgccccagttaacgacatcagggctgggcatgcagtcagggcttcatgcctgagagtcagcaggctgactttttaagaaatggccatagtcacttgggctaagctgctgccactgacctacctgcctttctgctcctaaatacatgagaagaatcccaccgcatctgtggaaatacagcaggagggagagctccaggactctgagaaatgtcaggactgctgaatctgaggaggtgttttggggtacagggaaaccctctgtaggagcctttctttggtattagccacagtaaatccctaaataccagagaagtccagggaccagcccagctggcagttgcatttgggaattaagctaaagaaaggctggttgcatcagttgggctcacttttagtgaagtcaatgtgtttatatggtttgaaagctcctggggtgagttagtccatcttaccaaggcctacagcatatcttcctggaagctatgaactgagaagagaaaaggacactggaatcatggattctggtccagaatccatgctgccttgctgtgtgaccttggacaggtttctctccctctctgatcctcaggttacttctctctagaatggaaggggtaatcagtgcctaggcagttcctcagattctcctctttctgattgtctctggatctgtgacgaaggcattcgatgactctgagctgcctcctgctgaggacgggggaactacagcaagaaaaggcccagaattagcctaaaatgtaaacagctgagagctttcttcttaactgggtgaaattttaaagatcataatacacctctacactggcctgcaagctcagcccataagacttccccccttagggatggtgtccatcattgagtcctgttttgaaaatcaaaagtatttttaaaatggaatttgcggggaagagggtagaagttaagtttgcgcctccagaagcagggtaggcttaatctaaggggactgtcattctcccagctccatggggcctggcaggaggcggccctctcagtgctctcggccctgaaggaggctgtttggttctgcccctcctcctgggtctgagggcaggtggcacccccagcagagaccagccccatttaccccaggaggttgggctccttccccctagtttcttgggtgccctcaggggccaggccttgcagctgagagcagagagtcccagctacactcaactgtcacagactgaagggcaaagtgcatctggcagccagcacggatgtgttgtcctctgactctgtagggtgacctgtcccatatgcctcagccgtttggggacagcctctgaaagagccaaatgttcctctccaaactccgtagcaatagatggtgaagagattctgagctatttatggtcaggagagatccggctgcctcatcccggtggcagcgtctgagtaacattcctcggtggggagagcggcggatggttctcagaaagaatcgaggctttgggcacacatcactggcctgtccccacttcgtctttccacaatgaggcccggactgttccatcgggaaggggcttctggactcatccctcattttctcaaaggagagccaagctccggagagggagtggcccaaggtcacagagtggtccggtgcccaggcagctccagagcccagccagtcgggcctctgccgtcacaccagccccagggtcacgggctttggctttgatttgtaaagatgttctctttcacaccagcccccaggtcacagcctttggttttgatttttgaagacgttctcctcgcttgcagggagctaagccttccttgggtcacttgtattggtttccatagcaaattaccacaaactgggtggcttaaaagcactgaaatgttttcttttcagttctagaggccagaagtctgaaatgaagatgtgggcaggtgggttccttctggaagctctaaggcagaatctgtcccgacccctcttcagctcctggtggctgccagcaatccaggacccccccggcttgcagctgcgtccctgcatcctccccagcctctgcctccatcctcacttggcagtgttcttccccgtggctctgtgtgcccttttccgcctctcctaaggaagctgccattggagtcaggcacgaccctaatgcactatatcatctccatccttaattccacccacaaagactgtatttccaaatcaggtcccattcataggctctgaggttaggatgtggacgtatgttttggggtgccataatttattcagcttaggaggacagtggtttgatacaccgtgtagaggactggacctcacagcaaggccgtgggacagaggcagctctggcgagggactgaccaggggctgtgctcactcgcagggcctctggtgtctctgcctccactctgcatgcctacctctctgtcttctcactgccccccagctttgtgttccctctggtgtcccctttctcttcgtcttgtggcctctggttctcacgccttgcctcaattcctcctggcccagcttcagcgttctggccttggtctcgacgacttcttggctgcagtttctgctgctgactgcctcattcccatgcccatgctgtttcccagttgggttcctgagcaaggaggtcgtgccagtcatgcctgtcttctcacatgggcacagatgacaccccgccaggccaaccttggattgatggtcctgggggtcgtggggcccactcgtggtccagacagcaggatggggctgtggtacgaagcataaccacctccacctggcccttggaaggtgcaggaacatggcagaaacagggtaaaggttcggccgcctacaaaggcgactgcgtggtccctgcaggagaacttccagggcgaggatccaactaagtggaattgtcaaattgtcagttaactgaagtatttccagtttgagaggagagagcaagagataataggaacctggagaaaaagcagccacagggggtgttcggcttcaatccaggtccgttcaccccttacgttcaaaacagcaaatttcaggaatgccacagtccgttaagcatcaaagagagatggggccacccacgttcactgtattacgaccctcattagacagaaaaggacgtctgtgattgaggaaagattttccaacgacatccctcagttgcccatcaaagttgcctacttctcatttcctcaccttctgggtcttcttcgggctctcctggagtcctgtgtgttattactctgctgttttcaactcagccacagtgaatcatttcttcttaccaagttgtgtaatcccgtcatttgtctgtaagagattccatcccagggcatattgtgtccccgtgctatgggcttaagacggcaaatccgagctgtgatataaatgtaaaagtcattcccgttctcctcgagcgcatgttaacgacagcacagaatagtgataattagatgaagcatcatttcacaccatcaccagcgtgctttacatttatttatcgccattcttttctccagcatcagcaaaacagagacttgtacgatatcccagagcatccaatggggcaccgtcctgccactgttaattaccaccttatgagcgcacagagcccagcactcacctctagccgctttctgggggcctaaaggggaaactcactccctgcacatctctgtccctccatatcccagacctgtctgtcattgacatgtgtcctctgtccagctgcctagggctgatcccatgccatgtgtgtactctggctgccatgacaaggcaccgcacacggggcgacgtacgcagcagccttgattttcttgcagtcctggagaagcgaagtctgagatcgaggtgcgggcagggcaggttcctcctgaggcctctgtccttggttctctcagggtcttccctctgcctgtgtctgtgtcctcatctcctcttatataaggtgaccggtcagactggatcagggcctgccctcctgacctcactttaactttatcatctgcgaagactcgctttccaaaaaggtcacattcataggttctggggcttagaactttgacaccttttcacagggacacaattcactccataacagtcctgaagcaagatgaatctgaacctcatgttcaaagtaagccctggtgagccctgggccttgggggcctcctggcttcactcctgtataagccccggtgagaacaggagggaacttctggcagaagggaagagggatggggtctcagcttgggctcacactgggctctctgtgtgagtatctttgtctaaaggtgccctgtgtgggcaactttacaagtatctcacctatggatcctcaactgggctggggaccttggcaagaccctgccccagcctcccgagaggggtgctcactcctgtgggctccccaggcacctgctcttgttctcccccactatcccagcacccatcccctgcctcccacctgtgtcccccacactgagcacccctcattggcaggaacagtggatgccggattctctctgtgtcctagagccccaggagggtccccaggagcaggagccacagagagatgttgttttgcagagagtcctcctgcccctatacccgccaggtcccctgagaccctctatgtccctgaacccctgggtgcacagtcacatagttgcaggtttggatgagacctggtgttaccttttattttgttaatcttaccctctcttattccagaaagaactcaaggtggaaaagtgtagcctctccgtttctgcgatatcactgctagaagccagccgtgtggcctttgaaaagctcctgtgaggagccacttgtttagcctgttcctttaccgggaagttccaactgttagaaaatttcatttttttttcttttcactgagtcacaatctgtctgccaggacttctaacttcatattgaactgttagtacagaatggtcaggtatttttaataaaaggaagtcatatggtgtgtgtgtgtgtgtatgtgtgtgtatgagcatctgggtacctgtgtatatgcacaacacatatgcaccatgctttgtacaaaagagagcacttcttggatttgggtctctgtccctccacattctgccaggatccttttaactcccgtaggggatgagaagggagttgctgctgtttaaagatcaaatctgctttgtagcctgtgttccttacacgtggcccaagcttccagggcttcccggtagggcacttctctgccccagcagctgcccatgggtcctctaggcccatcacgggtggggcgcattcctgctttggcactctgaggtccctcctgagcattttggtggtggcagacctcagcgtcgtaggaaacctaggaattgtggggactaggcagcgtgacccccaggacttgacagagacagggccatctgccaaagtgagcattttctcagggagagcatccatggcctcacgcttttcccaggcacgatcctgatgtctgaggaatgcctttcatccggggactgcgcagagctagtgaattgttctgccttcttagtgacgccacgcactcaggagctggaaatagccaggtaggaacttctagcaaaattatggcctgaatgccgccaggctcctgagccggcccacatgcagatcgggcaggtgaggctgctctgctagagagggccaaggtacctcccacgactcagtggtcactggccaaggagggagccagtcccaccatccaggaactgttctttcagcagaagcagcaggtcgggggacctctgcccagcgtggaggtcagtgactgagcacacacaggtcttcggccaaggctgcgctctgagtccagcttccatggaggcaggccattcggggtgatggacttggacatggagattggagaaacacattccattttctgtcgagggcatcgtcccctctcacctacctgtctggccggggtcggatcagtcagagggccttcaaggagccgtggtcatttggaaagtctaaaaggctctgcactcggagctgtgcataaatcccagcgttgcaggataagatatgattacagtatattatgtgggcttgacatttatggcaagtataaacagagcgttattactaccaaatcatgagcctccgaccaagaggaaggcagcgctgagagcacgcaagtgagaaggagtttttatacaaaagagaacaaagtgatatgctgccacttttaatatgcctgccatgaaacagaaaagcagagagcagaaaattgaaaccatcgggaaagcgccaggtccaggatggcccagacaaaagtcactgccgttgagataagtggcactggctcccccgccatggctgggccaggattccaggagagagggaaggaggaggagaaggaagcagggagaagaagagggaggagagaaggaggaagtgggcggggggaagaaggaaaagtgaggaggggagagagaaacggctcctgggtggtaactgcatcagcattgtttttccctccagttattgggaacctgggcttcctgggtcctttccaaaggggcgtcacttttgtcatctgggaggtgacaaaaatgcatctgagtgcaggtgtgccttggcaccccctagaaagggtaattgggaagattctgcaggttggatttcaccatgtgtttatgtcctggtgtctgcacaaaggcccgacatcttgtcgggttattaacggagacacagtggctgagctgatgactctgtcccagctccaggctgtgtgtggcgtgtgtctctgcaggtgtcctcactgatttcctctccagggcagactccttggccatccacccatgggcccctttccaggaaagggatttttaaagtaaatggtcatgagccacatgtcttctgggcctcctggcctcagcccagcaggctctgctcctgcataagcctctgtgagtgcagagggcctctggttgctgggaagtggggtgggctcaggttggggtttaatttgggggtggagacctttccaagtatctcacctagaggttacacctcctccctagctggacccatgactcttggcaaggcccggatcttgagggaagagccagggagctgggatgaaagctcttcccactccgtgtgagccagcctcatcgaggaacagagggacaggcctacggtgcctcctccttgggattaatgcagttaggatgagatgtccacgaagtccacagagcatctgtaggtcccaggctctgcatgagacactcagaggccatcgcccttgaccgcctggtgaaaggaatggagacagagaacccagcagttgggaacctcgggggtcagcctaggtcatgtgtgggcttggccacatccaatcacctaccctctcgaaggcacagtttcctcttctgtaacacagagatcataattgcacaataaaattacatgagggcagggttgcacctgctcttccctgttggcagcatagtgcctggcccatctcagccaccaaatgctgtctctatacagagaacccctcatttatatcttcaactctaacctctcacctgaaccccagactcctgcatctagccacctatgcagtgactcctctccagtagctaacaggcctcccaaacttaatacaaccaaatctgaactcttttttttttttctttctctctttttttttttgagacggagttttactcttgttgcccaggctggagtgcaatggcatgatcgtggctcactgcaacctccgcctcccaggatcaagcaatctcctgccttagcctcccgagtagctgggattacaggcacacaccaccacacccagctaattttgtatttttagtagagatggggtttcaccatgttggtcaggctggtcttgaactcctgacctcaggtgatccacctgccccagcctgctaaagtgctgggattacaggtgtgagccaccgtgctgggcctgaactcttttttaaattttattttatttttatttttcaacatttattttaggttcaggggtacatgtgcaggtttgttacatgggtaaattgtgtgtcactggggtttggggtacaaatgattttgtcacccaggtagtgagcatagtacctaataggtactttttcgatcctcaccttctgcccaccctccacctacaagtgggccccactgtctgttgttctcctctttgtgaccgtgtgtactcagtgtctggcccccatttataagcgagaacatgcagtattggttttctgttcaggcattaatttgcttaggattatggcctccagctgcatccacgttgctgcaaagaccatgatttcattcctcttttaaggctgcgtagtattccacggtgcatatgtaccacattttctttttctcttttttttttttttttgagacagagtcttgttctgtcgcccaggctggagtgcagtggcacgatcttggctcactgcaagctccacctcctgggttcacgccattctcctgcctcagcctcccaaatagctgggactacaggcgcctgccaccgcgcccggctaatttttttgtgtttttagtagagatggggtttcaccgtgttagccaggatggtcttgatctcccgacctcgtgatccgcccgcctcggcctcccaaagtgctgggattacaggcttgagccaccgcgcccgacctaccacattttctttatccaatccagtgttcatgggcacctaggttgattctgtacctttgctattttgcataatgctgcaatgaacatgtgtctttgcggtagaataatttatttacctttgagtatatactcagtaatgggactgctgagttgaatggtagttctgttttaagttcttgagaagtctccaaactgctttccacagtggctgcactaatttacattcccacctgcaatgtacaagcattcccttttctctgcaacctcaccagcatctgttatgttttgactttttaataatcgtccttctgacaggtgtgtgatggtgtctcattgtggttttgatgtgcgtttttctgatgatgagtgatggtgagcattttttcatatgcttgttggctatgtgtatgtcttctgaactctttctaaatctccatcggatgtatgccttccaaattgtcttcatctgggctgggttcagtggctcacacctgtaattccagcacttaggaaggctgaggggggtggattgattgcttgagctcagaagtttgagaccagcctggccaacatggtgaaaacctgtctctactaaaaatacaaaaattatccaggcatggtggtgggtgcctgtaatcccagccacttgggatgctaaggcaggagaatcgcttgaatctgggaggtggagtttgcagtgagccgagatcacaccactgcactccagcctgggtgacagagcaaaactccgtctcaaaaaaaaaaaaaaaaaagaaagaaaaaattagccaggcattgtggtgtgcacctgtagtcccagctactcgggaggctgaggtgggaagatggcttggcccggagggggtcaaggctgcagtgagttgtaatggtgccactgcactccagcctgggcaacagagcaagaccctgtctcaaaacaaaacaaaataaaacaaacagaaaaactcaaatcttcttctgtctacccatccattttctctaaaaaccaaggagtcagcctgaatttctgtctttccctctcttccttatttaatcactcagccaacccttacacccctacccccaaaatatagctcaagtccatctgcttcttcctaccttgactgcaaaagccctctgccaagtcttccgcaatccattctccactcagcggccagggccatcttttaaatacatgtatcaggtcttaatacctcctgtcttcagatgctccagtggcttctattgtggctggagtaaaatctaaacccctgccatggccttccacccctcccctctcaggtccacactctagcctcatctcccaccagcctccctcttgctcctcccttggctccggctcacaggccaccttgctggttcttggcgttgcacatctgttcccaccccagggcctttgcacatgcttttccctctgaatactcttaatccagattttcaatagctggatccactcatgaaaggactaagcacaaatgtcccttctttgctctcaggaagatctaggtatggcatcactgtgcatgacttgggaacagaaaggttcaccaaccatccagaaggctggagagagctcaggcagggactgttgaaataatggaatgtcaaggccactgtgggcaggatgattggacgggtttgggagggaggcatggaagcccgaggtgtccctggcttcagcaggcttgctgctttggctggggtgttcttacacacctagaggagccccaggctctgctgttccctgtcctggatgaacatgcctatgaagaggtgtgtgccctctgcaggcagttcctggggcctctgtggaggccttgggcagggctcaagtgcccttggccgacaggctgggatgctgaattgcaccacacctgtcacacgctgcaggatcttcctgcctggcgctgggcttttgctgatgctgttttagcaccatcctgaaattgaagccacaccaggtgatcttgagtgagacctgctttttgaaagatgtgtccccagagcctcagagcctcttcctcctggagatgcaggtggagcctacagatggttcagggaaatttggaagtgtgcatgagtgactgccaccgcctcctcctccagtctctgaatcccagtgaatggagatccctgaacctatggaccatcagcaggctgtctgtccccagggtccctctagcatgtcagggcttggctctgcaggtacccagcctgccccattcctggtggctgcttttatagggaaacagtagaatgttggttatgaacagggcctttggaatcatttagacacaagtttaaatcctgcctcttccatctactgaccaaccgaggacaaattacttaacttctctgagccttggttcccttctctgagattaggtgggcatagtacctgcttcctggggttgagaggatgtgacaggatatctataaagccttgggcccgtggaagctgtggttcatgtcagctgctgctgtgattgtccacactcagctcccttccccccttccctcccatcatgggcttttcaatccattcctagttgaagcagaggctccccggagtccattcattctggcatctccagctccaggtgaaggatatagctatgcacagaccctactggtgctctggtggatttctcggctcagggaatttcaggatgaaaccaagggccctgcgatgtcatccagtctcctggagcatcctacagggaggaaagaaggcatcgagggatgccccgccctcccattttttcattcatgtcttcctccctgaacactgcatggagccgctatagccaagagcccaggacccaacctccctgcccaagccttgccctttttggctcaggaggggccatctgggctcctggtgaggaggggggtgagctgatttagggggcagcgaggcagaggaactgagttgcccccttgccgggctctcaagtcctggcactgccccacctggctgcagaaccctgggcaactcacttacctctctgagcttccatttctttgtaaataggggtcacgatttccatctcacaggaatggtcattctttcatttaatacatgtgagaggggtagggatgaggcttggaggaagggtttgagctggcccctctaagctatccaaaaaatttcactctttatctaaagggccctggaaagccatagaagagtttctggtttgcttgcttttgtttttattattatttttatacagatgtcctcgtccatgtgtgtttttcgtccttagggtcttatgactcagtgcttctggacctttccatggggcctgctccttttgattcagggaaatccctggaaaggactccatgcagtgtctgggcagagtgccgggctgctggagcttggggtccctgctcccaggtccctgtccccacctggaatgagataggagaccaacagcatcttccctagaaggctgatctccctcagggactctttggatggtgacagacagggccctgtgttttctggactatgctaaagggctgcttgtgtgctggagggatctgggggctccttttcaaaatgaaggtccaagcccagatctttgtggagggggggaatggacacggagaacagcccatatttcccagttccttcaagttctatttgcaaataaagaggttaattggaaaggttgtagtcactggtcactggggctacaaaaagccccacgtcctcccttttttcctctggtaccgaggaggtgagcttttcggttgcttttctgaatctgtagctgaaaaccttgacttgataaatgagatgtaaccttgaagtaaatttgcctattatctagaagtcatggaagcagacactaaaaatggactccatttattttacgagaagtcagagcatgtcaagctgctcataattagtaataaactcatctctgcttgatgactttttacactgtttgtattttttattgatgtagtcacgcttaggtggccatcactggaggcgggcagtggtggggctgcttccggtgcggagcctcccttcctcctccagcgtccctgcatgccccgcgccacccctgccccgggcagccccggctgctccttcatcacagagcccagactcgcctcgtcagacttggctacctctgtgagcttgcaggaataaatctgaggtgctgaatatagatatattttcctttctcctccttggagagcagtgatttgcagccttttcttgtgtgagccagccaccctcatgtgacttgataggcacatggtcaggggaagttgctgtttccagacctaatgaggccttggagtcttgttaatggggctccttgctgtggaatgtgttgtttatggatggacagggtggccccggctttgtctcctcagccccatgccaaggagtggatctctgatgggcagcaagggttgagaaagaagcagaggagcctccagccctgggggccctggagcctggcagctttggctataaaatctcacccttcagcagcccatgtggcacactgggaggtaggagcctcccttctagaaagttctagaggctttccctgtctgcagagcctgggatggagcaggctcacgtgcataagaggggctctaggtgggacaggtggaagagtcctttgtggtctcatttgctcttgctctggcgataaagccctgttatcagtcatgggtaccaggtgacccttttccagtgagtctctggagacccaggggtcagtggggagccagcctttcctcatctctgccatgtgcagggaccatggagaagggcatgctgagtgggtcctaggcttcataaaagagctgggcacctggacagcaccattcccagtacagagaaggcaatcgctggcctcaccaaactgtgctctggtgaggctggagagcccctccccaccccctggttttctcttggcctctttggtgccctttacattgggccctgtgaacaggacgcagaggactcaggcagcccatcctcctagcaccacaatcctcctcatccctcaccccattcgacggcaccttttcttgaagcctttacttagaattcagctccctcttcctgctctccttctgcagtttgtgtttcactcttttgtagcaggaaatgttctggagcattgtcatttgcagacatgaggcagtctgcagatgggccagtggaccatacccagatgcaacagcttcctgagagctggcatgagggctccagcctgtgttcttggaatacaagctctgaaagggtacagggtgcggtgtttgcatgataagcagggaaggtgaaacttgtcccttctgaagtggggtctgcgtggggtttttcagagctagtgggttggtttgctagggctgccgtaccacaaacggcgtggcttaaacatgggaagtgcattgtctcatggttctgaagggtgaaagtctcagatcaaggtgtgggcagggctggtttcttctgaggctgggagggaggatctgtcttgagcctctcccctggctgctggcatgtgcttcagtgttccttggcttgtagaagcatcaccttgtcctctgccttcatcttcacgtggcattctccctgtgtgtgtgtccaacccccacctttttataagtaatcagtcatattggattagtgtccaccctaaggcctcattttaacttgattacctctttaaagactgtctccaaacaagggttcattctgagatactggaggttaggacttagcatgtaaatgttaggggactcaacccataacagctacaaaaagggaggtgcatcctgttcacatgggggctgggactcagccctggggcaggttctggaggtgattcccaccacagccatgccaggacaggacccctacactgatgcactggagtgtaaatccgaggagatggtctttgcactcttgtgaatcaggctcaaatctcaggtctaccattcaccagcaggtgaccttgatcaagtggcttaacttctccaaagcccagttccctgtttgcaaaatagggttaacactacctaccttggaggattgattgatctgggatcaaatgaggtcaaagatgacaagcctcggtgtgcccacattgtgccaggagcatgggaggtgctcatgccttttgtggctctctcaggactgtgtagtccctagagctgtttcttttcaccctgtccctcttagccttgtcccattctggcctggcagagtgagcaggctgtgctggcctgcacaggtgcaaggatttgcagcaagggaaggtgtgatgagaacaagaggccatccctctcctgccacgcctgccactttctccacgccggagttgcctgcaccaattggcagtcgggacacacagcagctgggatgaagggagtttactgctgaacttaatagggtcgttttctgcttcacataaatctgtctgtgctcagctgaggatcctgggtggctggtagagcagccattgttaatggacttgtccctggaaaacggggctgtgggtgttagagtgttgttctggatgtttcttccttgggaagggagaggatttagtaatagaagctcagtttggctcttccgttgctgccggcctgcctggccaatgggctgctttgggcaacaaaataggagtggcgccatattcatttggaatctgtgatcctgcatcatggcaagtcgtcatccttggatggaacaatagggtgggtcctcagttctctctgaacattcattgagtcgtttgctcaacagatatctgctgagctgtgagcttgggccagacctgtcatcaattctggtcaatgcgaacaggacagatttggtccccagtgtcatggaactaagagtcaaccagggaatcttcaggggagaagttggtggccaggaaaagctggggaggtgaccttctagctgacatttgttgggcgagtcaaagctggccagaccagaaggggaggctggagaagcctgggacacctcctggagccacatcctcttccttcagggacttctgagatcctccctgctagctgtgtagaaggaaccagaatatccaggtcctgtgtacccagccacctgagcaacttttccacagtgtgacttttttaaaagtcaagatgaatctcatttcatgcaataaatattaacctggaaggttgggggtacattaaacttttatgcatggcaataaatttcttatgcaagagaggactcactactagttaaagaaatttggggtgaaaactgccttggtggggattatcccgactcatctgtttagcaagtaacgtaaaccgagtttccttcaagctggattcctgtgtgttaatcatctttgagcctctgtttcctttcctctctttctgcacctgtcatttgattcctcaggccctggggctgccttccttctggggtcctctttgaagaagaatccttgatatctgccctctaggagtttaatatttcttgaatgcataggccataatccatacatatgtcttagaaaaccaaccctgaaaattttctctatacttggacagggccagaaggcctaatttcaaatggtcacacctacttgcaaatgatccagtgtcttcacaagggcttgacacatgtgccctgcctgcttcatgtcctggtcatgtgactttataactaatgtttatcctgtcttactagcatttctcttatgattggtgggcctgggtagaattgatgaacttgagcagagttggtggacttgggtagtgctggtaaacttggttagagttagtggacttgggtagagttagtgaacttgggtagaactggtggacttgaataggattattggacttgggtacaggtggtggacttggatagagttggtggacttgggtacagttagtagacttgggtagagttagtggacttggaaagagttagtagacttcaatagagttagtggacttgaatagagttagtggactggtggaatttaatagagttggtagacttgggtagaggtggtggacatgggtaccgatggtgaccttggatagagttggtggacttgggtagtggtggtggctttggatagagttggtggactttggtaggattggtggacttgaatagagtgagtgaacttgggtagaggtggtgaacttgggtaggactggtggactcgaatagagttggtggacttgggtagaggcagtgaacttggatagaggtggtgggcttgggtaggattggtggacttgaatagagttagtggacttgggtagagttagtagacttgaatagactgagtagacttctgtggaggtggtgaacttcggtaggactggtagacttgaatagagtgagtggatttgggtagaggtggtggctttggatagacttggtggactttggtagggttgatggacttgaatagagcgagtgaacttgggtagaggtggtggacttggatagacttgatgcgtgtggggcaaagacaattagtggaacataaccatttatgccaacccttctagctcgcagaggtgctctgtagaagaagaaagacattgcggaagtttttaaatagggacatgataccaagtttgaaacgtgagagagtgagtaggaactgtgcccttgtctgacccaagtgctaaatcaacaggaacatggtgcccacttgttacatcactcatggacatgagctgggctgtttttcttgcatccatttcactgggtgattaatatctcttttaatgttcagctgcagtgaattcttaacaaattattttgtaacacattgaaatcactttgtaagctctttgttaacacctttaagagggctctagctataaaatattactttatcatcttcccgttgcaggacatttgatgtaacactcgtgtctcggaggttgttaataaataatggatggaggaatgatctgggggtgaccttttgtagaacatcatctgtcagccgaacttcacttaatccttcctcttacgctgtcttctggctttcaggatatagcagtttgcaaatcaggtggtttggttcctgccagtgagtgacatttcacaggatgggtgacatcggaacgattggcctgtgtggttgcctctgggaccctcagaaggatttaagccccgtgattagcaggtctatttttggccaccaagtgcaggagggagggcatctggtgtgtgtctcatcttggctgtgatgaggcttggctgaccccagcaaggactctccatgagtggagtgtggcagcgctgtggttagctggccaggtgaggggtgtttctccaataagcatttgtagatctgccctctactaaacctgcttcaccctggtagcccccctcaaaggcatagcaagccagagtatcccagggaccgggaacacttgggaacagatgcctgatagagagtcacagaaccataaagtcacgggggctaaagccagagaaaccagagtccagccccatcagcttacagagagggactgaggtcagaaaagccgagagtgcctcttccagggtagctcatgggttagaacagatttttcacttgactcctgaaactgtggtccctttagccagtgccctgcctcacaggatgactctagagtcacttcattcattcataaacaatgcttatcgagtgctgactctatgcaggtggtgtgcaacatcctgaggacactgcaggcagcgagaccagcgaggtgtcttagtccatgcatggtgccagaacaacatactttagactgggtaactataaacaacatacatttaatgctcacagttctggaggctgggaagtccaagatcaagacaccagcagatttagtgtctggtaagaggctgttcctgatagatggcaccttctatgtgtcctcacatggtggaggagggggcacacaggttcccttgtgactcttttttttttttttctgagacaaggactttcttgctctgtcacccaggctgaagtgcagaggcacaatcctagctcactgctttcctgggtttcttgtacacagatcagacctatgagtgcatggtggtcattacagcttcaacctatgctagaaggcaggcgtgaaggaggctgcagctgcagatatgggatggtgggaggcttccctgaggaggggatgtcgaaggtgagaggtaggatgcgtgagatgctttctgggcagtgggagagggtatcccagtgtgctgtgggctctggggctgcagagatgcgtgtctgtggagtttggataagccccataaaaacactccacacagtgcttctagaatcagtcggagtccatggcacaaagcaagggctcagtatatactgagtgaatggatgaatgaatgaatgagtgaatgaatgaatgagccacctgtcaaactgctttctcagatcagtccagtcaggggaatggcggtggccatgggcttctgtagtggatgtccttaggctcggtgtggctggtgatgaaggactgagagtcatcccagagagtgcagaacacctcccatgaccttccccagagtccaagcccagggagcagttgtgacatccagccaagctcacacttggcctggaggccggaccccatgaggaccaacctgtggtcttcagaggttgtcgggagggaggccccagtggacgctgaattccagcctctgtctggaggcctttgagcagcaagcacctggtggctgcgctgtggatgggcttgatggtctgaacccataacacccattcaggcatcagaaaatcaccctcgaattatctctagagttttatttcctagaatcctgaatagatcacattttattgttgaatactgaaatctcattactttaggaagtgctattactgggctattactggaaaggaattcctctctcctgttctgattaaaacctcctgttcatatttaaaaaataatttcagacctttttttttaatgcttctaaaagtataaacgtgcagccaagcgtcttctttccctaggccccgcgcctgggtgtggacttccctgggcctgctggtggagagtgagcgcagctctgcagaagtagagacaccggagtctcctcctggacccccttcttggagaatgatccctttcttttcctctggctcagttgcttcctaagattctaatgacagttctggccaaaacaggcagcccccgttaccactggtttgagacttcagctctggcttttttcaccaggaactgattctgggatcttggggcatagggtccaagatatggcttctctgctgactgatggagtcaggggagctggttccacccagagcaatacgtggggatgggtggaaagcactcctccgggcagctcctgctcctctctggaggctgctccctccgcgcacagggtcatcagcttcctgcgtctgaatccccaacctgggggtgtcctctatggccctctgggctcacttggcactatcacatgccgagcccactgtgtcatgaatattacctggtgacttgctcctttctcctcctctgggactctgcccgttctctgtgaccccaatgtacttggcacagggactggcatggggcactcagaaaatatttgtcaaatggatggtggaattcaccagcacccagaaagcagtgtgatttggggagttttatcagcgagtggccatgtgactcccaggggcagaggggatgtcttcagcacatctccgtccctttgccaatcacaccctgctcagtagagcccaccttgcctgtcctcctcattgcctgccctgttcttgcctggccgcactgagctccacatgaggtatattccacatggacacaggggaggtgacccccttctctccagggctgctcctccaaggccgcgggttgccttggagaaagctcagaatagctgtgtggccccatgctgatgctgggtgagtgtgcatgtggctagaattcttttctggactcttggcaaatggaattatttacaaccaccagggccaatatttccctgctccgcagatgatttgcagcagatgaagtagatgctctctccttgcagagagctaatgataacattgagctcttcccaccccactgatgtgtctttgatggcacagctgtggatatttttatttgcccagtcaagtcggctcctcggtgcacatgtctgaagtgaaggcccttgggtctgcaagctgcagagggcactggcgccagccttgtgcgttgacaggagactgcaggaacccgccagcttggttgctggcttcctgagctctgtctgtgggttccctccctggaatggacaagggggagcagccgatttctgatacagctcatctgtctgggtcactggttccagaagttaattttggatggaacttcacaggcacctggcgtctggttatgcaaaacctgacctttggcttcactctggggccttcccttctcctcaccccagggctcctgctgcctccctctctgtgccattctttcctcttaaaaaaaaatatcctgctgacaggagctttctaacttgtcattttggagatcatcaacaaattctatagagaggtgacctccattatgagaaagagacggggagttggctgggacccaagccaaggagctggagcctcttttgactggcaaggtgacattgagtgtcatatcagcattcatggccagctctcttctcctcagagagtaattatttctttcagagcgaaaggtccaatttgctgtaaagaacagagccccaggtaaaacgaaagagctataagctcccctgacataaaggagaccagactgcccccgtccccagccctgctcactccacatcataatggccatttggccagatttattatgtttacttgtacttccttcctgtcataacacattagggtggttgcacattgcatgggtgaggccggctcagcaggtggagctgaacaccttgcagctgacactggctcttgtatccttggccagcacctggctctgggcagggattgagatggcacctttggagaaacactgggagagctgatgcctggcatttggggccaagctgagctctgggccctctgcactctcctggtatttcctctactcctgggacattacaagaataagtggcctaagtctgtggccttggatgccaataccacgatagatgtcattcactgagtgctcaccctgacccagatcatgagacactgggcactgatggttttatttagcacaggccctgggcactcatggtttcactgggcacaggccctgggcactcatggtttcactgggcacaggccctgggcactcatggtttcgttgggcacagacactgggcactcatggtttcgttgggcacagacactgggcacttatggtttcactgggtgcaggcactgggcatggatggtttcattgggtgcatgccctgagcactcatggtttcactgggcacaggccctgggcactcatggtttcactgggtgcaggccctgggcactcatggtttcattgggcgcagacattgggcactcatggtttcactgggcgcaggcactgggcacttatggtttcattgggtgcaggcgctgggcatggatggtttcattgggtgcaggccctgggcatggatggtttcattgggcacagacactgggcactcatggtttcattgggtgcaggcactgggcatggatggtttcattgggtgtatgccctgggcactcatggtttcactgggcacaggccctgggcactcatggtttcattgggcgcagacactgggcacttattgtttcattgggtgcagacactgggcatggatggtttcattgggtgcaggccctgggcactcatgctttcattgggcgcaggcactgggcactcatggtttcattgggcgcaggcactgggcactcatggtttcactgggtgcagatacctagcacacaaagcagtcctatttgcccatctatggctgagcagagtgagctcacagtcagtgaccccttcccaggccccacccccactagcacaggagttcccgctgtgtgcacccatggcgtggctctggggtggctctgggtggccctcatcacttggactgccttttcttcttttctcgtctgccctcccctaagctgtagctccatttctgtcttgcacgctgctgcagcttcagcacccaccgtggtacctggctcgctgtggtgttccgcacatgttgttaaatttaaattgttaaatgattggatgagcctgacgtgagatgaggacctgcccagagtcatccagctgctcatccacagagcctgggctgtcctgccacgaagcccttgccagtcactatgccttcttgacttcccatggcaccatgactgtcacactgcactgtggcacagtgtacctccaccttcctccttctgcttctgtttttgggagttcagtcaaagctgacatgttgcccaagactagaggggagagtttggaggccggagaggatggccaggtcctgggtgtggaggttgcttcctgcccctcctcctcccccaccacaggggcctggagaaggtagggtggtgtcctcagtgaggatggtctgaagggggcccaggagcagagggaggagtcatggttggttggaaattaggacaaccaatgcaggaagctctctgtcacagcttgcccattctgtaggtgagatccgtgaaggtcaggaagttgaataacctacctaagtttatctggctacttaggggaagaacagagttcagacttgaacttgaggtgccctaatgagtgtaagagtttgagggggtcattcacaagcataccctcgcttctgacactaagtgtaaattcagggcaggaccactctgtggttccataattcactgaaggactcacagaacttgctgaaatctgttatgcgtgtggttaaggcttatcagagtgaaaggacacagattaaaatcagctgagggaagagacacatggggtagggtgcagacaggttctgggtggggattccagccatcctctatgggtaagttgtgggaccactagcgtctccccacagcctgtgtgtcggtgtcgccaaccaggaagctcgctgggccttggtgcccagtctttactggggctcacacatagacctggttagctacccacatgtcttcagcctccagccctgcctaggacaagctgaggtcatgggaccccaaacacacccccttatcacattgttagactctcgagcatggcccaaagctccaaagacactctcacctgatcagtcccctcctaggagcccagggcacagcccagacctctctgtgggtaaggttaattcttgattgaatagagtactatgtaggagagtgtctaggaactaaattcgggcttattccctgatagactcttctcaccccgggtcaaggtacttcaggcccttgccatggcccactggtgacgtgggtccctgctgcggcgttcaggccccttgcttacatcacggcacttctctcttttccagactgacagcagcaatcacagtcacattccacagcctctccagcacccagccagctctccgcgggggcagcagggactggtccacccaacaacagcagccatgtcctcacctcttgctacagcagcaactttatttgatttgatgtatatgaagaaataaaactcagaagtcaattgacttaaacatggaacaatgcagcttggttattatggtgtatgctaaattttaatggcatttagaaagcgttttgtgtggtagaaaatagaagcaaacccatcaaaccccaactatgctctgtgttttatagtgcagaacgtttttctgctacaatccaaagactttaaaatgtaataaggtacatttgaacccaagggttttaaaatcgatgtaagaaacgtgcacatccagaaatggagtaaaataatccattactgtccgggtcgtattcgagggaagacacacattcctggaaaggcttttaacatttcatgttccacagactcttatttattgacacgtattagtgttcaaggattaatatatcgctaagtgagaaagaaaagtgtggttgggaggggttttgatagtcggcgttcttgggtttcttgctatttttgaatgcatttactcagatatatttaaaatcacatgccacataaatggatatatcaattgagaaataaggcaaattttccattcttacatttcattaaaaacacattccgactgtcacatgtctatatcccccttgtccttcccaccaaacatgatttttcagagcccgccattattgccctgggtcctgggatatggcactttctttttctttctttctttttttttttttttgagacggagtctcactctgtcgcccaggctggagtgcagtggcgcgatctcggctcactgcaagctccacctcccaggttcacaccattctcctgcctcagcctccagagtagctgggattacaggtgcccactaccacgcgcaggtaattttttgtatttttagtagagacagggtttcaccgtgttatccaggttggtctcgatctcctgaccttgtgatcctcctgcctcggcctcccaaaatgttgggattacaggcgtgagccaccgtgcctggcctggatgtggcactttctaatgctctgggttttgtttgtttgtttgtttgtttgtttgtttgtttcgagatggagtcctgctttgtcacccaggctggagtgcagtggcgtatctcggctcactgcaacctccacctcctgggttcaagtgattatcttgcctcagcctcctgagtagctgggattacaggcgcctgccaccccgcctggctaattttttttgcatttttagtagagatggggtttcatcatgttggccaggctgatctcaaactcctgacctcaggtgatctgcccgcctcggcctcccaaagtgccgggattacaggcatgagccaccatgcccagccacactccatgttttctatcgccctgtctgtatttcagagtttcctggccgtcctcatcaaaggtgctcaggagtttctatggctcaacacagtgtgagagttctcaggaatggcccggcctctgtgggtggtgcagcagctgcctgcagaaatctgcccacatccccgacattcatttgacagatgaacccgtttccatgatcttcagtttagggctgaagaaatcctgaaatcttctggttcagtggttctccactgaggatgattttgtccccccactccagggacatttttggttaccatgactaggaagtagagggtggccctctgggcatctgatgacatctgagatctaggaaggttctgcatcatctcagatcacacaactggccagtggctgagatggagcaaaactcctggagtccagacccagcctggggaagtcctgggctgagcgtgcacctctcttctttactgttgcacccctgccccacccgggctctgacctctccctgaagcttctacgccagtagtgtggcttgggctcacagtgtcaagaacagccaggtcttcctgggttgaggctgccaggcttagccgtcctcctatcctaaatccctccccaacctcccttaatctccagccaccgccagagcccatccttgcccttcagaagctgctctccttcgtgcaatatgggtgaggccattgcaggtcctttaggggacagcacagacctgcttgatgccaataagcacaaatctaggtaagactgaaaatgttggtgagatttttgtgagtatccttgctgtatgtgtttagttttttgtttgttgtttagttaaactagcatgcagtttctttttcaaaagctcaaaagtatccacatcctaccccaccgtctagtcgagctgcacgtctttcctgggctgggtctgttgcaggctgatcactgagcagctgcggacgtagtgggcccgtgattgggcatctcgcgttattacgtagccttgcccgtgaacacgtctctgtgtttctcaatcaacttcatcaccgtcagtgttaataattacaatcgccacagtgatggagccccgtgccagcgctgccatgagtgctttgtgtgtaggagctaatttgatacccacagcagccttggagccccatgtgctcttattaccctgtcgcacagaagtgatgcacagagagatgagacacgtggcttccggttgcagagctagtcggcaataggaccaggatctgaacccaaaacagccatctagagccgcccgcatagccaccatcctacaatgcttctccctttcaatggctgcaccctggtggagcaaaggggccaggccccattgaagtggccctgggccaaccaggtagtgcttccacagtgcctttactcagagctctgtcaccaacctggtgtcaccgtagaagctccacaggttcttgccagctccttccaccccaacatgtagcctgcaggaggcatgggaaccaggggaagaaatgaattggtgattctagtgcagagtctgtcaatcttggctctatcagccatggcactgggtcattcttggttgtggggggctgtcctgtgcattgtaggacatgcagcagcatccttggcctccacctcctggagtatttctacccagtagtaccccgtctctgccagtcgtgactgctaagcaagtctccagactttgctaaatgtcgctggagctgccaaagctccagcataagcaagggttttgctaaagcccaggatttgattcgctgtggatttcagttcccccagccccagggagccccgagttggctgcgactgaatgaagtgagacgtgggcctaggcactgtgcgcagatgggtgggagtgctccacctcagtccaccgcctctcccctactcgggggaagccttgtagggtggtggctacgtggcctccacactgcagcgggggaaggttgcactcagactcactctgagtcccacagagcagaggagccaagagacaacaggaaacccaaaacaatgatcacctgcttccagacaactttgcttttttgccttgtggggaaacttataaattatttggagagcaatattagtctttttgcttctgaaaaaggttctgcatctttgatagagcctggttttgaaacataactcacagagttgtacaaataccccatcaatagtgcagtggctcatttcattgttctcagtgcatggaatcttcattatttgcactgttgataaaaggcagcattttcagcagatctgcactactccatttagctgagaacaatgatttattcctccctcactattggacatcctcaatttccttgggtaataaagaatgctcccatggatgggatgaacaggagcgaccggctgctctgagcctggcaaagtcaggaagagcaagaaggatcctgactggtggctcctgcccagggagaaggacccagagcctgcctccccgcctcactggcaaccacagcctgtggtggaagtccggagttagtacacgtcattgacaaattgcccaggaagcagccgggcccctgatggaaaactgcccatctcagcacagacagtgcgcctggtcccaaacgctcctttctacgtggaggtgaaattcgaatagagcccttattcaataccacaactcagggatgggcaaagttgtgagcatgtatgcatgcctgctcttgttttctccgtattagaaaattcacagactgctgagagagggaaaataagagtaatagcttcaaactggaaatggaagaactttcacattcaacacaaaagggaattgttgcaatcctagggcaaacgagaaaagagcccagcctgctgcttagcagaggacgcaggcatggggagaggaggaggggccgccaacaatgacaaaaaattctgcctagcagtttgctccattgcagccttgcctgggtggaagggaagaagattggagacttccagcaccttggaacagattaatggctctagagatgccacacctattggtggatggcttctagccttacctttacaaggagccaaatataaggaagcaggcgtgcggcacccctgagcaatgggcatgcacgctcaccagataccaggacactggagagttgtgtgcgtggaagtgagggctcaaggaactctctgggcttcttaccagcctctaggccactcactattcatgctgttattacccccacgttgcaagggaatgaagctcagagatgagacacgtggcttctggtcgcagagctagtcggcagcgggaccaggatctgaagccaaaacaaccatctagagctgcccatatagccttcaccctacaatgcttctcgctttcaatggctgcaccctggtagagcagtggggctgggtcctgttaaagtagccctgggctaacctggtggatgcgataaccagcagatagccaccagcccagccaggtcagacccagagatgaaacactgtttcgtttcttccctgcatcccctggggttgtctgcagggtgcttgcagggctccttggtagagctactttttcctagaaggttctagaagcagaggatgaatgaatctgtggctgggtcctttgtgttggggcattaggagttgagatgagcttctgggagatagggcaccgtggggcacattttagagaggacgccagtgcatgcagggccattgtcctcagcttccaaccaaataacaaggattacccaacccagcccctgacccgaaaccaccattggccacaccctagagactccagtggggcccttgaatcacctcaccaggcaggagcaaaatcctgtttcaaagagtaattgttgctatggcaactggccttatgcactcacctggttgccactgggggactgaggcggacgcacatggtgtgttggcagagaaaggaaaaaatgccagccctgggaccaacacccgtggggacaggcaagggagttgaggtgttcagccatcaaaacccatcttcccgtctggagcagcaacaggccgggccttcccctgtgcaggctggcaccactgattaggggacctgtgtccccatggttacccaggctggaggatggcagtaaatactggggcctcgattccaggcaagagatgttagactcaggtttgtttgtgaatgtgagaattggatatttcctaccataaaggcctttccattaattaatgcaaacattaaagctttatagagctggcttcttctaagtcaccctttgtcaacagagacagggtggacagaagggggcagggagaggtaccctgtaggacaggaagcagcggactggggcaagggccactctgctcttcccaggtggggcccttcctatcaggaggcaggcctaccaaggggtctcccagctgcctcaccagctcgcttccctcagactaagagcccctgagtcctcagtttttaaaacactaatagggaggccaaataaatatttcaaggtcacctaagggctcccttgggtcttgtttatttatagcatcctggccacctccatctagaaatgtttcaaagtgcagaagtatgaatagtaagaaggcagctcttcatttatttatttggttatgaatgtatttattttcgctgtctctgccaactcgaagggcctgggcataactggccagcacatggccctgctctggcccttggcatctgcctgcttgctcagggagcatctaagtggaactctgcattgcatttagtcctcagctgcaaaaaggaagctagttagctccagggggctcgcgaggagactgtacctgccaccacacatacacgtgagccaaggtgtgctgtcatcctggagaccctggcccaattccctggagcatctatggagacagagtataagcagtgcctaatttagtgagtccagcagtgtggacgttccataccagtgaactcatgcagcagaaggggtcagtattagctgggcttcattgtcctccctctattcctggatgataccgccctcctaagaggtaagtgtcatcacacccatttcatactagagactggaagagatcaaaattgtagccccaggttgtgaacatggaggatggtggagctaggacttgaacctggctctgtccgacgtcttcccctgtctcaacactggtgtctcttttgccctggagatggaagccaatggtactgtctgcccaggattggttaacatttgtccccagcccttgcctatgtgagcaaaatgacctctcagataggctgctccctgggagctagtctgtcctcagcctgtgtccaaaggctctaatggatgagatcacagaccggatcacagattcggatctgtctggaagtgctggacccctgctgcatgtccattctgaaaagtgctctgcccaggcaagatggcactcaagctccactctacattaatttaattaatacaattaatttagaccaaatctagtctgtccaacccagtcccaacacatagggagcactcgcctgaccgagggctgaggggcccccttcacctctctaccccaggagagacctgaccacctcccagagttcattcattcaagcatttactagggacttaaaaagcgcaaggcactgggaatacagcagcaattaacaccgtcctcgctatggggagacagacaagtaataaatgtgtaagagcagcagtgaaaaggccaggtgtagaggggacctctggcatggctcaaccaagagtccggccctgtcctgcgattctttcaatgcctccctcctccttactgttctctattctcaggccgacttccctgtgttagtaaaatgactgtagtcatctcaggccccagatattctccactgtcctaaagaagagagaacctctcttttcccaaccattgggtaaaaagtccgaggtttcgctctggatctgtttaggtcctctgacctcctgaaccaatcactgcagctagtggatacaattcatttagactaaggattgacaaactatggcccatgaaccaaatccagtccaccatctgcttttaaaaataaaggtttttgaggaggccgaggcaggtgatcatttgaggtcaggagttcgagaccagcctggccaacatggtgaaaccctgtctctactaaaaatgcaaaaattagccgagtgatagtggtgtgcacctgtaatcccagctacaggggaggctgaggcaagggaatcgcttgaacccgggaggcagaggttgcaatgagctgagactgtaccactgcactccagtctgggtgacagagtgagagcctgtctcaaaaaaataataattaaaaaaataaagttttattggaacccctccatgcacatttgtttacatattgtgtggcttttccaagactatggcggaatcaagaaggcgccatagagacagtattgcctagaaagccaaaaagatgtacagaaaaggccttttacagaacaagttcgcaaacccctcactcagacacatctgagtctgtcctgggagatggtgttagaggaaattctcccaattgtagtgagctttacataagtgctggagggcagttgatctatgcactgtagcacctgctattcctgtagccattcagccaaagaagcctgacggccttgtatgtaactaactgtgtgctctgccagagagatcctagcttcagagagagagaggaagccgtgttacataatcagagtagccaaaagcaagaagcaacccaaaagtccctccacagaggaataaacaaaatgtgctctatccatacgatggaataatattcacccataaacaggaatgaagtatgaacccacgctaccaccaggatgaacctgaggacgtattgctgagtgaaagaagtcagtcgcagcaggccgcacatggtgtgtttcatttatgtgaacgtccaggcaaatccacagacacagaaagcgggtgggtggttgcctggggccgggggcagggaggagtggggaggggctgcttcaggagaatggggtttcctttcagggtgatgaaatgttttagaactagacagtggtgatggttacacagctgagaacatcctaacatccactgacctgtacactttaaaatggtgaattttatgatatgtgaattttacttcaattaaaaaaaaatcggagaccgagtcagaggccgcactaaactatggggctggtgggggatgaggcctgtgggcccagcaggtgcatttaaagtggggacccaggggccagggcttcctgggagggactttattccagcttttccttagctcatatcttgcaccggctcctcgaggcaccccatccccatccccactctgtctctgacttgcctgggtggcctgacagtggcctgtgcgcctcagggtggcacctgcaggcaccctcctccctggctttcttgagcacctgatggtgaaatgccaccatgcatgacagagtctataaatttgcctgcaggtctggcatttatgtttggcacctttgtaaaaatattatttcccattgctacccagtttttataatgtcaatatactaagatctacctctcagtattacaatttatacacaatgctgctttctttataccctagagcacatgtgtttttctaacttagctttcaaaaatagttgattttcaaagagatgtcgcaggagacttgctgttggcagtgaaataagtttttttattgtggtctggagcaaaatatgtgatggaatccttaattgaaattcacctttaacattcaagttatatttttattacaatttgaatccattgtgagggatcgttatctgcagagattcatttccttcgggaagtttcttctttggtgatgtaatttaaattcagggagccgggaaaaaacaccagcgtctcgtatttcaaaccgctggcagaaaaggctgctggtgtcagtgcccaggaaaccgtaaaacaaagcactttctctgtctatggattgtcttcctgttgcgtcctcatcggggcattctggggcttgtctgagcttcttaaccagcagaattccctagaaggcaagggcagtggccgtctgaactggcaggcagcattaaaaggggactgaactccttcactgtctttgtttctgacacctcgctttgatctcttggcctcccgatgcctctccttgcctcttcctcctaaggacagctttccttgtgttctcattttccaaacaacacacatcagcgaaccgacaaagcctgtctgcgtgcgtctgccttgcgccatggagcagagacttgaggctgcggccaggcagaaacaggactgccaagtgagcggtggagaaaaagggctgttcttaatcagtagtcatcactttgtggaggataatggcaatttaattaattgcccaatgccagtgctgaagacagggtctgcaggaacattgctagaatttgaggaaattattacaaattgtgcattcaactcttaggatgaataccaaatccagacatcatatgttttaacatacctattatttatatgcaaatctggctcttcaaagaggatttcccaggagcccatggggttagttttcctgtaggctcagaaagtgactgtccatttgcccggcacgtccctctcctctggtatcccaaggaaggttgcccagttaagtccgggtccggtggctcacgcctctaattccagcactttgggaggctgaggcaggtgaatcacctgtggtcgggagtttgagaccagcctgaccaacatggagaaaccccgtctctactaaaaatacaaaattagccaggcgtggtagcgcatgcctgtaatcccagctactctggaggctgaggcaggagaactgcttgaacccaggacatggcggttgcagtgagccgagatcatgctgttgcactccagcctgggcaacaagagcgaaactctgtctcaaaaaaaagaaaagaaaagaaggttgcccagttggatcagatttcaccacttctggccactcttcctctttagggcctagttccatcaggtcttagtaagaatgtggcataaatacagtattggtagaaatagtttgaagagtctttctggagccaagataacaaacagtcctcccttctgatgccaggcagggttaggcactttgggctctatgaaaactaccttgcctggtccacccagctgatctgatcattctggattgctaagcaaagctgtcagggtggcacatgcttgtgaacagcagcagcagtggccacgggacaatgagagcagtggctagttggaatttattgagcactcactctgagccagactctgtgccaagggttttatcataatgccctaaggtcatgcaaggatggcaaagataagctgctttctaaagaaagtggttaggaaaatgtgctctggagtcagacaggctgtattaagataggttcagctgcaagtgaccgaaaacatcataatagcggtgacttaaataagacggtttgatttttcttttttttattttttatttatttatttattattatactttaagttttagggtacatgtgcacattgtgcaggttagttacatacgtatacatgtgccatgctggtgtgctgcacccactaactcgtcatctagcattaggtatatctcccaatgctatccctcccccctcccccaaccccacaacagtccccagagtgtgatgttccccttcctgtgtccatgtgttctcattgttcaattcccacctatgagtgagaatatgcggtgttcggttttttgttcttgcaatagtttactgagaatgatgatttccaatttcatccatgtccctacaaaggacatgaactcatcattttttatggctgcatagtattccatggggtatatgtgccacattttcttaatccagtctatcattgttggacatttgggttggttccaagtctttgctattgtgaatagtgccgcaataaacacatgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatggtgatttttctacctgggaaacgattggttagagggttgagaactggctgggcaactggttgctcattagagtcccagcctccaataatgcagtaccactgtcctcaatagatagccttcacctcatggcacaaaatagctgcttgagttcaagccatagtgcctgcattccagccagcaggaaaggagagaacaacgcttttgcctgtatcctactggccagaatgcaattgcagtcacatctaactacagaggagggtaggaaatgtaggcttcactctgagtgtccacatgcccagctaaatttggggattctaatacttaaggaagagaaagctgggcaaagggaaacagatagctatctctgccatagagttagatgcaaagttagttgttttccttgggtgaattgggatatgtcttctggatatcatttccttatctatgaaatcaggtaaatctggtacttggagaggatgtgcgctaattgctctgtgatgcttagcgtagtaccagatgtaaacatgggccagaaggatggaaggcgttgccatcattccccaggacaggcacagcccctggttcttccatctgaggccagcctctagtactagctatggggaattgcaagccaattaatttattctacacttcatagtttaaatactctgccacatttgaattccgtaataagccagtgtgattggtgttcttgcccccactgtagcaaggctggcccaaggactcaaacccagatccctccaatgtgaaatgcggcgctctttcatttctccatacattgatgagccctcctgcaggcaaaagaataaaaggacaacaatatttgacataaaacattaagcacatgcctctttgttgcagtgatttcttagcctagatagatacttgcttcctagatgatagatagatagatagatagatagatagatagatagatagatattcctatagcctcaaaggttgagtctaggaaattttgagaaaatgctttccttttgccaatgagttcatttatttatacaaccagtatctatttactgagcaactagtatgtgccaggcactgtgctaaacactgggaatataatgatgaacaaaaccagaccatctccatgcttgtgtggagcttagcgttctatgtgggaagaagtaagataatcacatgatcataaaaatcaagggcatgcttgcctggaaattgtacactgagaccacatggagagtgtgggtcgtaaccctgcagggcttcctacgccatcaacacactaagacctttgccgcagaaaaggaagaaggagggccaggacggacattgttgccaaatataaatagtgagaaaagcattttatattccctaaggctccttgacacccactgaacatttctctgtgcacttactcagacgcctaattattcatttactccttctcactcatctaacgtgtgtagtatagcaatctggaatacagactccggtgccagttagattcaaaccggttaaaaccctggtcctgtctgcccagtaactaaccttggacaagttaggttaacttctgtgtgcctcagtcttctcatctgtaaaaatgggcgtaggatatctacttcatagggttgttgagagcattaaaatgcattacaacatataaggcacttagaacaacatagggcacagagtgagctccatgtaagtgctagctcaggatgatgggggtgaggtgatggtggtgatcatggtcatggtggtggtgctgctgctactgtcgatgctgtcgaacaagatgatggtgatggtggtggtggtgctggtgctgctgatgttgttgaagatgataagaatgatgatgaggaggaggatgaggatgatggagatgatgataattttgataaggaggatgagggtgatgaggatgatgatcgtggaggattcttgagtccccaccatgtgccaatgacaccctcggtgcgggtatgcagagaagaacagagaatctgcccccatttttccagtatagtgggagcaaagtccaaaggtgaccacagagccccatacatgtaatggagcaaagaagggcatggaactcccttcccactgaaacacaggacgggactgggctgccacgccctgctccaactcccagtgctagatccaccctgggaaagaaaaggtggcaggggaaagctgtggcttctcttgcaggaaataccatgggaaggcttctgtgccagggatgtgggaaaagggggaatggagcgaaagatggctgttggctccattctgaaagcaccacctgcagcacaatttgtacttactgcttctgccagaggtttgaaagtggccgcagcttcacggtggctcagtggcttggttccagtccaactttccggggcagctggcctggtgcaggaaaggggagcaagctggccagggccccctaaggctgcagacctcacctggatgctaatcctgagtgcctgggtagcttcttcatgtccactgccctgtgggccctatactgtgtgtgatgattgatatgagtcgatgtgtgggccttggagggccttttgtgaatccgtggctaattttttggcgaacaagtagatcaaatgcttgatatttccctttttgttattcaaaattaaaagaaatttgtacctatcaaagcagcaaggacacacattagataaatcaatctttgccattttgtcactcttaattttttgttaatttaattagaatagagatagtcaagtctaggtgtgctaaatcacagaccataaaattctgtaaatcacttcagcatgtaactgggtgtgcgtgtggttgctaattaggaggggcagagctgcggctttggagatgagttcctggcaaggaccctgggttggcaaggagtggaaagactccggggacatgtccaactacctcttgggccactgaagcctctgcctccctgtacccgtcagcgccactgcccagggatggttcagccaggcgagcgtggggatgggcccaggactcacagcctctcctttcctgtgtgagctcccaggataggacatctctgcaggaggcagtactgcaccagctggaagttggaccacccagcttcagcagaacagccctcctatgccccctgcccatcctgcttgcctgttcactatttttttttttttttgagacagagtctcgctctgtcacccaggctagagtgcagtggcgtgatctcggctcactgcaacctccgcctcccaggttcaaactattctcctgcctcagcctcctgagtagcagggactacaggcacatgccaccactcccggctaagtttttgtatttttagtagagacaaggtttcaccgtgttagccaggagcctgttcactattaacaggacacttgattttgccggtcaaaccactgcagcaatatttccagaacaaatacagctgcttagacatttgcttttggcgttttacgtttcaagttgaatctgttgatttcggccttgctgtttgaatagcgtctctgcaggtttattctgggcacttacatttccaaatgtgcaagtactgggctcgcgggccagtgtttgaagtgatgggagccagacaggccagggaagggcccttagaggccactcctcactcacagggagagccccggggggaagagtgctgcctggagagcagcaaacaccaggaaaaaatgaggctgcagaggccaggccagccccgaggcctgttggagacatctctacagcgtgctccacccagcacgatgctccctgctttccaaagtgattctggggtgcccgctccccagcactttctcccaaagctcagctctcaccacccactgctagccactctcttccacatttggcctcccagcactgggcgcctctgacggtctgattgaaatccgaggccctcactggccatttggttgtgtccagtgcggtgctgagcttcgttccacatgcaggagcctcactcactcgctccttctgggctgtgagggcctctgggcacctgggtgttgcgtgtgcctcccccatgctaagggtgctgcagaagcccaccctggctcctccaggctcctccgctcccccagagaatgaaaggcattggccccccaaaggaagtctggcttcacagggaccattgtcaggcagagacacatgcgcacagccccagcccgctggaaggccatctgttgtcagaaaggttgcgttttgagcccgtcttttcatctgggacaagtttgtactgaactggccacatttgtgctaaagacatggttcgtagtcagcttcgcaggcccaagaggcagagctcggttagcatcttgtgcagagtccccgtgatgccctgactcatcatgagcagccgccgtcacccagctgagctgtacagcgagagagagatgcagtgtccggaagacttgggccctctgggaggctgtagccactcagtcatccctgccaaggatggtgggacaatggcagtgtcaaccttgccaaggggctgggtttccagccatggctgggccctcagcctgctcggtggagcatctcatctcccaccccacggtggatgttcttggccttctctctccaactaacatctgccaaggcctcctcctacgcagcgatgcctcccttcctcctaagaaggccgtgcaccttgacgatgggcagatggggttggaggcccagccctcccttcccagcacgtgacctgctgcaagttacttgatccccaccagcctccacctcctccttggtaaaacacaagtggcaacagctcctgtttcccaaggctaagaagtcagtaggaaaatgcataaaaaatactttcccgggtcacttggctccttcctcccctcctaacacccatacaggccactgaaactgttctgagaagtccctgttgccaagtcaaggactttggttccatctcacggcagtctccgctggtgacgttcagtgctgctgcctgctcttgttgccatggtttccatgatgctacatctccggtccctcttatgttcctaactgtttggttcccaatcttctttgctggcttgccctgaaagtcagcagcccctggaaccctgcccttggcttccttctcttcctgggctctcttcctgggtctgtctctgggtggaactcacccattcccatggcttcagtctcccccctccaacgggagacttctctcccacaaatccattactccagactgggctccttcccttgtgtatgctgttgacccctctcattgaacaggcttggaccctaccctgcttcctcccatccaccaaacacctcttcaccaccatttccaccacccagtgactggcttctctctcccaccgacatggcaccaccacacagccaccccaaccaggagacctcacaatcctagtttctgctcgcccttcacttcccaaatccaatcccttattaagaaattcccattctcttctcccatctgttttccatttctgtccaggccaggccgtggggtctctgagcttcacggctgcagctgcccctgccagcaagcagggtcccagctgccctagaccccagccactgtcctgccagggtcccagcctgaggctcacccagcccaggtgcctcctggggcctctcgtgcttctctgcttttcttaaagctggaggcaggttagcgtcaactaacacacacagagaaaaagctgcaaaacaggttttaaaatgtgcacggtgtaaaaatgatagtgggagtttggacacagatgggtaggaggttatgacagggaaagaattttgcttaatcttggaatgaaaaatactctgatcctggcagagtccagtcagaaggaatttccagcaagatctgtcttcttgccacattgtctgcaacacaattgatctttgctttgattgctttcccctccctccccctcacttggcttttcgcagataatgtacagaaagcccctttttgttgttggagcggtttactgggggaggccttcagaatcaacatccagctctcccagtgtgacctcccccttcccctgccaagtcagagatgggctttctttgtctgtgacttgagatcttggagggccttgggttccaatctgagccctgtcactagccttgggtggatgatcactctaaggaccaatttcctttttcatctggaaaatggggatagtagtccctttctccgggggtcgttgtgagaattaagtgaaatgacacagggctttaatggatggtgctgcacctgttgtcatggccactgtggatgtgagcggcagagctgcaaacacgccttgctcctctgaggtcagcccatgccggctgccctttgggtgccagccaggccgttgtgctgcagggaagggaggagaggagcctctcttctgggtgagccagacaaaaaggaacctctcgtggcgtttgtcccagcatcctctgaccgtgagccttccgatgtgcctgcctggtatgaacagaaacgtggatccaacccacactccttcctgatttcaaacgtccctgtgaatcggatgggacgtagttaatagcccctgtcttcctggaaggaaatgttcagggaggactggtgttgggaagctagaggggaggcggcccggccttggagcccagccctgttggtgttgctctctttggccctggtgaacgtcctggccttggtctcctgagtccagggggcctggccagcagcctgccttcctgaggcccaagcccctggttctgactgctgatgcgcctcctgggagcgttcctgcccatctccacttggagttaccaggaactgagttgttggttctgctggcagctcccatcctgtcccatggggggttcagacacggagaccagtgctggaaggccctgaggcctctgagccctccagccagagccagggtgtgcccagtgcatgcactgctgtgtctgcctgggctggtctccccaccagaccgagcttcctgccggactggggcagggccctaacgctctgttgttacactctccatccccgtgccattcagagcctcccagcactgagtaggcactgcacggcgagagggagggggaggaggaagggagtctggctctgtgcctgtccccggctgcctggctctgactgtcagagtcactctgcagcagcacagagcgagtccgctgggtgctgtgagacgaccctggagagatcctcccacccccagctgtctcttctctagcctgttgcccccagctccatccctcctaaccctaccccttggccagctctctgggctctgggctcggcaggagcctctttcccccatgggctcagtcagtgctccccctgcagccctgctgggtctccctggagctcaccatccggactcgggctgtgtgggcactggagttcttgatgtcacacacgtcagcgtgttcccttagcactgtgtgaacacgaccctgtcccctggccggcctgggagatggcaaaaaagaatggagtggctccctggcaggaagtgcaggaaggcaggggcacagccccattgcagcacccctgccagcacaggccagcttctccactgatttgcccttgactgttcccttagaaacagacatgagtggccacaggccgaacgaggctccgtggagagaagtgggggcaggtggtgggtgggtaatttatcttacttactgtagggtgtgggggtagaaagccagggctgaaaatcttgcttctctaggaggtgactaaaggccttcacagtggtctggacaggaaagggtggagtccaagcacagggtccccagaggagtgtggtgaggccgagggaggagggacccaggcaagggaatcttggaggagaaggcaggacagttagcccagactagggtggccggggcaggctctgtgaggctgctgttgggggtcccgtggctgcagagaggtttgctttccaagtcagggccactagtttccctcggatgctatttgtgtcccccgccttccattgtgatgctgcacaataacttttacagcctggcctggtgcctggcctgcagccctgaatcactgattcatctttacctgccgcttccctgccggacggctctgggtgcaggagccaagagcccgggcgacggcgcagggctggttccttcccacttctgcccagtcacttccccaccctctgaggaccctggagaaattcagccagggcctgggcctctaggagctgccaagcctccctctcttaagcaaagcgagcttagggttcacagggccagagcaagagggtgacacaacccgcccagggtgcctgccttctctaagcatctgacacagctcagggacctgctgtcctcaggctcattccaggtgggtgccttggccctgggcctcagaccagcctcccctcagagctctatctggacccttgtgatggatgccattacttgtctgacatgtccccaaaggagcccgcagatcccactgccaacgccagtaccagtgcacggcccaggattggccctgctgcttactactcctgagcccctgcaagtgagttctgctctctgggcctcagtttcctcctgtctacaacagggtcgctagtagtgcctgtggcagtagggttgctgttcagacacccaggctgtgaaaagttcctggaagggaccccaccctacagaaagcactcagtaccaaagaaagcctcatgggtgtaaatgaatctgctccactctgcaaagaaaaagagcacctctcccccacatgcattcctacggggcttgcagccctggtgccctcactggctgccattgagagcctgtgctctgcaccgcccgccaggtgtgccagggtgacgtgactccacaccaagcactgggggctggacttgtttagccatttctctcaagatggccatttctacactttcatgagaaggaggcctcgcctccgttggagtggctgagtggtgcatccagctggttcctgggactggggacaggttttagtgctccgagaatctgggttgttgtttttttttttatggagttttgctcttgttgcccgggctggagtgcagtgacgcgatctcggctcaccgcaacccccacctcccaggttcaagtgattctcctgcctcagcctcccgagtagccgggattacaggcatgtgccaccatgctgggctaattttgtatttttagtagagatggggtttctccatgttggtcaggctggtctccaactcctgacctcaggtgatctgcccacctcggcctcccaaagtgctgggattacaggcatgagctaccacacccggctgtatctggatgttttatgcatccctttacacagtgtgtgtgtgtgtgtgtgtgtgtgtgtgtacatcttcagctgatccttcaaagtctgtgggttttattgtcatcccctttttatagattaggaagctgctgctcagacggattaaatcatttggcccaggtcatatggctaaggggcgcttggtgtcccgcacttctggagatacaattaacatatggtaaaaattccgactttctgtggccattctgagagctttggcaaatgtatgtggtttccatcagcttggtccagtgatcaccaccacaatcaatatggagatggtttctatcagctcaaaaactcactgcacctctttgtcagataagctgctcggcgtactccagcctctgggaatgaatggcctgttttcagtccctatagcattgccttttccagaatgtcatataaatgaaatcatacaggatgtggccttttgagtctggcttctttcgccagacataatgatcctgagatttatccatgtagttgcatgtatcagtacttccttcctttttatgggtgagtggtgttccatggtgtggatatacagcaatttgtttaaccattcacctattgaaggatgtctgggctgtttccagttgacattacatgccaaggactctacacatttgcatacaggttttggtgtcatcatacatttttatttctcttgggaaaatatatagaggtaagattgccaggtcgtatagtaaatctgtttaacttaatgagaaactacccaactgtgttccaaagagactactactttgcattcccatcaggaatatataagagttttagttggctgggcactgtggctcatgcctgtaattccaacactttgggaggccaaggtgagaggattgcttgaggccaggagtttgagaccctccaaacctcaacatggtgagacccccatcttttttttttttttttgagtcagttttgctcttgttacccaggctggaacgcaatggtgcaatctcagctcaccgcaacctccacctcccaggttcaagtgattctcctgcctcagcctcaggagtagctgggattacaggcatgtgccaccacacccagctgattttgtatttttagtagagtccgggtttctccatgttggtcaggctggtcccgaactcccaacctcaggtgatccacctgccttggcctcccaaagtgctgggattacaggcatgagccacggcacccggccaagacccccatctttacaatttttttttaattagctggaggtgggcgcaatagctcatgctgtaatcctagcattttgggaggccaaggtgggtggattgcctgagctcaggagttcgagaccagcctgggcaacatggcaaaacccgtctctactaaaaatataaaaaattagccgggtgtggtggcaggcacctgtagtcccagctacttgggaggctgaggcatgagaattgcttgaacccggaaggcagagattgcagtgagccgagatcacgccactgagctccagcctggacgacagagactctgtctcgatcaatcaatcaatcaatcaatcaatctataagctgagtgtggtggttagtgcacacctgtagtcccagctacttgggaagctgaggcgagaggatcatttgaggtcaggagttcgaggctgcagtgagctatgatcgcgccactgcgttccagcctggatgacagagtgatactatatctcttaaaaaaaaaaaaaaagttttagttgctccacatccttgccagcatttagtattgttgtttttaaagctattctaataggtacatagtatttcatcaagattttggtttccatttccctaatgactgatgttttttcatgtacttgcttatatgccatctgtatgtttactttagtggggtgtccaaatttctgtggtctgtttttcatttttgttttgttttgtttttgaggcagggtcctactctgttacccaggctggagtgcagtggtgtgaccaccagctcactgcagccttgacctcctgggctcaagcaatcctctagtctcagcctttcgagtagctgagaccacaggcatgcaccaccacacccagctaattttttatttattttttcttttttttgtagagatagggtctccctatgttgcccaggctggtctccaactcctgggctaaagtgatcctcctgtcccagccttgtttgttttttcttttctttttttggctttcacatttaattgacacaggataattgtacatgtttatgggatacagtgcaatgttttgacacatgtatacattgtgtaatgatcaaatcacagtatttagcatatttagcacctcacacatataccatttctttgaggtgaaaacatttaaaatcctctcttttagctatttcgaaatatagaatacaatattgttaaccatagtctccctagtatgctatcaaacactagaaattattccttttatctaactgtatttttatactcattaaccaacccctcttcatcctccctctccaggttctggtaaccactattctactctctacgtctatgagatcaacttcttaagattccacatatggatgagatcatgcagtgtttgtctttctgtgccaggcttatttcacttaacaaaatgtcctctaggtaggttcatccatgttgctacaaatggcaggatttcattcttttttatgactgaagagtattccattgtgtatatgtaccacattttctttatacattcatctgctgatgaacacttaggttgattctatgtcttggctattgtgaatagtgctgcaataaacatgggagtgcagatataatgatttcgtttgctttggatgtatatattcagtagtaggattgctgaatcatatggtagttctatttttaattttttgaggaacttccaaaatgttttccataatggctgtactaatttacattcctaccaaaagtgtatgagattccccctttctccacatttatgccagcttttgttattttttgcctctttgattagccattctaattggggtaaggtgatatctcattgtggttttgacttgcatttccctgatgattagtgatgttgagcatttttaaaatgtacttgttgaccatttgtatgctgtcttttgagaaatgtctattcaggttttttgcccactttttaatcagattatttgttttcttgctactgagttatttgagttccttatacattctggatattaagcccttgtcagatacacagtttgcaaatattttctcctattctgcagcttgtcttttcactctgtttattgtttcctttgctgtgcagaagctttttaaatttgatgtaatcccatttgtctattgttccttttgttgcctatgcttttgaggtattatttttaaaaaatccttacccagaccaatatcatgaagcatttcccctatattttcttgtagttgtgtgtgtgtgtgtgtgtgtgtgtgtgtgtctgtgtgtgtgtctgtgtgtgtggtgtttctttttttttcttttttttttgttttctgagatggagtttcgctcttcttgaccaggctgcaatgcagtggtgcaatctcagctcactgcaacctctgcctcctgggttcaagctattcttctgcctcagcgtcccaagtagccaggactacaggtgtccgccaccacgcctggttaacttttgtgtttttggtagagaaggggtttcaccatgttgtccaggctggtctcaaactcctgacctcgggtgatccacccgcctcagcctcccaaagtgctgggattacaggcgtgagccaccgcacctggcctcttctagtagttttattgtttcagttcttacatataagaatatttaatccattttgtttttttgtatggtgagagataggctctaatttcattgttatgcatgtagatgtccagttttcccagcaaaacttactgaaaagactgccctttccccagtgtgtattattgttgcctttgttgaaaattggttccctgtaagtacacagatttatttctgtgttctctattctgttccattcgtctatatgtctgtgtttatggtggtgccatgctgttttgattattatagctttgttgtatattttgaaggtaggtaatgtgatggaccctctggctttattcattttactcaaaattgatttcactattcagagtcttttatggttccatatgaatttcctgattgttttatctgtttctatgaacaatgttattggtattttgatacaggttgcatcaaacctatagattgatttgggtaatgtgaacattttaacaatatcaattcttccaatccatgaatatgggatatcttttcatttatttgtgtcctcttccatttcttatatcaatttttttatagttttcattgtagaactctgtgacctctttgcttaaatttattactaggtaccttagttttttggtagctatggtaaatggggttgtttcttgatttctttttcagataattcactattggcatataaaaaaacctcctgatttttatttcctacaactttactgaattcatttattagttctaatgggtcttttttggtggagtctttagggttttctttatataagatcatgtcatctgcaaacagggatgttatggtttggatatttgacccctccaaagctcatattgaaatttgatatccactgttggagatgggacctaatgggaggtgtttgggtcatgcaggcagatccctcatgaatgacttggtgtcatcctcgcagtaatgagggaattcgtgttctattagttcccacgatagcttgttcaaaagagcctggcacattccctcacacctctctcttgcctcctctctcatcaagtgatctctgcacacactggctctctttcctcttccaccatgagtggaaaaagcttgaggccctcactagatgcagatgctgacactaagctttttgtacagcctgtagagccatgagctaaataaatctcttttctttacaagttacctagcctcaggtattcctttatagcaatacaaatagactaagacaggaacaatgtgagtttgtattttccaacttggttgccctttatttctttctcttgcctaattgcactagctaaaacttccagtactgttttgaataaaagtggtaaaagagggcatcattgtcttattccagatcttagaagaaaagcatttaattttttccagttcaatatgatgttagctgtgtgtttgtcatatatgacctttattgtgttgaggtacatttcctgtatatctgatttttaaagagttgtatgatgaagggatgtcaaattttatcaaatgctttttctgtgtctactgaagtgattatatagtttttgtccttgattatgttaatgtgatgtatcatgcttattgacttgcatatgttgaaccatccttgcatccctgggatgagtaccacttgatcatggttaatgatctctttaatgtactgttgaattcagtttgctagtattttgttgaggacttttgcatctgttttcatcatgtagattggcctgcagttttcttttctgtgtgagtgtgttcttttctggttttggtatcagggtaatgccagcctcacagaatgagtttggaagaattccctcttaattttttggaatcgtttggaaaacattggtaatagttatttaaatatttggtagaactcagcaatgaagtcatcaggtcctggacttttctttgataggagattttattattaatttaactcattactcattattcatttgttccaattttctatttcttcataattcaattttattaggttgtatgtgttcagaaatttttccatttcctctaagttttccaatttgttgccatatagttgttcataatagtctcttatgatcctttgtatttctgtggtatcacctataatgttgccttttcatctctgattttttttaaatttgagttttctctctttgttccttaggtagtctagagaacagtttgttgatttttttgtatcaatatatcaacaaaacaaagaaaaccaacctttattttgttgatatattgtattgggttttggtctctattttgtttattcctgctctcatctctattttttattgctatctactaattctgggtttagcttgttcttgtttttctagttccctgaagtgcaatgttaaatttttttatttgagatctttctacttttttgatataggcatttattgctataaacttctctcttagaacttgtattccataggttgtggtatgttatgtttccatttttaatttgtcccaagaattttgtcattgatccattggtaattcatgggcgtgttgtttaattttcatgtattcatatggcttccaaagtttctcctgttattgatttttagttttattccattatgatcagaaaagatacatgatattatttttatttaaaaaaactttttgagacttgttttgtgacctaagtaacatatggcctatcttggagaaagtgccatgtgctgtagagaagaatgtatattctgcagctgctggataaaatgttctgtaaatgttttttaggtccatttgatctagagtttagtttaaatataatgtttctatgttgattttcagtctggatgatctgttcattgctgaatgtggggctggatattggagtctcctactattattgtattgcaatctatctcttccttcagaagttagatataataatattgctctctctctctctctctctctctctctctctctctctctatatatatatatatatatatatatatatatatatatatatatatttgcttaatatatctgggtgccccaatgttgggtgcatgtgtatttataaacattatatcctgtgatgaattgaccactttattattatatagcgagtgtctttttctctttttacagcttttgatttaaagtctgttttatctgatataagtatggctactcctgcactcttttattttccatttgcatggaatatcattttccatctgcatggaatatcattttccatccctttactttcagtttattagtgtccttacaggtgaactgaatctcttgtaggcagcacatagtcaagttgtgttttcttatccattcagccactctgtatcttttacctgggaaacttaatccatttacattgaatttattccataagttggtggaataaatctatcaatttattattgataggtaaggacttactcctgccatttttaagtgttttttggctcttttgtacatcctgtgttcctttctttctctcttattgtttacctttgaggtttggtgattttctataatagtaagctttgattcctttctctttttcatttgtgtatctgctatagttttttcctttgtagttactacggggtttacattaacaatcttagagttatagtatactattttaagttgataataacttatctttggctacatttaaatattccagacttttaccctaaccactcccccatttttaattttgttgcttaatttatatctttttatattttgtgttccttagcaacttattttagcatagttattgttgatcattttgacttttaaccttctgctgtagtttggatatgtttgtccctcaaacctcatgctgaaatttgatccccaatgttggaagtaggacctaatgggaggtgtttgtatcatgggggtggatccttcatgaaaggtttggttctgttctcatggtaatgaatgcgttcttgctctgttagtttctgtgagagttcccccaagagctcattgtttaaaatagcctggcacctttgctctctctcttgcatttatttatcaccaagtgatctttgcacattcctgcttccattttccttcctgccatgagtggaagcagcctgtagccctcaccagaagcagatggtgatgccatgcttctaatacagcctgtagaaccatgagctaaataaacctcttttctttataagctacccagcctcaggtattcctttatagcaacacaaaaatggactaaggcaccttcatactagaggtttgaaaaagtatgtatcatcattacagtaatatagtattctgaatttgataacaaatttatctgcacccgtgagattatgctttcatatgtttcacaatagtaattattgttcctttacttctggttgaagtactcccttaagtatttcttgtgaggttggtctagtggtgatgaataccctcagctttgcttgtctgggacagactatttctccttcatttctgaaagatagttttgttgggcataatattctaggctggcaggttttttttcttccagcactttgaatatattatcccattctctcctggtctgcaaggtttgtgctgagaaatctgctgatagtttaatggggattttcttataatgacttcatgcttttatcttgcaccttttaaaattctctctgtctctgacttttgacagtttaattataatgttccttggagaggacctctttgggttgaacctgtttgaggtcttttgagcttcatggatctagatgtccatatctctatcaagacttggacaattttcaactattattttgttaaataagatttctgtgccttttaccaactgttagtcctctgaaaacctcataatgaagatatttgtcagcttaattgtgtcccacaagtcctataagctttgtttactctttttgattctgttttctcttttgtactgtgggttatttcaaaagacatgtctttaagtttagaaattcttatttctacttgatctagtctgctgctgatgttctcaattacatttttaattttattcattgaattcttcagctgtaagactttgtttggttctttttttatatacatctatctctttgttgaatttctcattcagatcatgatttgttttcctgatttcattgaattctttacccatgttctcttttacctcactgagttcccttaagataattatattgagctttttccaggcaatttgtaaatttctatttctttggggtcagttagtggagaggtattgtttctctgatggtgtcatatttctttgttgtttttttttcatgtttgttgtgttcctgcatagatagctgtacatctggtggaatggtcacctctcccaattttatagggtggctttcatagggaaagactttcatcttcagatatgtcctagagtatacgttgggtagggtgcattggctttggttccaggtaggcacagtagtaatctctatgaagtttcttttgctgtatcaatatcagtgatgcctgtgagtacctcagtggcctaggctgctagagtttgtgtggctgatccaccccacttgggtgctgctcctgtggaagtggggcaccagactagtttgcatgctgagggagtatttcaagagttctttatatattctagatacaagtcatttatcattatgtgatttgcaaatattgtctttgagtctatagcttatcatcttattctcattttattcccttaatgttgtgtctttcaaagaataggtgttcttaattttgatgaagtaaaatggatcaatttgttcatttatgaattgtgtttttggtgtcatatctaagcaatctttgcctcattcaagatcacaaacattttctatcctttttctagttttataattttatattatgtctatgatctgctttgcattaacatttgtatacggtgcaaggtatagattaagaagtgtttttctttttaatgtatgggtatacaaattttcagtaccatttattgaaatgactgtcctttttccattgaattgcctttgcacttttgttgaaaatcaattggtcatatatgtgtgattctgtttctagactagttcattgataactacccctttgccaattctatactaccttgattactgtattattatggtaagtcttgaaatcacgtagaatgtcttccaacttcattctttttcaaaaattgctttggaaattctgcttcctttgcattttcatataaaatttagaattagtttgttcacttctaaaaaaaaaaatccttctgggaatttaatcggaactgcattgaatctatagatcagtttggggagaattaacgtaactattgggtcttcacatcaacatggtatgtttctccatttatttaggtctcctttgatttctttcattagtgctctctagttttcagcatccagatcttaaacatatttagtttgattcattattaacttttttgttgctatcataaatgatactgttttttcctcatttccaattttacattgctgttatataaaaatgcagtttatttttggttgttgtatattgacctgagcttaggtctttatggctccacatccagctctatgcttcccactccccaccctctaggctgtttccttagcagcaggagcagccctgggaactaggttactatgttatgatccccatgcctgactctgagtcaccttaaaggagtgagtcaccagcctctcttgcagtagttttcctctccctaaagcaaggattaaaccacttgctctcttattgctcccaggaatgttaaagatgagtgactaaggcagcaagggtgtcagcactctgacatgaatagtttgacgtaattgagacctggtagttttgtgggttttttcctaatccaggtgttattgtcaattacatgttgggaaaaagagataaaggtgggatgagtcaggagacagctgctcacactctgtaggtctccagcggctttcctccaccctctcacacagcctcagaagacccctggtcctcccttgttttgcctactctcccaacccaaaagtacctctttctcccctcacctttctattttaaccatctgagagatccagcttgagccttccctcctcaccttcttctgctgcatgacattacccagcacctgtcaatctccctgaggccatgataggcagcactgtcccccagcttggggttagatatctgtcccatcgcccaaaaatatgaacgtgaggagggcatcttttctgtggcctgtcatagggcccattatatgctgcagtcgtgatgggggcttaacaaataagtaagtaaagccacgctatgctcagggtctgcagcttttccttcccctcctttctttgtggtttgcagttgtcttgggagggccttctgtctgggtttgacagtgaacatgagtaaagtgagcaggggctttggcaagaagagtggtgagcagaagctggtggagacttgggggctgcacaggacctaacttttgaaactgaaagcaaagtcaagtctaaaatacatcacattaaccctcttttggtctgtctgtctctttctcagacagtgtccctgctgagagtaagaagtgttctcaaagccttttccacagcaggaatggggcacgcgggactcgcatccattcattcacaaaatggtacctggtacagagtaagggattagagaatattgtttgaataaatgaacaaatgattctgccttatgtgccaggcactgtgctagctctttgggacactaagatgaatagaaaatgatattaatcacccaggcgcggtggctcacgcctataatcccagcaccttgggaggcctaggtggggggatcagctgaggtcaggagttcgagaccagcctgcccaacatggcaaaaccccgtctctactaaaaatacaaaaaattagccaggcgtgatgacgggtgcctgtaatcccagctactcgagaggctgagacaggagaatcgcttgaacccaggaggcggaggttgaaccaggatcgtaccactgcactccagcctgggcaacaagaatgaaactccatctcaaaaaaaagaaagaaaatgatattaatccccaagcagctcatggcctagtgagggaggcagatacaaacatataaataacactctgtggggaatcccagtgagagagatctctttaagtgtatgtagcgagatcagagagcggaaagtacctcctggaagatgtaacactaggctttcaagaatgagtaggagctggtcaggtgttagtgaaggggtgaaggggaagaggcacagggacaacctgagtgtggggatggggagcagcatggtgctttggtggtgctaccggcaaaggtgagtagtctgtggtgttccctctgaagccgaggaccaccaccagccctatggctgcagggtcagcactgcacctgggaccatctagaacctggttgatctggcatgggaagaagttgttgagtgataacaggtgctggcttctgtgctgaggcttccagaggtcctcagtgaatcctcaccgcaaccccccaagggacgtaccaggactagtcattttacaagtgaggaaatgggtgcagggaggcaaaggagcttccccaaggtctctggcttctcagtggcagagtccgggcccctgacccctgcgggatcctacctgcctagagtgctcctggagagcagcggggagggatgctgtttactgaacaccttttgtggcttggtgctgggctgggcagcagatatctgtgatctcattttattctcacaaatatatgggtgggtggttttatctgcattttacaagggaggacactgccccatccgatgtcacagtttttgactcagagatccccactcccgacaccacccacactcttgtccctccatggcccattggccaacgagctcgccacgctctggacccgtttctgaacctctttctggggttggcgccaactcccggaagatgcctttgtacttgctttttctactcagacctcactctggccactgagcctctccaaaagcctcctccaacacccaacaccctattccgtacaattctatatgcatttgaaatgggcttctgatgtcctctggtgttggtcacccccaagtgtccacgagaaggtgagcccctttgggcagagaccaccttttgtgcgggcttcccgaggagagtggcctgttgccacgcacagagctgatgggaaatgtgagctctggagttgtggggtgacactgtctatgttgtatcgttgctggagaatttgctggcccaggagttttggggaccctctcctcagcttgagctgcaggcccacgtccgtcccctcaccctggctccccaggagtcctgctgagggcttcctataggaagccaagctctgagacatggagccaccctcaccagagccgcctacgggaaaggaagagccagcctcctttcctttggggcagctggaagacaatgtacaacacattttgagaaagtctctgcagaacaagaaaattgacaaatactttcaggtctgtagtcaaaggaatctggagtatgctgcctccttagttcatgactagcagaaaataaaagggtctttttttgtttgttttttggggtttgtttgtttgttttttctgttttttgttttttttagtataacaatgacttatacagttgaggtgaagtgaaaatatcattacaatagaggtgacattaacttgctaccgattgtgcctggtactcattgcaggtaagaggtgagccatgctgttggaggctggtctctgtgggctaagaggtccccgggccttccctcctccctcacttcctgcaggcaagtaggatgcgtcctccatggagtctctgcattttctaactcaataatggagtcagatatcccggtagaggaccaggcttgggggccacaagatgggcctaaaagcgcatcttgaaggcctagtgtcacctcctccaggacttccttggtacttctctctctctgatttcactatatacacttagaaaaaaagcttttcttttctttttttttggtttgtttgctgttgttgttattttgagatagggtctcactctgtcacccaggctggagtgcagtagcacgatcatggctcccttcagccttaacttctcaggctcaagcaatcctcccacttcagcctccagaatagttgatactacaggcatgtgccaccatgcctggctaatttttgtatttttttttagagacaggggatcaccatgttgcccaggctgatcttgaactcctaggctcaagtcatctgcccaccttggcctcccacagtgctgggattacaggtgtaagtcaccatacccggcctgcaacaagctttgatcttgaacatgtgagttatttttaccaggcctcagtttcctgatctgtaaatgggtataacaccacaccgggtggatgtgaggcttccacacactgataggtcaacagcagtgcagtgccctggaggaggaccaagcatgcctcagtgttgaaagagtaactaactaggtgctggctgaggacagcacctccccagctgttgggggacagaagggggcaccgttctcgaagcagctgccctgctgttggggatttgggggattttgctgttgtgagggtgagccctaccgtctgcaccccctgctcgggccccggcactgcagtgggagactcacagaacactctggacagaggttaaatggtgaggaacaggggtccccacaatggcagagctggagcttctgcagcagcatgggctcctggtgcctgtcacttcctgtgataagtaaatcttgtccagtctccagattgctttggctccagaggatgagaagggctatgccaagtgggcaatgtcctgggcatggcagagagggggccatgatatggaccaagaagcatgaaccagcttttacagtatccagcaccaggggtgccccaaaccctagactctgacaaggaaggacgaggctgtttcagagcacagttggcaccacagctaaccagtagtaagtgttcctgaaaggtaggacatgaggccagaagccactatgcagggcagtcctccacgtcttagatgaacaatcgggatagggaagggcctgaaaattctttttatactggacactcggagagtgtctttggtttgacaacaatatccatggctttgccttttctcaccatcttcaattgctcacatgtccatgcaggtgtacacacacatgcacaggcacacacatgcacacaagcacacacggatgtacacacacacacatgcatgcagacacacacgagcacacacacgcacacacatgcacacagagagatgcatacatgtatacacaagcagggcttacgtgtaaaggggactacttcctaaggcccctgggcctgggcggcggctctacccagaagcatttgtgtcctgtcactccccaggtggcccactgctgcccccacagcccccctcccgacaatgggtagagttactcaggcttttcaaaaaacctcacctgagtttctgccagttttctttctgagtgatatttgcataaaccactcctaagacacgcacatccaactgtgagaggggacattctgaggcctcatcagtttcatgtctcagcccccaaccacctgtctcctgggctttggtagagcttggaactaagtgcccgcagcccggcggcacatgcaaccttgcacttagtgcgagagacatcaggcggctgctgaacactgctcgattcattgaaggcaggcggccaagcaggcccttctgagcaggttctggtgccatcgccgctcggccccatgcataggttagtgataatatgctccttcctacccagcctccctgaagcacctgtcgactggcaaggttactaaaagaactgacttggggggctcatggctgctggggtagtaactgcaggggaagatacagaggctattaaagccagggcctttggtgcagcccaggctcggggagggcacaggctgtcttgggggaccacagacaggcacctgcatgcagtgtgtgactggagggtctgggaagggccctgctctgtggggcccctcactcctcactctgaagtctgaagtctcagggctgaggaagaggccacccatggtgagttgggaggagctgagctgccctagagagtggagccaccttgagggagttggttccctgtgttggcctcacctccccacccccaaatgcaaaggacatgggtgggtgttggggggtgactgcaaaggtggtctctaggcccctctggctttaagaatgaaagccctttgatttgcactgagacagcgcgtctccgtccaacgcactggggatgcccgtgccagcctgcaggtctctgccaggcatgttcacgaggtgctgcttggttttagaagggagcctgatgcccaggccaaggtccaggcatggatgtaggtgaccaaggccatcgcagggcattgggggcctggggacagtcccccaggaagggagggagccagggccatcttgcattctatcccatttttaccttggcctaccctgcattcaacgaaggttctcccaagcccactggagaggacttgtttgcttcttagaggagccagaagttctcaacaaacaccaatgcaagcagagagctggccaaagaccctgagtgggagaaaggttggaagcaggcctggcaccggccacgaggcctggtcgtgggtgctctctgtcccgcctgctccgtccaggaggcatctcagggacagagctcatggtggtcctctggcccatgtcaggtgtcatctgaacgaagtggttgcaagtggctcagggggaaatcggagaccagggcccccggcaagcctggcgatggcggggcagacagagactcctgagaatagggaccaagcatgtctgcgttagctttgcatctttgtgctcagcaaggacttggcacagaacagctgctccgcgtgtctgtggagtaagaggtggagcccctgagccttctgcgagcagcggggctggtggggtcccagtcattaggagcagcccctcccctcctccccatgcctcgcctcgctcctgccaggtgtgctgtcttggccaggcctctgctgacctcagctgtctctatgtcctgagccgcttggccacttgtgggagcctcagaggagatgtagggacagggtagggaggaggaagccaccctgggcagcacctctgccctggctggagtctccctgctgagccacagcttcacaggctgctctcgattttggtgatggtgccaggtgggcatgcatggctatcagcttctgggcactgccatctacagtaagccctgggcgccaggcggcctgggtcctcagcctccatagcacgccttgctgggcaagcatcagagccgagaggacaatggtgatcatctagttcatctctctgaattggcaggtggggaaactgaggccccaagtctggcactcattggcagcagggcccacggttccccctcccactcacacaccttcctttgccaccccttggtgcctgtctgctcagcgccagccaggtgttccaacctccctgcccatatgaaagcaacagaggccagaggctgctccagaacactcctcctgtcccagcctcccctggccctcagcagacaacacctaggcgctcctttaagtacctgcctgtggccctctctccaaggtcgtgaccacggcagcctgagagaaggagctacacatggagcccaagggctctgacctcccagcagtgagctgctgagaggctgagaagaaaactgggtccacctactcagggcatgcaggctggacttccgtcatctactagacaatcccagatggagagacagagcggaccaagagggggatggtgggaaagagcacgacctgattgtccgaatacttcttcttggagggaggagagcccactgtcagcccaagatgtccggagacccctggcctccatcagagctggcccttctgtcctgcaggggaggccttccatcctgcccctctggccaccagccactaagcttaccagtcccttagccctacaggctggtcgagagcctggccagtgggaaatgagacccacgccccgcccttgagggcagagtccagcatgaggactcacctgacacttgcaggctcccaagggcttcctgggccatggctggcatttcgtgactatcacctgtcccaggtttgacttcccacttgactgtgctgagccctcccagctgcccacggggtaggagggattgccgtctccacagggaggaacaagggctcagagaagctaattctgcccaaggccaccagctcacacaggacaagagactaggaccccctcatttagctttcaaatgcaaaataaattaatttttttgttctcagagggaaacccccaactcctcacctcatttttctctcctgggcacctcagcaaggtgacacccaagttcttttggaatcggacaaatcattgcagggtctttcaagctcaagggaccctgttgatgggtgggctgaggcctggacctggccaagaacaggaggtcaggagagttactgagcaggaaggagccgggtaccctcagctgttgctttctgccactgcctcaagacagacagcttcgaagggaatgggggccagtaggtttgtgtttcaaagagcaaaggatgtggctggaggcttttctccagttgctctcccctccttgaaggaaagcagtaaggatttgttacagttgattttaaagtgagctgtaaatgcgtaaacttaggttaaggcagaattggaaaaggactagattgggcatttttcactggagtacagcctggacctgggaaatagagacagaatggggaagaaagaaccaaagacgtgggcatgagcccccaaaaactggtggacatggggcccagggcctgcggcagagctgccccctgagctgctgggtgagggtcccacccctcaccgtcacctggctcgagcctctgaatggccagggcccctcccgcctgtcgtcaggagcccacgtgggtgcagagtgacacgtggagcccatctgatggcttttgcgtttgaacaggccagaccacaattcctgattcagcaacatcttcaaagatttgataaccatagaaacaataactctttgcaaaaaaggaaaaggagacaccatcacccaaagagggagaggaggccctggtgaatatttatgaccagaggctacagaattcagaatgtacttatctcagctcaggttgaagaactcgtgacctgagagtccttgagtgtggaccacttgatgacgtccccacagcccatgtagcggggctggaaatacggagccctgaagcttgcaggcgctttaatgccttcaaaatgcagatgctgtggaaaagcagggcgttctgggcccacacggggcgctctgctgggagatacttgctagttgtgtcactaaaggggttgtgggttcccaacgtgcatggagggtgggcgtctgtgtgtgtgtgtgtgtgtgtgtgtgtatgtctgtgtgtatgtgtgtatatgtgtgtatgtctgtgtgtgtatgtgtgtgtatatgtgtttgtgtatgtgtgtgtatgtctgtgtgtgtgtgtgcacccacatccatgcacgttttagtgtcttttttggagaagcaaatagactccataatatattcgattctcaccacggtcatcctggttttctaagctattatcttgctctgttcctctggataaggagccagctgcttcagaacaggtcctcacactctttccatcactgtggtttggaggggccgcgtcggaccctgggatggcaagttcagtcatttcgaagcctccctggggcatgagcaggggtccccctctttggcgcaatgacagttctagtccccgactgacgcaggatgtttcagcgtcctataagagaccatcctggccaacatggtgaaaccccatgtctactgaaaacacaaaagattagccgggcgtggtgacacggccctgtaatcccagctactcaggaggctgaggcaggagaatcgatagaacctgggaggcggaggttgcagtgagccgagattgcaccactgcactccagcctggtgagactctgcctcaaaaaaaaaaaaaaaaaaaaaaaaaaaggaattagtatcaagttaaataactttctttttttttaagccatgattcagaagaccgaggacacccttgctggcagctgatctttgaagaagtaccagctcagagagagactcttggcccatgtcaggactcaacaaatgtggctgaatgaacgaatgaatgattgtgatgggataaagccagcttttcctttttttattttattttattattattatactttaagttttagggtacatgtgcacaatgtgcaggtttgttacatatgtatacatgggccatgttggtgtactgcaaccattaactcgtcatttagcattaggtatatctcctaatgctatccctcccccctccccccaccccacaacagtcctcggagtgtgatgttccccttcctgtgtccatgtgttctcattgttcaattcccacctatgagtgagaacatgcggtgtttggttttttgtccttgccatagtttgctgagaatgatgatttccagtttcatccatgtccctgcaaaggacatgaactcatcattttttatggctgcatagtattccatggggtatatgtgccacattttcttactccagtctatcgttgttggacatttgggttggttccaagtctttgctatcgtgaatagtgctgcaataaacatacgtgtgcgtgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctggtggccagtgatggtgagcattgtttcatgtgttttttggctgcataaatatcttcttttgagaagtgtctgttcatatccttcgcccactttttgatggggttgtttttttcttgtaaatttgtttgagttcattgtagattctggttattagccctttgtcagatgagtaggttgcgaaaattttctcccattttgtaggttgcctgttcactctgatggtagtttcttttgctgtgcagaaactctttagtttaatgagatcccatttgtcaattttggcttttgttgccattgcttttggtgttttagacatgaagtccttgcccatgcctatgtcctgaatggtattgcctaggttttcttctagggtttttatgcttttaggtctaacatgtaagtctttaatccatcttgaattaatttttgtttaaggtgtaaggaagggatccagtttcagctttctacatatggctagccagttttcccagcaccatttattaaatagggaatcctttccccattgcttgtttttctcaggtttgtcaaagatcagatagttgtagacatgcagcattatttctgagggctctgttctgttccattgatctatatctctgttttggtaccagtaccatgctgttttggttactgtagccttgtagtatagtttgaagtcaggtagtgtgatgcctccgcctttgttcttttggcttaagattgacttggtgatgcgggctcttttttggttccatatgaactttaaagtagttttttccaattctgtgaagaaagccattggtagcttgatggggatggcattgaatctataaattaccttgggcagtatggccattttcacgatattgattcttccaacccatgagcatggaatgttcttccatttgtttgtatcctcttttatttcattgagcagtggtttgtagttctccttgaagaggtccttcatgtcccttgtaagttggattcctaggtattttattctccttgaagcaattgtgaatgggagttcattcatgatttggctctctgtttgtctgttattggtgtataagaatgcttgtgatttttgcacattgattttgtatcctgagactttgctgaagttgcttatcagcttaaggagattttgggctgagacaatggggttttctagatatacaatcatgtcatctgcaaacaaggacaatttgacttcctcttttcctaattgaataccctttatttccttctcctgcctaattgccctggccagaacttccaacactaggttgaataggagtggtgagagagggcatccctgtcttgtgccagttttcaaagggaatgcttccagtttttgcccattcagtatgatattggctgtgggtttgtcatagataactcttatgattttgacgtacatcccatcaatacctaatttattgagagcttttagcatgaagggttgttgaattttgtcaaaggccttttctgcatctattgagataatcatgtggtttttgtctttggttctgtttatatgctggattacatttattgatttgggtatgttgaaccagccttgcatcccagggatgaagcccacttgatcatggtggataagctttttgatgtgctgctggattcggtttgccagtgttttattgaggatttttgcatcaatgttcatcaaggatattggtctaaaattctctttttttggttgtatctctgccaggctttggtatcaggatgatgctggcctcataaaatgagttagggaggattccctctttttctattgattggaatagtttcagaaggaatggtaccagctcctccttgtacctctggtagaattcggctgtgaatccatctggtcctggactctttttggttggtaagctattgattattgccacaatttcagagcctgttattggtctattcagagattcaacttcttcctggtttagtcttgggagagtgtatgcgtcgaggaatttatccatttcttctagattttctagtttatttgcgtagaggtgtttgtagtattctctgatggtattttgtatttctgtgggatcggtggtgatatcccctttatcattttttattgtgtctgtttgattcttctctcttttcttctttattattcttgctagcggtctatcaattttgttgatcttttaaaaaaaccagctcctggattcattaattttttgaagggttttttgtgtctctatttccttcagttctgctctgattttagttatttcttgccttctgctagcttttgaatgtgtttgttcttgcttttctagttcttttaattgtgatgttagggtgtcaattttggatctttcctgctttcttctgtgggcatttagtgctataaatttccctctacacactgctttgaatgtgtcccagagattctggtatgttgtgtctttgttctcattggtttcaaagaacatctttatttctgccttcatttcgttatgtacccagtagtcattcaggagcaggttgttcagtttccatgtagttgagcagttttgagtgagtttctgaatcctgagttctagtttgattgcactgtggtctgagagacagtttgttataatttctgttcttttacatttgctgaggagtgctttacttccaactatgtggtcaattttggaataggtgtggtgtggtgctgaaaaaaatgtatattctgttgatttggggtggagagctctgtagacatctattaggtctgcttggtgcagagctgagttcaattcctgggtatccttgttaactttctgtctcgttgatctttctaatgttgacagtggggtgttaaattctcccattattattgtgtgggagtctaagtctctttgtaggtcactcaggacttgctttatgaatctgggtgctcctgtattgggtgcatatatatttaggatagttagctcttcttgttgaattgattcctttaccattatgtaatggccttctttgtctcttttgatctttgttggtttaaagtctgttttatcagagactaggattgcaacccctgcctttttttgttttccatttgcttggtagatcttcctccatccctttattttgagcctatgtgtgtttctgcacatgagatgggtttcctgaatacagcacactgatgggtcttgactctttatccaatttgccagtctgtgtcttttaattggagcatttagcccatttacatttaaagttaatattattatgtgtgaatttgatcctgtcattatgatgttagctggttattttgctcattagttgatgcagtttcttcctagccttgatggtctttacaatttggcatgtttttgcagtggctggtactggttgttcctttccatgtttagtgcttccttcaggagctcttttagggcaggcctggcggtgacaaaatctctcagcgtttgcttgtctgtaaagtactttatttctccttcacttatgaagcttagtttggctggatatgaaattctgggttgaaaattcttttttttaagaatgttgaatattggcccccactctcttctggcttgtagagtttctgctgagagatccgctgttagtctgatgggcttccctttgtgggtaacccgacctttctctctggctgcccttaatattttttccttcatttcaactttggtgaatctgacaattatgtgtcttggagttgctcttctcgaggagtatctttgtggcattctctgtatttcctgaatctgaatgttggcctgccttgctagtttggggaagttctcctggataatatcctgcagagtgttttccaacttggttccattctccccgtcactttcaggcacaccaatcagacgtagatttggtcttttcacatagtcttatatttcttggagacttttttcgtttctttttattcttttttctctaaacttctcttctcgcttcatttcattcatttgatcttccatcactgataccctttcttccagttgattgcattggctcctgaggcttttgcattcttcacgtagttctcgagccttggctttcagctccatcagctccattaagcacttctctgcattggttattctagttatacattcatctaattttttttcaaagtttttaacttctttgccattggtttgaatttcctcctgtagctcggagtagtttgattgtctgaagacttcttctctcaactcgtcaaagtcattctccgtccagctttgttccattgctgatgagtaactatgttcctttggaggaggagaggtgctctgctttttagagtttcagcttttctgctctgttttttccccatctttgtggttttatctacttttggtctttgatgatggtgatgtacagatgggtttttggtgtggatgtcctttctgtttgttagttttccttctaacagacaggaccctcagctgcaggtctgtcggagtttgctagaggtccactccagatcctgtttgcctgggtatcagcagcagtggctgcagaacagcggtggctgtagaacagcagattttcgtgaaccgcaaatgctgctgcctgatcgttcctctggaagttttgtctcagaggagtacccggccgtgtgaggtgtcagtctgcccctactggggggtgcctcccagttaggctgctcaggggtcagggacccacttgaggaggcagtctgcccgttctcagatctccagctgcgtgctgggagaaccactactctcttcaaagctgtcagacagggacgtttaagtctgcagaggttactgctatctttttgtttgtctgtgccctgcccccagaggtggagtctacagaggcaggcaggccctcttgagctgtggtgggctccacccagttcgagcttcccggctgctttgtttacctaagcaagcctgggcaatggcaggcgcccatcccccagccttgtgccgccttgcagtttgatctcagactgctgtgctagcaatcagcgagactccatgggcgtaggaccctctgagccaggtgtgggatataatctcctggtgtgctgttttttaagccctttggaaaagtgcagtatttagggtgggagtgacccaattttccaggtgccgtctgtcacccctttctttgactaggaaagggaactccctgaccccttgtacttcccgagtgaggcaatgcctcgctgtgcttcggctcacacacagtgtgccgcacccactgtcctgcacccaccgtccggcactccctagtgagatgagcctggtacctcagatagaaatgcagaaatcacccgtcttctgtgtcgctcacgctgggagctatagacccgagctgttcctatttggccatcttagctccacctaaagccagcttttcgccatgattttaaaaagcaagtctgaagacccaggcccttcctcctgtgccaagcatcaggaccctcacctccttggccattcctcagctagtcttgggtaccttggtgtggtcgattgcccccttctcttggtttccaagacaccaccttctcccagctttcctcctaccccttggtttctctatttcaggatcttttctccccgctctgggattccagagtccacttcctggtcctctttctgctcttcaacacttctttttgttgttgttgttgagatggagtcttactttgtcacctgagctggagtgcagtggtgcaatctcggctcactgcaacctccacctcccaggttcaagtgattcttctgcctcagcctcccaaatagctgggattacaggtgcccaccaccaatgtgcctgactaatttttgtatttttagtagagacaggatttcgccatgttgcccaggcttgtcttgaactcttgacctcaggtggtccgcccaccttggcctcccaaagtgcttggattacaggcatgagccaccgtgcctggcttctcaacacttcctgatgacctcctcttgtccccaggacctgaaaggctatctctgtgccagtggccccagatgcggatccctagcccagggccttgtgttgaatttcacatttgctgatccacctgtccactccacatcgccacttggctgtccaacaagtgtctcaaatatcaggagcccaaagctgagcccctgaacttcccctcctgagtcccacttcactgcagcctgcccatcttggtcagcggcaaccctgtccttccaagctctctgggcaagcacgttggagcatcctggacgctgctctcctgcccacctccaccccactcagtgcagcctgttggctctgcccttgcatgctgccgggacccgaatctggaccaccatagccacctccaccccaggcgcttctggccattatcaacactgcagccagagggatcttcagacacaggtcagatcaggtcactgcccgccagaaaccctgcagcagctcctgcctcactcaaattaaaagcccagtcactgcggcctctgtattcctaacctcagagctccaccttccatcccatgttgtctgtgtagacaggtggctgagcactcctcattcatgcagcactttcttcccttcccgaacttcttcttctttttatttttatttatgtatttatttgagacgaagttttgctcttgttgcccaggctggaatgcagggcacgatctcggctcactgcaacctccacctcctgggtttaaatgattcttctgcctcagcctcccaagtagctgggattacaggcatctgccaccattcctggctaattttttgtatttttagtagagatagagtttcatcatgttggccaggctggtctcgaacttctgaactcaaatgatctgcccacctcggcctcccaaagtgctgggattacaggcgtgagccaccatgcccagccccaatctccttgactcatgacttttggggatcccagggctcccttcctgggccacctctctgtctgcacacaatccctaggtgagctcactcagtctcgtggttctaaacaccacaaggcacatttaagctgatgcttcccaaactgattccctgggcctggcctctgcccctgaagtctagactcagactcctaagtgtcgactcatcctcctgacctggacgtttgcatttcaaactgaccacggccacatggagcccacaccccaccaccacccagcagcctcctcctgtcatcccacctgaaccaggacatggcagttttcaccttccagccattcagccaaaatcatcagcatcatccatggcccaccccattcttcctctccaccccccacccatcaggagatcctgcgggctcttccttcagagtgctttctgcttctcaccacccctgcagttttgccacgctggaccactccaccatcccgccctccatcctgatcatcataacagctgcatgtttctgccattggcccccgtggtctctttgttacctggagccatcagctaatgtcactttcctgctcagaagccaccaggaggaggctttgcagcttactgagagcaactgccccaaccccagtggggacctccactctgggcccgcacaccctcctgaacccatgctgttctccacgcgtgcccctcctttggccttcacactcacgagcccatccacctggagcacctgcccggtcctgcacacttggccgcctggctcccccacctctcccctctgtctgggtaggctgagttccatcaccccagcggagagacctttccagacctgctgcccagtgccctgctccttgctctgtcttgtttttctccattgcttttcttaccatgtacagtgctgtgtttactcatttgttcgctgtctgtctctccactagagtggagcttcgtggggccacatgtgtttgctgctgtatcctcagtgcctaccacagcaccaggccctggtggcactcaggaaatcatgtctagtgaaggactaagggagtgaataggccagggagggtttcccttccatgtggccctcgtttgctcttcccaccgagcccccaccagcttctccacagagctgcgatgtgtcttggctctgtcaataagtttctgttctatgctcagtctcctggaaatccatgcgtataacctcccagtccaaatattagcaatgccctgagccaaaatcagcatattctttgagcctccaagctggtggagaagcagacagaaccgttcaagtacaaatgtgtctgtgcagcagggcctccacaaagggcacccagccaggggggcagaggggcctcagctgggtcctgaggggcacgttcccagccacaggtgctgacatcatcctggacttgagcctgaagcaccctgaggcacaagctggacattctctgggatcctgagatttgccacaggccacacaccagtgggggcttctcaggggaggcctccctgggatgaaagtcccaactgtctcttgacctgagaaaagcaggtgctgcccttctgtgtcctggctgtcttctggccttcatccaggacatttccagcaccccttggaatagcggctaggtgccccgttcagtagatattggttgaatttcttttttctttctttcttttttttttttttgagttggagtctcactcttgttgcccaggctggagtgcagtggcatgatctcagttcactgcaacctccacctcctggattcaagcaattctcctgcctcagcctcccgagtagctgggattacaggcgcccgccaccacacccagctaatttttgtaatttttagtagagacggggtcttgccatgttggccgggatggtcttgaactcctgacctcagctcatccgcccgtcccggcctcctaaagcactgggattataggtgtgagccactatgcccagcctattggttgaatatttttaaccagataacactggagtggagaggctgaacgtgacgagtgctggattgctctgggacttattagtgaggtcacctggacaagttactgaactctctctgggcctcagtttcttcctgtaggaactggaggtaacaacggcctccccctcttgggctgtgtgaggattagttgatgtgaaatgatcagaatggcacctggcacgcagaggggccttccatgccagcactcactgttgccacctcattggtggtaccaggtgggtccgtgatggaggatgggaagggaaagaccaaggaggcaggaggccgttctcctggggttgggtgtctgtggtcaacagacagaggggaccataccctcctgcaggcccacggggcactggggcatgacccagcagcgctcactccacactggaagcctccctcccctggcaagcgttgctctgtgtggcatctgtgctgtgcatctgcaggtgccctctcggtgcgccgtggctgggggagtggaggagggcatggatctccagcattcctcatcacctcttccagctcctggagatatttacaatcagcccagggagaaaagtgccacatgtcagaaaccatgagaacataaagcagggctgactggcaggagggtctgaaggggcagagtgggagctggacagggcagattgggccctcccctgtgcaggggcctgtgctgtgggtcgtacatgcaggcgtggtctctgttttcaagatgcctggtttccagctgtgggtcctggtgcccatgctaggagctgaagggagacagtgagtgatgcaagaggctcagaggaaaggccgggggcttccatccagggcctggtggatcctcctgctgggggtgggtgagaggggcttcaggaccagggaagccaccctggaggagacagcagatcccggcttccacggacaggcgagaggacatagcaggaaaaagggcacatgtgggcaggaagagggttgacaacaccaatggccagaccccctctgtgctggggggatctgtgctgtgctgctgcccatcacagcagcctagcagagatgggatgccatgaggatgatacatcttttagacaatggactacaaatattgaaaatgaggattttaatatccctcttttacagacagggaaagtggaggtcagagaggttaagaccaaggccaagcagcccacagccaatggggccaggctgtgaacgctgcctgtcaaccctagggccctcacacccactccataggcagcttcccacatggggctggcacatgccacctggacacagggctccctgcagtccccacacccccctacattggggtctgcaagcaccaagtggagggcatgctttccattggctcttagagactggcccgtggatgcgaggggccctttgcaaacctttgatggatttgtatttgaaactgcaatgaacacctttcccaggttgccctgcaagatgcattttcagagcatagattaatggcagtgccatttaagtgttttgaaaatgttttctccattaatctcaatcaggagccgattactaccaataaggctcatgaagacagcatgagttagatggagtctcagggcaaaagagccccagggcgaggcagccctcacagccccaggtgggggcctggccccgggccaagccttcctcaatggtttagaagcagtgcacagggccaggcgtggtggctcaggcctgtaagcccagcactttgggaggccgaggcaggtggatcaccagaggtcaggagctcgagactagcctggccaacatagcgaaaccgcgtctctactaaaactacaaaattagcagggcttggtggtgggtgcctgtaatcccagctacttgggaggctgaggcaggagaatcgcttgaacccggaggcagaggttgcagtgagccaagattgtgccactgcactccagcctgggtgacaagagcaaaactccatctcaaaaaaaaaaaaaaaaaaaaagaaccagcacacagataatgcctgctgcctgcctgtacccagcctccccccgccgggtgtcattacctcattctctattgttctacttaggtgagatgcaactacatattcaattttatatcctgcttttgtcaatgaacatgaattccacaagggtcaaactgtgtaatctctctgatcagtttttcttaccaataaaatgcgcaacgacttcccttgcttacctcccagggccatcactgggtcagctgtgatgagcgaaggaggatgtcgtatggccgagtgtttgtgctgttaggattttgcacctgctcttttttcattcattcattaggcaaataaatatttaacataccagatggaaaataaagcaaggtacggggcgagaggacagagaggggagggactctgaatgctgcttacacctttatcaaccaggcggccaactctttgcccaaatgtcacctctttctggctttagggagcactgtgagctatttggaagcccttgccgtctgccccagcaccatgcggcacctttcttggggtgaggtgcttggtgggcacctgatgggggcagaaggataagcccacgtcagccttcctctcaccaccgtccccacgtgggctctgtgcttgtggctgtcttctctcgggcatctctttcctaccttcagggaggctgcccctcaggtgcagccattgcatacaggcagctgcttctctctggtaccaacatggagcattttgcagtcatttatcacataaacatcaatagacattttttaaaagaaaccaaattagaggtcctccccaacccacttcctctgctctacaaattaaattgctttgatttttcttattctctgccagatcttggaaatatcattttgtattgcgtgtcacagtgaggggcctttcatgaagcagcattcctgttttggccacgctgggaggatgagggggggtgggggtgggggacagctagggatttgcctgcctgagaggggatccacatggtgactcccatcccacttgctgcatgggagcaaacagggcagccacgtcctggcctgaaactaagcctgttggtgcagctgacacgttgtaagaaagcaggccgctgtggatggcactttctcatgggctaaaccctctccttccttcctctcagtctctggctacagttgagtcatgctccaggctcctgggaggtgaaaggtggcttcagagaccctggaacgtggcccaaagctgtcatgttgcagctcggataaggtgaaatgggtccttggccaagttcaacagtctgggcctgcagtggggaagccatccctgtccctaaaaaccgctccactctgacataaagataataatgtgtgggtttgtcatggtggcgctcatcctcccagaacgctgtcttctagccagcagttgaggggacaagaagggagtgtccctgcatagggagggagggaggcaggatggacttggcttcacttccaggggggctcggggaatccaatctgtgcccttagacctgagagcactgcttatttacttttgggagaacttgaatgtatctgagaattggaccaaagctgagaacctagtccccataaacaaagtgtacaccggctcactattctcacgtttgtaaggtctcaaagagcccacagaccccaggccaagaggccttgatccaggactgtggggaagacttcctgctctgagaagaggctcagagaaggtgcactgcccaaagctcagggaagacagagcgaggcttgcaggtggcccttccatggtgccctgaggagaggccgcacagttccctgggggccagcggggctcttggcattatggtctgggtgctcaggtggcacctagaccctgggaaagaggccctggcagtcccctagcccatgtcagtcatcctctgtgaatggcgatgggggcaggaaggacagtcctctaggagtttgtctggggtggacgctgcaaggccagggtccttcagagcagcctccatggcagataaagggagagtgtgaatgaggctgccaggtgggaagctatgggtcggggtgtctaaagagccaggcacttcttgctgtcagaggagagtcagagggggcaggagcaatcccccctccaccatactgccccttctctatgactcaaagacgtcaggcatggctgctacccaccgagagcccttctgggactggcagggtccatccacctcactctgttgctgagaccagcaaacagggagcaccccttcccacttgctcgcttcctagacgaggggactcccagtctccctttcactttgggccctggtctcactctgtagccagaggggcccagttgtgactccagcttccccatcttctccctgcccccatagccactgggccagccactgaaggccaatgtttgtgatttcattgattcatgtacctgccctgtgccaggcatggggccaggtgctgagaaaagaggctgcagtgactggcactacacatgcttgagatcacaggtgagctgcggtcctggaaaaggtggcagggtaggggcctcctggcatctgcagggctcctccctccttctgctagtcccatcagccaccccatctctaaacacttctgagcagattacctttccagcctgactttaacagtttaaaaaggtgagggcacctcccccagaccttgctctttaactatatccaggtgcccagggccagagagagctgcacggtccgaagctcagagcatcctcactagcatttctgtagcccctcagagtcctagggtgccctgcctggtgggtgcatggggccagcaagggcaggtggtgtcaactcccatcctggcatcggatataggaccagcggtagtgatctcccccaaaaaactgcctacctgggtttccaacttgcagcccattatctattaatactaaataactgcatcgattcgattgatactacttgttagatcaagcggagggccctggccagggctgagcaaggcctgatttacatggagatcgtttaaaagattaactttagtgaaagcttcgaggtttggcaaatccataattaatcagcctggctcagagcttctgtgattgggggctgatggcgactgtgcaaaaaagcaggggttggggcgggggaaaggtggagaaaacttcgctcaccgcatttgggcaggagaaatctgagattcagagacgtgggagttccgaatgagatcatttttgtgcctggttgcagcatattagcttgcacgtgacttaaaaataatggctttcgtagaattgcaaaattagagttaaaaagacctgaacggctgtcctcctgggagtcaggttgagatgaaatttggtccttaaatctggcctgtgtttttagtaatttatcaggccaccagcaaggcctttttgctcagcggtggcgttcagaatcgtgttttccttactcaacattcccaggtgtcgtcccctcttaagctgtcctagatgaatcttccagaagcagggcagccgacttagaggcctgaagaggtggcatccatcctcaaggacaagcgaggcctccagcaggtgggggacaggaggtgtctgagccgagaagagctgtttattacaaccctgaaaatgagcttggccatctttgataaaaaattaatgctgcgatgacatcaaccttttgaccgcttcctaagtggcccacaaatgtcagaaaagctccgttcctatttgtacattgtgaattccagcacatttagtcactaatcttaagagattaatgcttagctatttgggctgcaggagcacaaatgtaatatttataagtagattgcgagtgatccaaactcagtatttctacggcaatgggttcaaaaagacctcctcagacaccactgattgtcactcctgccagcatatccaagctgcaggaagctctgcagagtctaaattggaatgtgaagatttagtacggggctacacaataatttgctataagctgtataaatagtattttatttgggaattcattgaaaggaagtgtcgaaggtcaaatccttcccagcagtgagtgcatacgtatttaattttcaatctctagtctcttttataatcctgagtggcttggcttcagaaatatttttagcaatgggaaattaaatgtcaatttgagaaagctctcccctgggatgggctgtcctctccctctgcacacattctgccgcccagggacgaggcgcaatcccagctggtcctctgggggagagtgggttacccctgagcactcagcccctcagacattgcaggtcctctagggtgagccttgaggtacagggagctctgggttccagaatattctcagggccccttgcgactcatcctttcctttctagggtaccctctttggggattacagaaatgagctccaaactacagagcagacctggcaagggaggctccaggacgtgctgctgccacgggagggaagcaggaagcaggcagcactggagtcggcgtccgtgggaaacactgtgtctctgggaagcactgtgtgtctgaaaggttctggccagcacgcagaagtgctatctggagggagggtgggggcaggaagtccacgggcaaccatcagactctggagagctatggagacgttggtactgttgggaagcacagcctggggcagggaaagttgtctcttgcacactggaaggcgaatttctagaggggaagacctcgtcgggcgaatgcactgttccattgccagcacctagaccagtgcccagggtgtaggaggcgctcactgagtatctgttgtatgaatgggatctttggggtgggggctctgaaggaagggaggagatggaggcacaccttgctgcctctaggattttaccgagggccgatcaccacatcagggattgtgtggctctcatgaccctgccctgctcagttgcctctggtggcttcccggagcacatagagtcaagtccagatgccttcccgcataggtgataggtcagggctctgcagtggaggcccagcactgcctcccagcagcgtccctaccacatcctcccctgagtcctattctaaagtcatccagagcacctggctcttcctctgaccccccacactgtcctctccactaggatgacatcccctctccctcatccatcactccttcaaagccatgactgccccaccccaccacccctgtgcctaatcagagtgattccctgagtgccacgtcttgtattgcgtggcctttgcatattggtttcggagctggttgtctgtgtgcgtctgattcctgcagctagcaccggtgcctggcaccactgtaagggctcagtgggtgtttattattaaatgttattttctctggtctgctggcagcgatggcagaagtcatcttagcagatggttattgcatacaagccacaggctgaacgaaatacccagcacctctaatggacgcctctaatggagaagtttcctccccatcttgagatttcttggagtgctttctgcttccacgaaatgctcttccatttgagagtgttgtcagaatttgggagccataatgacctgggttgcgattagagccccaccacctacagggtgtatgtccttgagtgagttcctaacctctctgagcatccgtttccatactggatacacaattggatacacgtacctcatatggtggttgcgaggttgaaatgtaatgatttatgtcaagcccttagcatagtgcacggcatattttaagtgttcaacacatggaaactattcgcatggtgatgatggtgatgaggatggagataatgatgggcataatggtggtgatgatgatggtgataactatggtgatcatgatggtggtgatgattatatcaatgatggtgattatggtggtgatggtgatgatgacagtgataatacgggtgatgatgatggtgatgatggtggtaatggtggtactgaaggtgatggtgatgatggtgatgatgatgacagtgataatatggatgatgatgatggtgatgctggtggcagtggtgaatggtgatgctgatggtggtgatggtgataatgatgatgatggtgatgacagtgctgataatatggatgatgatgaaagtgatgatggtatgttagttctcacattgctgtaaagagatacttgagactgggtaatttataaagaaaagaggtttaattggctcacatttctgcatgctgtacaggaagcatagtggcttctggggaggcctcaggaaactttcaatcatggcagaaggcaaaggggaagcaggcacatcttacatggctggagcaggaggaaaagagagtgggggaggtgctacacacttttaaacaaccagatctagtaagaattcactgtcaccacgacagcaccaaggggaatggtgttaatcatgagaaaccacccctatgatccgatcacctcccaccaggccctacctccagcattggggattacatttcaacatgaaatttgggtagggacatagatccaaaggtggcaaatctgctgctactgctgctgctgatggggatgttgatgacaatgatggcaatgatggggatgatggtggaggtgatggtgatgatgacgatggcagtggtgatgacggtgataacatggatgatggtgattatggtggtgatgatgatgatggtggtgaatctgctgctgatgatgatggggatgatgatgacgaggatgatggagatgttggtagaggtgctgctgctgctgatggcagtggtgatgacagcaatcacatggatgatggtgattatgatggtgatggtgaccatggtggtgaatctgctgctgctgctcatcaggaggatgatgatgatggtggaggtgacagtgataataacgatggtgatggtgatgacagcgataacatggatgatggtgattttggtggtggtgatgatgatggtggtgaacctgctgccgatgatgatgatgggtatgaggatgacgatgatggggatgatggtggaggtgatggtgacagggatcttgatatgtttctaccattttgaggctccatgaggatccatggcttcaggtcttggcaagcctctctgttacctgaccagggccgggacatagaataacctgccccttccctctcattctctgcatgttcacccacagggaagcctgctggagaggcctctatttctgccctgtgggccagtaaaggcaccaagtaaaatctttgctaaatccctgcacttccaaggctcgccatctgtttcctattagagtctcatgcatccctttgacatatttttattgtcaggttagaagaaaatattccactcatttgcaacattctcattatattccctttataacaatttctaaaagagaataaatataaaatatttctctgtattgtggagatatttcagcctgactttaatatgctgcatagttttccaactcacaattcttctaaccttgtgatgacagttaagaaatcttcaggctggggaaaacatgtggatcaatgagttagtggaagtgcaggacactttatgaggactcagggagagcggctttctgccgactcagagatgccttctcagccttttgagaataaactgttccaacagtcccaaagtctctttcccttgggccatttctaagaactcagagatgtctcctttgagatcgatcagcagctgggtcctcaaggagcctggccaggaagcttggtttgaaagggcaaaagtggaaacccttgtccacagcctctgagtaagcctggctgctccaggtggcagtcacgactgaccctaccccagaggacccagtcaaagggcatccagatttctcatttccacccgggagtacaggtcctactgtgccttcagccccaggcttgtggctgccccaggtccctgatcgctgggaagagcgtcctgccatagactcagctccacactgggcagccccacttggcagatcgaagaaggcagcattcccaactgccctcccgaatggacggccactttggggtgggcgccaggcagttaagcctgctggtggcctctacttcctcctgccgtggcgccgctcaagcataccccagcccatctgcagatcaggtccccttaggtgaattcctgcccctgctcccttgccaagtgtctcccactcccagtaagcccttccttcaaactgcctcttccctgcagatctttgagaccaactctctaaggcttttctgatgcctaagcccctggagaccacccttacctcctcctgccccatccccaagctcccaaagtcctatgtcatctgtgcagaggccctttgcacatgcagcatgggagccactcatcctaccagactctaggacccccgaaggcagcgactgtaatgctggtgccaggggaacaacctgggccctgagccaggcagaggcaaccctggtccccaagaagcctgcagtcagttctggagaacaagacataaacctgggaagatgatcgaacaacgctgacaaagtggactagaaacaaggctgaccagcgcagagcccaggggccctgggaagagccggagctgtgagaaccgctgttggctgtgggtatgctaggtgccaggagcatccgtattctcttttaagcctcacccagccttgtgagctaaacataacatccctattccacagacccagaaacaggcccagagagggaaagtgacctccccaaggtcacacagccggaaagtactgaagtcaggttttgaattcaggtctaactataaattggtgtcccagggagttcaatccaggaggcctttctgtgggtgtttaacataatttagaggatctgagggaatgggaggagcatgttccggtagcggccagggaattgaggcacagagaccattctatgcagcagaagacaagtgagaggtggctgcgtggcatgagaagtcagggctgtctgggagaggaagcatcctggtggggtcaccacggggccaggatgctgaggggccagggccagtgctctgcctccgtccgggcctcagcccacctctggtgctggggtggtccgtcctgagcaagccttgggaagggaatctggctgctccccacacagcagctgcctttctgttgtctgagctccactcagttgaacaaaatttgccgtcccccttgtggccctgcatctcctgttatctctattcagggcccttctgcctttcagcttcaccaggagaggattatttacggccttgtttatttcgctctctgcaggcaatgcccaggctgaggagacaagtagcagtgggcagcctgcagccagggcccagccagcacctgcctttcttcgtgcataggttctgcaccggggccagccccagagggatctccagacccgacagacccccagccttggtgaaatcacctcctcagaaggaagcaggcagcctccctctgaccaccgggtatgccggcccccagtccccatggctgaagggtacttggtccctgtggccttattcaatagagccaggttgcctgcctcctgctcatggaggtccctgagggaggaattgcccaggaaataggccagcctaaggcttgtggctgccctagcaggctggtgttgggtgtcagagaaggaggcagggcagaaggaagggctgtgctgcctgcatcctccacctgggcatctctatctaagcctccagcaacctgagcaacctccttggtggccacagctgtgtgactccctcctttccattcctctgcagcccttcagatgggactgtggcagctgggagcttctgaaagccacggcctgtgtgattcccactcctggccaggcccagcctttgcctttgaggctcccaaggaccacctagcagtttcttgctgcagggcccctccaggtacccacttctcagggaggggccaggtccaatggcaaggtgaagccactactacctcaccaacggagaaaaaaggacgagccaattgatgtacgtgagcacctggaggaacccccagagaacactgctgagcaaaacaagccaatcccagaaggccacatactgcacggttccatttagataatatcattgaaatgacagaattatagaaatagagagcagattagtggccgccagtggttaagaaggagttgggctgggagggaagtgggtgtggctgaaaagggtagaaggaagggcccttgtgatggaagattccgtttcctgactgtcctggtatcaacatctgggatgtacaggaaagggagactcatggggccaggacagcagtagccccagcctcagccccacaagccagcagcacaggatcagccctcctcattcaatgcaaggggagggggccctggtggacggggaagcattaagcctattgcctggaccttgggcttcactgctgcctgcttcgccctgtcccctgtccctcccccacatcccttccacctcctggagagtccctcccccacatcccttcctcctcctggagagtccctccccaagcatccatgcctcccagctctctctcttttactttccaaacttgctctcagaaaggaggaggctggccctctgctgctctgagcatttgcagaactctctgctctttcccaagggatcagctcatgaaggcaaccatatcctcaccctgtgcaaaaaattgcaggatacaggagccacggggagcatggcagtaaggacagctccctcagccccgaacactgcacagacgctggccttctccatctcgccagggcagacactgtctgtgtgacatactccccatagggtggctaggcagtgatgggttggccacccctggggcttaggaggaaagcaccattcattcattcattcattcattcattcagattcagcaaatccccactgagtcccccgctaccttctaggacctgccctaggtactgggttctctaaaatgagtctgacatcatcagacattggcttgagccttagtctgtttgtgctcctgtaacagagtgtctgagattgggtaacttagaacagaaatttatttcccatcaatggttctggaggctgggaagtccaaagccaaggtgccagcatcttacctagtgagggccttcttgctctgtccccgagtggtggacagtagtggggaggggagccgggcatggtggctcacgcctgtaatctcagcactctgggagaccgaggcaggctgatcgcttaagctcaggagtttgagaccaacctgggcaacatggcaaaatcctgtctctacaaaaaaaaaaaaaaaaatacagaaattagccaagcatggtggcacatgcctatagtcctacctactgggtaggctgaggtaaaaggatcacctgagcccaggaggttgaggctgcagtgagctgagatcccaccactgcactccagcctgggtgacagcaaaaccctgtctcaaaacaagaaaaaagaaaaaaaagaaggcagagggcatgctagctgaatgctgcctgaagccttttttataagggcctgaatcccattttggcaggaggagctctcatggctttctcacctcttacagaccccacctcttaaaacaatcacattggcaacagctgcattttggagggggtgcattcaaaccacagcagtttgcctagacctgctgagctcacagtccagtggggagatcaggccccaggctgcctttattctcactgtctcaggcatgaactcaggccagaatcccatcattctaaagcccagaatcccagaactccagaattccaagtttgggactcctgtacctctccctgtgggatccctgccctaggctgggttcttgctctgctgctattcctgttttgaaacagaaccttccggtttgttgagggttgggtcatcatcccctctgttaccctgaagagagcaaccggcagtgggctcttcagggttctcagcctggttcactgtggtggcagtggagcgcagtccccatgcttggggaaagtcccccagctttggcggaatcagcgcctcagaaagaaccaggcagcctccttctgaccaggcaagggctggccgccgttctcatggctgaagggtactcagttcctatagcccgatcatggcattgtcacggtggcacaggggcccgcctatctgaagtcagggcaatccacgcagagagccctcctcatggcccggctcagggagccaccctcccattcctgcacccttgccttctggcagggcttgcatgcctccgagctcacagcatgacccaggggcctggctgtgctgcaccctggggaagatactgtcttaggtacaagaggcacctcaggagcagaggagggagctgggaagctccccatgccaccaccctgagcttgcagcagagaaccagcccaatttgcaagcaggagcgggaggctctgggctttcttagaacattatttatcaggtagactctcagcctcatggcagctcgagccacagcctgatatgaatattgattggaaaaaatgtctctcccctcgtcccccaggcccggggctgccagggagctctccaagcagtctgggaggcgagagggagccgggcatggggagaagaggctcatgggaagagagtgtgtttgaagctgggagatgccctgcgtgccgcaggcccctgtcctcaggagcagatgaagccctggcttccgggctggttccagcatgggattgttcaggattgttcagggagggggcctgggagggaaaaggggaagagtgacgccccagttccaggcagcagacttaatgctaggcttggaggggtgcttctgtcctagcactaagcacctggaggggtgctcccagcttcctgcagcatctaaagctctgtcttgtgggcccggcagagcctctgggccgccctctgcctgcagaccacagggccccagggaacctgaggtgggaggagcagggtgaggtcggtaaggggtccctccttgccagggcctggtccctcctcccagctccccagctctagaggtactagagcagttgaaggctggttcctggacttgcccttcccgggcctgtggcatctgaaagggttattacttccagggtcattttgtttagtttctgtctcttattaacttgtagtccctcgcctctgtaccctgggaacggcagtggggctggggtcccagcggggcggatgcagaggtagaatgcaggctgtggctgggagctgagggccctgcaatctgggtgtgggatgtaaagaggtaactgaggctggaggttgtgggtgccgggtaccaaagtggggcacattctgagctgtgggcaaagcctgcacgttggggggaatggcagggcacagcggcattgcaggaggatctaagtcccccatgtctcagcccctctggggcacagctggcaggcttggccaggtgggacaggagcagaaaggggaaactgacagccgcaggcaagcagaggaggccgcagaggaagaggagggaggcccagcagaggcccttcccagccctatcctccccggatgcctggatgccggaggcaggtctccggtgtccaaccagcagcctggcccctctttagcctccaggcctggaaagcggatcatcctcctaaggggacagatgagcctaaaagcaccacagcctgggggcttaagccacagggatccatcctgccaccctggaggctgcacgtccattcctcctgagggcggtgaggaaaaccctgttcggggcctctcttgccttctaatgctttgcttggtgtccctgggctgggagaagcctcatctgagctctgccctcatgtttacttggcattctacctgtgttcgtgtctgtgcccacactccctgccgtgtaaggacaccagtcatgctgaatcagggcccaccgactcatctgaactccttacatctgcagagactttccaaattaggccacattctgaggtcctgggggctaggacttcaacgtatgaattttgggagacaacattcaatccataaccgggggcctctgacttttaagggaagagacccctcccctgggaaacctcagattctgggtctgtagaagcctgcagcttggtgggttggagggcctgacacagggtgctgcctccccagctggccctgtggggtaagtcccgggccagcaggcgcattcactcattcagcgagtacgaccggctcctacacggtcgggcggtgtgtccagcacatgggtgaagcaggccgcacgacagccaaggttttaccacctgggtcttgctttctgggaagaagccagaggacaaacaggtcaacaaatataaaaaatcatctcaagtggggatgagagctaagaatgaagtcacgtgacgggaaatcacagagggccttgctgagagtgggacgtttgagcagaatctgaaggagaggggctttgaggaacccaagaagaacacctcaggagtaggggtgtagaggcggaggcagaggcagaaggcagggctgggtggtgttgggggaatcagagatgccagctctcaccccagctgcggcccatagggctgccacctccaggcagctgggcagggcctgggtaggtcagaggtcttgagactggggtgaggggcaagacgcactgtccgagcggcaggtttgcgggggtggagcatggtggagaaggactctgttctagggaaaacccagatacagctttctttggagtcttttaaatcctttgagaagaagccaaagtgatgagtgagccagggtggccgggaacaaggggaagttgtgactttgagctggtctcggtcactcggggcaaccatggctggagagactgggatcccccaagggcctgggctcagccaggaatctctatcctcaccctgagggcatcccagggtccccatcatccaccactggcccctgtgtccaggcaggaggggtcaactgtacccagagccgtgggaggcccctggcttccagtttccctccttcctgtggctgcaatgcagctgtggccccaacatctgtctcctccgaggggcaagggcaggtggaagcaggcagagggggtcccgcacacaggaatcagacaggttttagaactcaaagggcctcgagggtcctggtggagcagaaagagcatggcctgtggagcccggaaggcctgacctgctgttactgagcagggttggacaggaagaaaagtcctggccactctcagcctcagcttcctcatctgtaaaacccagtgtccacctccatatcatagtgagacagtgaggatggaatgaccatctctgagagtcctgggtgcggtgcctgcacagagaggtgtcacggagccgcctctcatcacaccagggccagagtgagcagggctcgtgctggctctgagagggaaggccaccacaaagaggggcagcttctggctgcaggcaggtggtcggtggggggctgcaggcccagagctgcgtcctcccagggccgagggcccctccaggccctgctgctcccaggtggggtctgcggtcctgggtcgggcccgcccttgctgactggacacaggtgggacaggctccccatttctgtcatactgctttctgcctgggtccatgctgccactgacccctcctaggtgggggatctgtgtcccctggaccacactgagccatcgttggctgcgactctgatgttcttcgttgtctggaatcgagcccctccctgagactgtgcagtgaatgagccccctgcccctgcaccacccaggtcaggccgagtggacactaccctgaagcacgtctcccggtccagcccccactcctgcctcactgcgactctgccacctgatgcctccatggagggtcgattcacctgcctgagtctgtgtgggacccaccacccatgcaggaccagggctccccactgaggaccctctgagctactggttaacaggctcaagcctgcgcatggtacggccaccgtcctacataggtcctgggatccagcctccagagtgcaggcccataggccagacaccacctgggcagcttctcattcaggactgccccactgtgatgatggggaggaacggaagtgtgcaggcctctagggtgcaggtctctgagctccccaggtgcagatgaaggggtgaagggagggagagtgccgagcccagcctcccaggaggcaaagcctgggtatctgaggctgtccaaggtgcggagtgtcggagtcacgtgagctgcatctccaaccttggcttcctcatttgcaaaatgaagaggccccagtgagctcggagatcccttcacagaatcatcgctagaattccgtgaggctttgttgaggcccagcaggcctgtctcagtggcaagggaggcaggtggctcctggaacgcaggcagcactgggcgggtacccgcactgggcatcccatgtgccccacatctctggcacattagcccatggctcaggtggcactggccccgtggcataggcgagagggcaggctagggactgctcctaccagtgtgtcttgggctctgtgcccactacctggtggggagaggtgtccactttgtccacttcatggcatgggagccgatgcggcttcaatcctgactccgcagctgcctcctgaccagtcagcaatcgggagccccgacctcttccctctccatcctcactgcagcctgggcaggccggaggccaatgtccccagggcagagctgggacagtcccagtgggaaggaggcctggccgggccagacagcagcctgggaaggagccgtgtgttgcctgggagttccacggcaccggctgaacctgcatcttgaaggtttgattgattgcgtcgttcagagtgaatatattttttaataatcggtttccaaaattagtctttctctgtgtagcagctatcacaaacagcatgagacgcactccttttattttttttttacctgccagaggcagatatttgtttttccttcaagagagcagcaggtgaaggtgtggtccccggatcccagcacctggaagctgcggtctggtcctgcctgcttggagcctgtgggccgagaaagacaggggcagaggcagcctgaccaaacctcctcttgctcccactctccgtggcttgcgggccaagcgacatcagctctgcacccctcggtttccttagccgatggcgatggtttgattacttcatcacactgttttgggattaagacaggacaagcttagtgcacacattatagctgctcagtgcccattcagtaactggtagcttggtcctcctacctcgtgcccttgcggtagctctgggaagccaactctgtctccatttgactggtcctacaggtgcgggttttaaaccctacgtcacccacatctccttttggacatcacaaaactcctgaggtgcccagcccacttacccccaagtgctcaccttctgtgagctcctgagcttcttcaccagctgagatttttccttgtggagttttctacttctgttgtttgtaattcaaactaataagttcttcctgcatttgaaaaatgaaaacatggtgtaatattgaatgttgctgttcaaactgctccccacacccagcattttgcaatgtcccccaggggcacacacccttgatgcttgactgaaaaactaccataccagtgactgtctgtatctcattggcctgagaaattaaaagctgctactgtgttacattaagtgtctgctgtacgcaccgccctgggctgggccagtcctgggggataaagaacagtatcagaaagatactcagacagagctgtctctgtggtggaggagatgagagctaagagaagtgaaaatgcagagccgaggccaggccatcccgcagtgtccactggtgcaggggtgggctgcgggtcgcgagccacgggagcttgcaaaagggaagggcatggcttgaagtcagcttcccggaagaggaagaggcggtccttggctgatggcagaatttgcatgggctgataggaagggacggcttcaaggttgagttggctaacaactcgagccaaggcccagaggtggggatgagtttgctgccaaaggggacggctggcaggaagctactcagtgtgcttgttcgtctcgctcattaattgggcacaaagagcagcaaatcccatccccatcccgaggccctgcagcatggtaggatcatgcccacttctccctgctcttagaccaacgtgggttctgcctcccctgcccaaagcgtaggcgcagactctgggtggaatcaaggtgcaaaggaggcctcgattccggcggtttcagagggctgctccctgcgtaagtcatccacccatcctcttgttaccccacctctggcttctgggggccccaggacttccccagcgctgtcctcagccctgaaacctccatggggtttccatggagaagtgctgacaattttgtttctactctcccagttcttcctgaaattcatctgcatcaaagtgagatcccttatgctcagcgctcagcaaggctgtggtgattaagcacttaaattgattaatcaaatttcctgtgatgagaactactgtcattcattaatctgagcgggattataaataagagatggcagatacaggagacaaccgtgttgacagatggacacggtggcctgaatcacaagtaggtgcctgcttcctgggggctttcgctgtgggcagctggggacggagcttccctaaagacaaaattattcggagattgaagtatccccattttaataacgaaatatgcatagatgagcaggcagccggtacagggagcacgtaggttcgcataccaatggcccggttgtattcatggaggtggtagcagcagctccaagagataaagaatctgctagaaaaagaggccaaagcaaagtggcacacgggttgagaatatgggtttgagggtcagagcagccctgggtgcaaatcctgcctccatggtttactcaacgcgtgacttggctgaggttctcaatctcccagagcctccattccctcactggcaaaatgcggatgctgataatcctgattccactgggttgttgttaagagtaaatgagacaatatctatgaggcactttttatctagtttacaaacatttattgagcacctactgtatgtcagtactgtgctggtatttagagattggcaaggaataaagcaagcatggtccctgcccccagagctggtgttcttatggagaaggcagacactgagactcaagggctatgacacagtgctactgccctggccttcccagatgccacattctctgttgacctcctggactcaggatgtcctttccatccctgtctttgaacacttcttcctgcctgtggtctctccttgcccctgcgcagatcctcctcctgacttcttggcctcattcactccaacagaactgtccctcccagctcaagtatactgtgtctctacccaagtcaaagccctggatgacggctgcaaagcataaggcttcgggttcccagctcagtcacacataagcttcataccctagacgtgtatgatgatctgcatgaagtccatttccccactttcgtggggtacagtccccttgaggcagggaccaggtctgttctggtccccatcgcatgctcagccccagcatcgggcctggcccatggcaagcctagctagtacttgttgagttagtagatgctgcatcaaggtggccttgggagcacgtggagatgatgatagccatgtcagacgacagcagggagagtggaaagtcacccagccctgggcatccgaatcagcattttctggagactggcgcctggaccacctcagcacaatacctaccactgattgagcttctgcttggcatatggccctgctagggcactgggaacccagtctcaccttccagccatattgagtggcacagaggaggctcgcaagcagagatgattgcagtgccctatagtgcaccgttggggtagagggaggcccagagcctggggcattctgggtgagctgatgccagaggtgggttttgtagatgtggaggtttggtaagaagggagaagtggggctccagagagggtccctcaggtctctgcaccctcttttccatttatttgtacctcctgatatcctgtccagggtcccaagacagcctctacagggggtcccagctgagcaggccagagggaggaggcacagcctctcacccatgcctctgcctggacacaggaccaggaaatgccatccccagtcttgttgggctcagacattgtgatccgtcggtgagccatcgagcccctccttcaggcccccagaggaagctggaggagtttgcggagggtgggagctggggctgggagcagggaaaagtcagattccctcgctcagaggaaacccgctggtgctcagtgagattaaaactatcactcctggctgaattggcctcttctactgttttgctaaatatttaaagaccccttattaaaagagttaccatcttaaaaatgtcagatcttcatctgtcatgtccttcctctggagtgtggcctcagggctgtatccaagcaccccagaaacagaaaccctctttgccctgggccccaggatcatttcaagtggtttctgaggacccactctgtacccagcactgtggctgcccgagcatctgcctctccagccacagtagcttctgccacgtgatgggctggcaccagcctgagcaggtctcagggaatatggtgaggaggcagcttgggctgcagtacgtggccatagtgcactctgcccagcccaaggttctgtttgctgcttccctcctccctgggcaccaggctgggctggaggcagagaagctaaggacagcccagcctagggagtgaggaagcaggaagtgaagccctgagccacggcaaggtcttggccctgctgatgatgttgggcaagcagagggtcatgggggcaccgagcaagaagcatccacttctgcctggaggaattagagccagattagaggagaagctgttgtaggattaggatgagaattaggtctttgagcagcacctaaaaggtgaataccagttcactggacatagaaatgggggtttcccccaaccctctaaaaacaaagaaaaccagacaacacaaagacatacaggttcaaagacttgttcaacaagcaattgagcacctactgtatgccaggaaccatgccaggccctgagaatatagaactgagtgtgacatgttcctgcttcccgtaaaatttgcccgcctagctggggaaatagactaaaaacagcccatgatgtggaatcaaatgtgctgtaataaaagcggttgcagctgcctccctagcacggggtaggaggtgggggatggggtgggggttacctctgtgcctcaggtgggaggtgggaggggtgcctcaaggggaggtgatgtctaagcaggttttgaggataccctgaatccactaggaatgtgcagtagcttggtgtggcctggacagatggggagagagggaagtactgatgaatgagaccagagaaagggccccagagtacaagggaaaggcatgggaaagagatatccagagccttctggaatgatccaagcagagagggatggagaagccgctgctatgaggaaagactgccccacagagacaagggtggagacggagctggtgaggaaggggaagcccatgggagctgtggtctgagctgggtctgaagggctggtcagccgggggatgccccactgcccacagatggtacagtgaggctggtgccagtgtggcccacagggaacgaatgcccagccagagcagaaccacccaaggtgaccctggacgggggaggggctcagcctggagggggaggcggagctggcctgtgtcccctcccaggtggaaagacctgggcccaaggccacctgacgccggaggagccagagagaagaggggacacaggacagaacaaagacatggctggacgttcactcacatccaccctcatggtagaagagtctggaactcagtttaaatttttcaagtctttcatgaaaggggaggttgcctcctcttcctaagcgatgaacatctcaatttgctgctgctacagagggccaggggtagcatcactgaggctaggagatgtcaccggatgtcagccttgacttgagcgaacattcaggggtcaggatggtgtcatgaatggagctcccagagcctgcgagtccaaagacctgggtcccatctgggtgtggccacagatgcctggcgtgaccttggacacagctgtggctgctccaggcctccctcctcacctgataaacaggggagttgggctggtgggtggacaatccctctctgctccacacattttccatcccggtgcatcctccgcccgccgctcaccttgctgtcggcaagagttaagttttactgagaaaagaatttctctctggaatattgagtataattaaaactctgctgtgaaaaaaaaaaaaaagcctagcaaacactgagagacctagaggaagtgaaaatgtaaaaacacgacccccattttcctctccctatgacatggattattaagtcaggtttgaaaagttcctattaaatatttaaatatttcattaaatattcatcatctcaaaaattgcttcctaacagatccttaggtaaatataacaatatttgatcacaaaagctgcttggcctgactgaggctcaggaagggtgatactctgtctggggctctggtcccacgggtacagggaatcctgcttacgagagggaggctgagagaccgggaggggaacacacgcctggccaccaggagggcccgggtggccacggacttgcctactgggcgaatgagcctcagaaaggtgatacggcaaacggagctcatgtggcttgtagtggtgcagctgggagccgaacccatgttggccggacccctctgtgggcgatgaagaaggctctcccacagtaggggctgcccgctggcttaggccatcccaacactggccacgtgcaggggacattgtgaaagggaccttctatcagaccagcagctgggctggaaacccttgacatcccttccccggggctgtggaggggaggggtgctcccctggggttctgtggaactggattcacagcccggttgttccttgtaagggcacctggtctcccaaagtggagtataaacagctttcagtgggcaggacatgtggcagccaccctcgcctccaccgtctttcttacctcccaggtatggtgctggggtctgcaggagggtctcaaacctggagctgtcggggtttgggccagatggaggagtcaaggtggagaccgtcccgtgcactggaggatgcggctcccactgggcctgcacctagtagatgccagtgtgccccaacccctcatgcccacctgaaatgcccagacacttcctatgcccccagggagccatactgcccctggctgagaacattgctttaccagaagggcactttgtaaacacgtggtgcgcgtggatggtgtagcaccatctggagggagagagtaggggagggaagcagagtgactctacaagaagggcacttggtaaacacgtggcacgcatggatggcatgacaccgtctggagggagagtaggggagggaagcggagtgaagtcaggttgatagtgttgggcctgcctttggcctgaagggctttgagtgggggcggggtggggggtgagggggtgggggagctgctgagtgctggatttcagcagccacggtgccagctttcagttcccacatgggcttcttctcaaaggcctcaggggatcgtgccaggctaaggggtccctggctctgctcacctccacctggcactcgctaggcatatgctgcagcccctaaccctccctggggctcaggactcagtggaacggcagggactcagagcagccctgccagtgccacgggcctcccagccctgtgtgggggttctctcgtccacccgagtgctttcactggccctggaagcctccccagcctgaatgcagcccttggagggtggggacactgtcctctcctgccttcctgtgctgagtgtgaggaactcccatgagcattccaggtgggctcgctgctgaacaaggtagaagctcttcactgctttttatagtgcaggcacctgggtgcagagaagcaaagctatttgcccaaggtcacatggcaatcaatccaggtttacacccaggttggtctgacctcagagcccatgctctgaagcaggctgtccatgcacaccacacagactgcccatgtcactgagtcctcggagcaggtcagcgggtgctcctctgcggccgctgtcttgatcctcctcattccaaacgcatgtgtttgcagagcagagagggagtcttggtgcccaagcccagtccccgcacctccctcctctccttccctgggcaaattctggggtgaggaggagggcacaaagattgatgggctcccctcactggcagcaggcatggacatggagtgggggggctctcccctccagaattctgatgcatgacacctgctgccagtgccaccctctcaggctcctgggtgacaggaaggtgtgaaacctgacgtttccttgggtctggaatgtgtgcgaacctccatgtcctggaggaaggaccctctgcctggggagaactggtctccaggtgggtgctcagctgaggcctctgtggaggccgaggctctctgtgctgtgtccaagctgggagctgggcaggcgccagccctccttgtgggtgggggacagagcctgtcccagtctgtctgggctgctataacacaatctatagactaggtggcgtataaaaaacagagatttatttcccagagttcaggaggctggaagtccaagatcaaggtaccagcaggttcggtatctggtgagggccttcttcctggttcatagaccgtgccttcttgctgcgtccttacgtggtagaagaggcaggggtctccctccagcctctttttataaggacactaatcccatgcacaagggctctgtccccatgacttcatcacttcccaaaggccccacctcctaatcccatctcctcggggtcaggatttcagcatatgaatttggggacacaaaaacattcagacattgcaggcccctctgtgggcgcccagcagcactgcctgcttgctctgaggcagcgatccaggctgttttgcacacacaggtggaaatggctccaaggtacagaagcaaaatgtttcccaaaacaaacaataacctgtcgtgaacattgataccaacatggtctgtggggcgccatgggctggaggcctgggcagctgctgggggccactgccgagcaggaagggtggctggcggtttgcacattcttaaggaaaacagcaaagaaagaagaagctgaccctgggagcatgggctgtgtctggattctagacaaaccacaaggctgataaagcgaggagatgtaggcctagacatttgtcaggatggggctagggcttcttaacccagcgaagctgcacccaacgtggtgtgcgtgggccaagcaacatttttctgacacgaggtctctaactctcatcagagaagtcagaagcagtctaagaccaccgggccaggcagagcagctcccaccagggtaggcaaggatgctggcagcgtgtgggatccaggagtcagagccctctgacctcgtcttttccaagggcctcagttatctcacctagaagataggaatgagggccagggcagtggcccagccctataatcccagcactttggaaggccaaggcgggcggatcaattgaggacaggagttcaacaccagcctggccaacatggtgaaaccccatctctactgaaaatacaaaaattagctgggcgtcatggtgcatgtctgtaatcccagctacttgggaggctggggcaggagaatcacttgaacctgggaggtggaggttgcagtgagccgaaatagtgccactacactccagtctgggcaacagagcaagactcggtctcaaaaaaaaaaaaaaaaaaagaaagaaagaaaaaagaaaagaaagtactggggcccagtactcagtggaacggcagggactcagagcagcccccgaggagtatgagcctgactccttgctccatgcagcccccaggggagaaaggcgtttgataccacacttcgcaacaagaccaccaggtggcttgggggtaggagggaggagaggggcagggtttgaattctggcactgccatcatgttacccttagggcctggtgtcctgcttggagagatgaggcccaggatgaagccccaccagccagcccagcagggatgcggcccccttggggactgcaggcaccaacttggaggccaccatcccgcaagccatgggtctgaatccctgtggaatgtgtacaagtcctgagcctctccaaggcttgatactccatcctgaaagaggatgtgctaattccctcctccttgaaggttgttgtaaggaccaaaagtgaggatgggtgcccatcagccagccagtgaagacactaccttaggcaacagtggcccagagatacaacagctcagtgagacaacctggggagacttccctaaaaatccagaacacagaaagtgtggcatcaggcaaaggatttccattatgagcagccacaagaaggaaagcaggcgccctgccacctccacccacctctgctggaggggaggggatggaaggggcctctgcagctttcacaccttgtaagcagaccagatgcagaagtagagacaggtgggattgaattaaccacaggtgcccggggctgcaggccccaccgcctgcccgctctgcctgcaagattcaataccgccccgtgcaggttagcagcacattggattccaacgagtcatattttaacactgctggatagttgcaggtgacagaaaacctgtttctttcccattttatacatccaggaaatttgtaccacatgcagcctgcatgtcattacacactttaaaatactgcattctctctttctggagcccgcggacccatcacaaggcagataaaatgcaggaccgagggtgagagcccctctattggggcagagagagcagctaaatgcagggcatctcatcttactgttaagaactgattcctcccttccacccccaggaggatcatcctagaggctgcaggacaatctgttatttccccggggaggtcggcgaaggtgttagctcgggagaagcaggtgtaattacagaggcccaggcagggcactgcattaatagatgtaggctcttcagctagagacttatgtacatgttgctgaggccccagaccctgctgaggctccaggtccagagagcaaacctcctgcctggtcccattaaagcactgagccagccccatctctccccgtccctgactccagttgacagccatttgcatgatgttctcatctgcagattgcacttcttgctggggagctgctcagaacctaccgggaggggttttggaaagcggatttccagggctccagatcagtgcactgagctctgcagctgcctggatggccccaggcagctcagcccccaggctttacctggtgcagggatctccctcctactgtggccaggtggccgccctcgccactgcggcactgcctacggagggtcacagctctgcctgggggatgagggatgagtcagctcgccccatccctgctctccgaagccccaggtccctcctgagccacctttccaccttgagtccttagccccctgagctttaccagaatacgcactgtgtgccaagtgctgtgtcaggttggggaggtggtggggaacttgaagcctagcctctccctgagaacccttagaatggacagggaggcctcccttcctcctgtcaatgaaccatcactgagcacgttctctgtggctgctccctgtgaggcctggagtccacagctgagtttgggcagaacctcagccctcagagctccagagggttctcacccaaccagaagggctattggctccctgccctcagctcccctggtttcctctgagctgggtcccagcaacacaccattgtccagtagctctgctgggccgcgtgtgcagacccagggatgcagaaatacatgaaaggtcaagttcatgcccacaaggagtcagcagcctcattgggcaggtgggccccttagaagctaatatggaggggacacaagaggcaggcagctcccagccgcagtgctgaggtttggacctcaggctcactgggctaggctacacagaacaccaggccggggggctaacccccctctaaactggaggcctcaagggcaggacaaactttgcctggttccccatcaaatttcagcacctcgaatggggcctggaatataataggtgctcggcaaacttgtcagttgaacagatagactcacggggggtctgtgtctcctgcatcccccctggttcctctccaggcccccctccgccctgccaggagggtgtgtgtgctgaggcagcttccccagggactggacagagtggaatccctggcccttgtctgtgcctgggccacggtttctttttgtttgttttcattttggtcagattcacataatgcaaaattaactttttaaagtcagcaattcagaagcattagtacatttacagtgttgtaccgtcatcaccactatcttgttccaaaacactttcatcaccccaaagggaaactcccaatgcattagcagccgttcccccttcttccctccctctgcctctagcgaccaccaatctgcattctgaccctataggttgacctcttcagaatgtttcctaggaatggaatcatacaatgtgtggccttctgtgcctggcttctttcagtgagtctgttttcaaggttcatccatgttgtggcgcatgtcagctcttggttcccctctcggggtggataacgttccattgtatggcgagcccacatttgcttacctcttcctctgccgatgggcatgtaggctgttcctgccttgtgtgaagtgtgccactgtagatatgtgtgtgcaggtacctgtttgagtctgttttcagttcttttgggcagttacctaggagtggaatggctgggttgtatgctaatcctatgtttaactttttgaggaatgggccacagtttctctatgaagttcaaacgaggttcttgaatcggcttccagttgactaactagactccaaggaaacacagatgaaataagaccccatcccagcccccaggacctcctggcctgctctcagcccatgtgaggcagcaaagctgctgctgggacaggaggaccctaggggaagctttggagagtccgagctcccagcagcatctggtggcagaaccttcttttggcttcgtccctgaagcataaatgtggaatcgtgtccagcggcagcctgggttccccagcctgggaggttcacgggaggaggctggcccagaaagcacatggcccagaatgagccacacggggtgactgtggctttgggcaggtccccctctccctgcacctccctccccactgtcattatctgcagagtcaggggtgggcctgacagcttccagcagtctgtccaggtgcctagatctctatactcctggaccccaaatctaggaaccactaatcaggaaggaaattcctccaccaatccttccaggcctttccacagagaaggcagcccttttagcattttatgtccggatgaaatagttctaggcactatgctggaacccccagctctgagccaaacaggccttccctggtccccccaagtcctgggggaaggctgccctgcacctgtccctggagggggacatgtgggcagatggcacaaaggtggtactggccataaaagccatgttgcaggcaacaggctggtcccattggccttccctgctctctcctcagtaggaggcaaggcctagagagctgacccttaggcagaagaaggggtggctgtggcagacaaaagacccccctgagggagggaaggaaagggacggtggggttcccactttccttggagctgctgtggagtctttgctcactcatgctgggacccggccccccgcagcagcccggggacctggaggtgcatccactgtggtgagctgcagcaggcgtgttgggttaagacctatgtggttggttctgaagagagctgggaatttcaggggagacctgagcggaaccagggaggatctgacatttttataaaaggaggtccctgtgctcatccagtggggaggggatcccagagcttatgtccccgaggggagctctgactctgtccccctttctgtttgcacttgggcagggctctcgagtccttggaagctgccgtttattttaaaacagcccggactccttgaggaagctgaggagagaggaaatggcagaggcgacctcgcctcacacttcctgggcgggagtccccactaggtggccgcctgagccatggggagctattaggaggatcctgctgtaatcaagagatgggcaggcaggggacagagtgccccgtgtctggggaaactgaggaggtttgtgtttatcgaagaccttttatgtgccagtcactgcaaacgtattgtcatttaatccaacaaacctgcaagatcagggtcatccttcatcccctccctactaatgaggacattgtgattcagtgtcgcggccactggcccacagtcatcagtgctgctaagatgtgcaggcgagtttcaaacccaagtctggcttagtgcccaaacttccaccaggcaccccaggcccaaggccaggcaccccgacctccatccaggaggaccgagtgagtttctctgcctgatcagggaggataggaaggggcctctacccccgcttcgtcctactcagctctctcctcctgagggtctgaggcctggacagcagtgctgggcgggaggcctcagtcagcctgggtctgagggtgcagagctccctggggacattacctcttcctgcaaggggcaaagttcctcagtccctgtgttaaaggaaggttggcttctcctctgcccgagatcccagagcgctcacagtgcagcccttctttctgctaaactgcagacttattttatcagcagttattattgaagtctcaccattactattattttcattctgcagatgatgaagtcagggctcagtgagactgagtgattcagctggggttcatccccctgctccgtgccagagcctcggaggttccgatgcactcagggccctgggggcatccagggccggcctggctggggcagcgcatctgcaggtgtttgaggcacatttgttttcaggggaaggggcgctgctgtgcagaccctgctaagtctgttccaggacaagacatgctgcccatccctcctgcttctctagtgcaggagccgcggctcggcatggttctgcgtgtgtgtttccgacactggctcccaggtggaaggcctgatgccgccctgctgtctgctctcttttgtagagatgttttcgtgaacttgagaaaaaatcgggaaaaggccgattccctctgcccagcccattaattctgcatgctcaggccgaattaaccttggcaagccttcaagaggagagagtaattctaaccttaaaaatctgctgatgaaagctggtttcaggaatccaactcctcttaatgtcctggcagacagctcagccttgcattaacatagccacagaccggcccggcgtttccctccacctgcttcataagcaaaaccctgttgtccgttttaagcaagaatccctgcccagactccctggccacatgcagccgcacatgttggagtgtgccgtggatacctacgtggcgtcacaggtgcctagagcgggcggcgctggggagctggatgccagcaggctctggagctgagtagtaaccacagccaggaatcccggcagtgccagccccgcagacgcctgcccacaggagaagagagccactgatttctgggcagcacttggccctccgtgccgtccagaatggcctcggggagtgggctcctggcatctgcatctgctctcctctgggaatggcagatgagtagagagaaaggccggccacctggggctgtgtagccgaagctcccagcgccagagggtacagcctgagcctccttaccaaggctcagggtcccaccgttggtcatccctgaggctgaaatacacaacacccctgctggcctaacaggctgttgataaggaacacatcagacccagagctacttgcaggcattcgtcagagatcccttgtgcttaatgcaggcagacctggtgaagggtgagggggtacccataacagagggatggaggaagggagggagggagatggaagggagggaggaaaaatgggagggagggaggaagaatgggagagagggagggagagaaggagggagggaggaagggaggaaggggggcagggaggcaagaagaatgggagggaggaaggacagggagcgggaaggaggaaggcaggccatcaccagtatacaccactctggagaccagctctagccacttggcagggctccaagaaataggtctcagcggtacattttgatgaaagagagggaatttcactttatttatatattatttatgcccagtacttttaggaagtatttgagatagcaacagcactgatacattgaaataggctaaaagaacaagagccagtgggtgggagataactgagcaagaatatacacgtacactgagcagagctcctgctgatgacaggaccgcagatcccagcagcctggcacacccagctcagagaaagcctgttctttgctggggcccgcagggagccaggtatcaggacagatttctgagacacgaaaggtgcaggtctccagctcccgcttggctgggcctgtgcagggtgaggagctgggctgccttccccaaagcggtttggcaggtgctgggacacagcaggggcccatgtgggcctggctgaacgtcctcagagggtgggaaaacaggcaggtgagagtggccaggttcctggacgtgaccctaagcagcaggcgctagagctgacgagaacagcccatgtggagcgtgcagcaaggcccagatgggagcagcccatgtggagagtggagcgaggcccagcagagttcggcgccgccctcccgttcctcctccctcccattcttcctccctcccttccatttcccctcacccgccccgccccctgcgccgccgtgcccctcacccgccccctgcgccaacgtgcccctcacccacccctggccttctctgacttgagattcatgacttggatcaactctttctctaaatctaaatttaccttattatcaatttttagctattattccattttatgcccactaatttattaatcttggaacccccaaaaacaataaagctgaagctccagatattttatttatatctttcaacatgatttttatggctttttatctaaaaattcattgaatttttattgccctcctcactcatgtcgtcgttaggccggcggccgctttatttagatgtttcccctgcagatacttgggggccccaacaggaaggagctcaggtgaggggaggtgggtgggggcagaggcacgggtgccagcctcctaggggactactaggttaggtcccctgcccctcagtgtccccgggccaggctgtgtcccatgcccctcagtgtccccgggccaggctgcacacctccctggttcctttctggagcacacactgttctccgcgactcttacctctgctcccattttgccttccagcttgcaaaagggcctatgctgcaaaagcaatctagaacattcctcagagaggctgggggagcctccagcttgaagacccagtgtccctctctccatgacccccctgcagagtttctcactggtcttcatccagaccgaggggccctccttcctgttccccattcgacggcacacctgtcctccctcctgagcagagctctggggtctccagggtccccacctggcgggtcttcttggtgctctctgcctgcccaaggatcccccttccgcggagctccggccgacccagatacccaggggaggagtctgtcctgtcccccacggccagaggcccgcaggcactttctgcctcatgatggggtggggcgcccacgtgtcctgcgcctgcctggcgctgcctggttcttctggctgtttccctcaccagcttcctgtctgggggtggggactagggggtggcgggtggccagctttttgacgtttgctgccgttcctggtttctatctgctcttcaatcgcctccatctcaaaggaaccaaccttcatggccagactgggccacctggtcccctgtgtccctccagggtgtgcaccagggcttctgatgagggagacggggttaactcctgcaggctttgccggccaggggactggagttcagattctagctttatcatgcccctgtgacctctgccaaggaaggaattgatgcctctgagctgcagttcccacatctgcagagagggattcatactactcttccttccaggagggtggtgaggtccctggaagggctacccttcctcatcctcctgtgtccactatggcagaaagagtgatttaacattgtggaaggacaggaccagccagaatgccaagccaagggacggctactctcccagggagccctggagaatgaattttggggagccttcccgcccctgcccagaggagtcccccaagaaagtgcagtgttaaggggctgttttcaggagagcctctagtcccacttggggagcctgggcctgagctgtggccggcacctgacttcataacctgaaggcatcagggtttggggatccaggccagccctcttgctgtctggcctcagtcccctggcgtggcagggccacaagctgctttgggagacaccattgcagattgtcttaggaaagaggccaggctagagccctggtcaatgacgatctaatattccaaatctctgctgtgacccaaccctggaggctgaatcagactgcaatccatttagctcaaactcgttttaaagcaattcactatttaacaagttctgaggcgccatgcttttgcaggcaatatgtgaattgaatcatttggtctaatcttagattaatacaaaccaaatccttcagcgaggacagtcttgggagcagctccaggacttcatctcattgtctttgatgaaggcgggtcccaaagaagacctgactctcagccaatggcacgggtgtctgagcgaggaccagggggtggcctgctggggaggaaggagcaagggctttgcggtcagatgacgcttgtttgaatccttctgcctgttcctagccgggtgaccttagacaaactgctgagcctgtctaggctctggtcttccccacagatgcctctgtgcaagacacttgtgcaactagagaactagggtaagaggaatccatgtcatcctctccttgccccacacaggatcttgccaaggcctcccaggatctgcgtctgcgttcagggtaccctggggagcaatagggctgcttggtcctcctcctgtgccttgctgtacctgctgctggttagggagctctggaaagtgctggaaggttttcactcccacctgctctttgaggagcacctacttcttcctgacgtctaggctttgacaggaaaggaaccacatttttacccccttctgtgagccccacagccctgcccttggacatcagcgtagcacactcaggccctgcttctgctgacagatctgccctccaggctgcaggcccctgctcaggtgctgccctaccccactgacagtcctgggcttgcagtccaggtaagtcaaagtccctccctggtgctgtcaccccaaatctggaagagagagactttcctgcctcttgggtcacagccggaagaaggggactctggctacgtgccacatgaagtcagcccaactgtagtgggagagaaacagcgcagggaaggcatacagagaggagaaatggagacatgggatggtgagcgggtcagagccaaagttctagtcctgagcctgcacttgagccatcagttctcagagcaatcctgagtccttcctggaaatctgcttcaatacacagagtctggaccagtggagaagggcagcgccataaaatcacagggcctttgcttcaaaggcaaggccatctgccagccgctcactgtgggtcccttaggggagattctgcagaactgtgtgtggagtcatgcactcggcccctgcagcttcaccccgcatgcgggacgcggatgagagagctggggaggggcccgccgtcctctcccgtggcggcccctctgctttgcatcccttttgtccacctggccaattccctctcaccttttttggctcagcacaaatgtcacttcctcttaggtgactttgctgaccttgaatgaaaaggggacacttcatcctccgggctgatcctgccccctcggtactctgcccttagcaacagggctctttgatttggtctcgtgtgtttgcccggcatgtacacgctctctatctctctcctctacgagactgggggaggctggaggacaagagctcaaggcaggcacagagcagacagcagtgaaaagttactcacatgggatctggtcccacacgttccttggatgtccaagctacggcccagctggtccaggatgccccgttctggaggctgtgactgccccccccaaccccagcctgcccccagttctgcctctcacctgctcctgtcccctcattgcttgaggatagcattaaaccctcatcttctaggtggattttcccttcccttctatgagctcttttcttccatcagctttataccctggacacattttaaaaactgttcatctttgtcgtgggtacatcagatacaagcaagagtgataaaccaagcaccaacaaaatctatgttctctctgattgcctttgtgtagacagccacttccctagcggcagagagatgggcccagtggagtctctggggccagccacaggggctgtggtggtgtggaggccaccacagccagcctaacgtggtgctctctgacccctaccggtggcctggctgctaggactggggcagggctgtttgcagaggaggtagcagagggaccctcataaaagaggattatagatggagatttgctggtaaacacccctgtctgccgcccccgcgggtattatccttgcattagagaaggttttagggaagagaggggaggggagctcaggaatgagctttgccatcacaggcacagaaggctctggggaatcttccctggttgattcaggcctgcccaggtagaacaacaggtgccaaccttcaagcatacggactccccaagtcctcatcccttgaagccctgactcccccagatcgtggcccctggggtcccaagctcccagtgtctttgccaaacatctctgaactggaccctaacccatgttctctagcgtgggagcatcggtataactttctgccattgctgtgctgtccaatgtggtagccctcggccacatgtggctgttgagcacttgaaatgtggctgctgcaactgaggaactgaagctttgattggatttaattttacttcatttaaatttgaattcgaacagccgcagtgactagtggctgccaagttagatagcccagctttaaagacacctgttgagcaatgccaaggatgtcttttccagtgatccatgaaattagatgctggcctcacattttcccagaatgggaggtcaacagcaagccctggcttctgggggttccctgcctccttgtgggaggtggacccaaggaaacagcataaaaggggcttccctagaaaaggtcttcatggcagaccaactagaagttctagggtcattttgttcctccaggggaaaagggccatgcatgctcatactcaggaccagaaaacaaacatcccaaacgaagtacaattggaaagacatttccagtttcctttgtgtctgtatcatatgcagtccatgatctcccatacgcctgggccatgctccccttccctgccctgcctaagggcgcacaggaaatcacacatattgagcacctgctatgcgaatgtcactagcagtgatttaaaattgggaattttttgaaggacgatataatccacacttgtcccaacctgacaggtcacaggtcagcaagcaatgctccataggccaaatccggcccactacctatttttattttatttttgagacagagtttcactcttgttgcccaggctggagtgcaatggtgtgatctcggctcaccacaacctccgcctcctgggttcaagcaattctcctgcctcagcctcccaaggagctggtatttttattttttattttttgagatggagtctcactctgttgcccaggctggagtgcagtggcataatcttgccttactgcaacctccacctcccaggttcaagcaattcttctgcctcagcctcctgcgtagctgagactacaggtgcatgccatcacgccggctaatttttgtatttttagtagagatggggtttcgccatgttggccaggctggtctggaactcctgacctcaggtgattggcctcccaaagtgctgggattacaggcaggaaccaccacacccggcctaactacctatttttgaacagctgtgaggtaagaatagcttttacattttttttaattgttgaaaaatagccaaaagaagaatactcatgacacttgaaaatcatctgaattcagatttctgtgtccgtggtagtttgattgggatgcatccccaccccattcctcctgccgctcctcccctgccctggcagggacctagtaacccccgaggccacccggctctcaaagctggacacatctgctctctgactcttagcaggaagtctgccagcccacaggatgggtgaggtgaggctgcagaggtgaagagtgaaatgacccgaggcagagtccacatcctccctccacccgtgtgcccactgtctcgctctgatgagtgttcccagcgtctgctcctaggccactgggtcgggggctcctggagggggacctgagctggactccagctgagcggggtcttcggaggcagcacagggaggttgtcctggtgaatggcactgtgtgcggcagagcctataggtgggcacataaggcctcctggggccgggggttcatgtgagcagggacacggggagggctgccctgtggcccgctgtgaccttcaggccccatctgctccccggggctccatgccctaagcatgctctgctcaggacgccttgggtaagttgctgaatcctctgcggcttcccccaggcagggcatgggaggtggaaggaaagggatggagggtgtgtgtgtgtcagacacagagacagggacaggcaagggaaacagagacagggagagacagagagacagagaaagatggagagagatagcaggagagacagagacagatacagaaacggagagagaaataaagacagacggggagagacagatgggggaaatgggagagagacagagagaggacaagacagctgcagagatggagagagagagaaagaaagagactgagaaagagattgagagacagggagagacagagagagaaagaagatgagacagatacagagatagagaaagatagagacggaagaagagagaccaagggacagagacacagagaggcaaggagagagagacagatacagagataggaagagagaaacagatggtgggagtaggtgggggcagaaatctgctgcgtcagatgaggccgtagagagctggccgggaagggaggtgcccacaacataccaacctataagtgatgtgcttccttcttgggccactaagccatcactgcccagccttcaggagccctctttggtgtgggacccccactgcgtttgagggggctctgcggccatgctcccttcagaaacgccactttcttttttgaggcatttactttgagctgaagggagctcttgtttgctgttggtttcccctgtaatttcatctttacttttttataaaaataaataaataaataagccctatagtgtcataaaagcaattttgaatatttaccaaaaaatttttccttgctcaactgccatgttaaggggaagctgccaggccttaattccccaatacaactgattcaaaggttgctttcatctgaaaggtgatgtcctcccaggtttcctataaatacctagttgcttcctttctctctctttttgtgtatacacaaaaataagggaacccacggcatgtactccctcacactcccacacgcgtgtgcacctcacacgcggatttatccacgagccccggaatgtggctccctgcagtgaaaagctcaactggggaaaccccagaggaccctgagagcctgatcaaaaagcgccaggagtttgtacaacacaaatcactacagacaaacttgattgcttttttgattagtggataaagggaatggattcgccacacggcctcatggaatattgtgcaattaatccccaattggcttggtaatgaccttgtcatatggcctggaatctggtgaaaagactgcagagtgagggcggtggtagcagctagagcctggggtcagggctgggctgtagggtggtttgggccaaggggtgaatggaaggggagagggaatctcctgtccttcactggctgcttttcctgctgctgtgcttccctcggcaaaccctgctcatccttaaagcttttgcagcctcctctgatgtccccttccggtgacaatcactgatgagggtgcacactcacggggggtccaaggagcatcccgagggttccattgctgcataagctctcagcccacacagccacccgagagaaaggattagaatcgtacccatggtgcagcctggcaggacaaggactctctgagcccaagtcacacatctcccaccccaggcaggctccacctctcgccgaggccctcacagccaccccggctcatcagcaggggattgccgtgagctgctttccccacttggacagcaaagcgcgactccacacaagtctgctttccttgaaactgaagctcaaccctttaagccctaaatgtagagccatttttcaaggttgttttctagtgtgtattagaagtccttagcgttcagggtgccacgggcaaaacttaaacattgaccgtctctggagtcctttcctgggacctgtgtcctggagctgccagtggggagaactgggatatctttattcaaaaagcctaaggccctgtgccctcaggagcccccattctgagaaggcagatgggtaaattaaccaaataaccaaccattggggtagcccagtgtgctgagccaggcagcatggaaggggtcccattccctgtgggcttcctgagtccctggggctctttgtgtagcttttttctttcctcctctggtactgtttgatgtgatccttgcctattggggatctgccttcagccgcacttcccatccctcccaccatccagggaccacgcttctcatccaaggagaccaggggcatgggattgccacagtggttagaggagtatctaaaaatggagtaaccgggttctggagtgagggcccgagggttcctctgattcaaatgagtgagccttgatgtagaaatggcagtgtttctttcatcttaacttcattttgtttatcggatggttctggggcagttgtgggtaggccagagaggtgttaggaggcttcaggggaaagcgggcctgggccttcctcttcttttgtaggttcacagaggaaacacagttggtgtttgggaaattctcacctctgagtgtggggttcagagatgctgaagcccagtccaggcagacaggcaggcaatcgagggagaagtgatggtgaaaaccaaccacggtcttttcaagtccaagagaaagtagtggacagagaataagacaggtgaagagggaaagtcattgcaaagtctagagaggaatagagtggggaaacagcagatggaaacctcttatttcaaagggacgagagaaacacccctcagccgttgatatctccctccatttggctcatcacatgagtcaaagtaatgaacctgcctgtgagaacatgcaaattccaaaggaaaggagatggtgaatgtcacaggtgggttgcttgttcattgcaaccaaacgcttagacaaaaatgtctagacatgcgtctccttcggcaaggagtgagttatcaaaccaccaaaacaacgaaaacaaaacaccgtgtcttgaaaaccagaaaagtcaagaaagaatattgctttcttaataataaatacatttcatgggcaagaattgcaagggaattgtttaaattaatttccgctttgtatgtttggtttatacagggcttaagtcccagctgacagtgatctgtaaaagttctaacatattgaaatctgattttcttgcagccagaatcgcatagtccaaaatgatttctctgtcaactctgctaatcagacaggcagggctccgatggactcctagttcaaccaaattgcacccgctcttttgggggtgtaaataatagctgatgaaagctttaaagcagagctggtggcatttctctctggagagctggttcaagggtatggggacaacagtgagattaaaatgagcaaggagaggtgggggaggccttttcccacctggcagatgtcctgtgtggctctgaggaactttcctcccctctatgccccaccccttctagagcggatgcagtgggaagccaggggaactctgaagctgatggaagggagatcattccagtctggaatcagaggcaccaaaagaaaagctttgcccctggctttggtgggggcccccatcactgggtgccttgagacttccctctccaaattgatgacctgctcaaggctgggcccctccctcccactcagaccttccagctggattgcaagagggacctgatcaatggttctccttaggcccctttctccatctcaccagcaagcctggcccacggtgcccagctctacacacgcaggcagcaccagagaatcagagcagggcggccttcctcaccaacatgccagccccaatgaccccacccactggtcaactctgctcacctgggtctaggtgatgggcccctgagagccatcccgacccacagtccacccttcctgaccttgactttccacccaccttctccaacctggctctggctgttttccaaaaccaaatccatctgcaaaagatgcaggattacttaacaaatatatgaataaacagtaggcaaagtcaacaagcagggatgcacaagaggccccacaagctctagaagcccatcctgggaagtgccgccccaccctgtcccccctggttgggctcgtaccggccagggccccctggccaggaaaggtctgtagcatgtatgtttcatgtgtttaatgaattctgtaaccatcagccattccctgtaccccaaagggtcttaacctaggctctaggaatgaactacagagtaactccaagcccctaaaattataggaaaatgcatacgtaggtacatttccctggtccttggctgtcctgggttctcgacgcctctatggctcccggagggtaaggccccagctgcccatcgagtctgccggctggtgtgtccccacggggcttcgtaggtgctgtcccagagccttagtcttggagctggagccagacgcagaggtgccctcggtctccctgggccgctgccaggcggctgtggccccttcttgctccttctctgttgcgccgtcttccttccttccttccttccctctttccaactgaattctcgtttttcctctctccctagtgcttgtacggctgctatgtccattcctccatcatccccaccttccaccggaggtgctactggctccttcaggtaggtggctgggactggattcttcttctgtctctggtgctcgggaagggtctgtggagggcactgagggcgcggggctccgcatgcgacacggcttcgggctgagagccctggtgagcttgcctagggagacttcggctgttgcggcactgaggccagctcagtggctgggctggtgttgtcatgtgtcaggaaggggagaaggcctggtggcaggggtagctgtcacccactgatgggaaataaacctaggtgcttccagcttccaaggcgcctcagttttcttttgatgaggacaagaaagaaggccgagtatcctgccctgaaatgcctgttggctgaaagctgtacattcattttctctcatgggttagttacaaggcacatgtggaaaacaggctcccggaggttgccaggcacagctggattgattgggatagctgtggggaaaggaggaaggagctccgtaatcgatttgtgatgtctgctgtggcagggatggaacaggttgtggctgggcatgctagccattcctgtgggagagtggcctggtgcccagatctctgtccatggtgtttgtgcacagcgttgctgaaccaggggtgggtaggtacgggaggcccacctggcctcttgccctctggggatcgtctgccagctgtcttgcctgccgtgtgggcgggaaggtctgagggatccatgcagtcggactagacataggtccttttcaaaatgcatcctctgatttgcagctgttcttggtagaacccattccccatggcctgcctctgtcaccccaagttcttactgttgcctctacccaggagttgctgcctgaggcctttcccaccatggttctactttctgttgttcaaggcagcaaacccctggaccttgatggtttagggatctctctgacctggcgggggtgtagttggaggggcctggcagctggggaagcaagtcccccagtgctatgacacaagctcagggagaaaagagtcacacatgccacggagtgcagagaggctgatggccacaggagagctggtctggaaggtgcccacagggccggagccatgtcgatgtggaggccgggctcagcctagacagggccctctatccatcggctctgcccagccccagcctccaaaccctttccattctccctcagttcccagaaatagccgtctgttgttcagcaagttcaaatgatgcccgagaccatccggggacgtgctgatttgcagaggctgcttcccaatacctcaccctgtcatcagtttccctggctctgcctcccctggaggctgacgtgctagcacctgcttttctaattgctcagacctgtgtgcttgaggaggggagttgtcacatggtcatgggatgaggcttttggggtcttgttactaggaattggtcccaaggtgttccaccccttggcagagggttttctcctctacccgatgaagggtggggttccacccgaggccagagttctggcggctgagtcagagtcagagcatgtccttgagtccccagggacaaactctggcttcccaagaaacaccatttatccaaagcagcctgcagccctgtacactccttcctgggcctccagccccatgggtctggtttctgcccttttccttttcggtttcatgccccctggtcagaacacctctttggccattgccctcctgtcggggcagcacctggaagctggcatcctgccagcagcccagccacccgctcctccaggctggtctgctcctccaggccttttctcctgcacccacgcctccgcctgcctcccctcattccatcatgcccttgtggctttttaattccactaaatttactttcctggaatcagacaccattgggcagccacgaggtctgagctgatgacttcccaagctgcattctgctcattccgggtccctcctagattcagctgctcctgttcctcaactcgggccaagcgaggagaggggtcctgctctctgccccagccctccctcactggcgctcctgttttccagcctccgtatgctggaggcatacctggactgattcatgtgtgtctggttcgttacctcccagctggcggggaagttggagtctccccgaaggccaggatggcaggaccaggcttcttcatggccgagctggggcctcttcatcttctctgcccaagcctgggggagccatccctccccatccctctcctctgtgtcctccagcatcagacttgtttctgtgatcagatcacaaagagggagcgcacacaggtgtagggggttcctgctcccccaggtctgtgcggggcaacagcaggttaaggagctaaggccaaagcaattagcacaatgcacgccctgctcggagcccagagcctatgtggcagccggtgccgctcagggcaatttgttctggtgctaattacaacaccaggataatgatgctgtggccaggtttaatttctctgatgttaaataggaaagaagccatgagttactggctcagatggaaattggctcaagtgtgtctctgacaccaattaccaagaaaaaggattaggtggggtccaaggtgtcagggcagtgcccatgttgggagctgaggaaggaggctgctcagatgccagccccgagccagcctggtcctctgaatgcaggaggcactaggaaagggagtgatgggctggccatgctctctcagccccctgcagggggtgagccttctagaaaggtaagggcattggaggaaagagggaggaaggaaaggaagaagtgcttctggaaaaaggagactttctccaaggaatagcacccactgccccacctttgtagcctcagttcagtggccgcctcctgccggcccactgtgaactcgctcctgccctctgagatgctccagctgatgtcacccaaggccacttagcacttagtgggcacgtctgcctatgttggcctcgattttcctctccaactagtcagctcccaagggagagacatgaattcctgtctcccctgagtgcccagcccagagccacagccaccacagggcaggagccagcatttgggagagccatgttctgctgtggtgacgtatccaccccggggcgggaatgagcaggcctcgcagactcggggcctggagctcaggattggtgccaagatttacagagaagggcctgagttgacgtggcacgtaagcttctgagtcatcgggctttcaggggagggtgctacctctctgtctgtgtctgtctgtctgtctttcaggctctctgtctctctctgcgtctctctctgtcatgttctccctccccatctctccattgctgacaaatattctattaggctatgagcgaggagacgggcagggagcctctcacaggcagggcactagagcccatgtggcccataggctcataaagccattggcatgaccagtaaccaccatgtgaggtcaccaggacagctggggagggaccagatgacctgagctcagcccactccagctgggcagggccagagccatgacctggaagaggccacctcttcccctctgctggtggcacccatcctcagcattgctgggggctctgtgtcacagctgacagggccttcaggctcccctgagcctacccagtgcattttctagaaggatttctgagacccagcgagagcagggccaggcccaggtcacccagtgggtcaggggaggagcaggcagtgctccgttctcccgatgccttggcctctgcccctaccgcctgatgtgggtgtcactgcagccgcaggaccctgagcctcgtgaggtagaggaggcatgaaggggtgagctggacagagcggtccctcctgtttgggattttctgatggtttcgaggggtaggcagcagaggttcagggccccctgacctcctcatgtgcccctttctcctggtcctccaccttccgtccttctctgcattctccgcctgcccccgcaggggaccaggcccccattccaggccagacttccctgcagattctgtatggctcatttggaaactatttctgcttctaatgagtgttttcctttgtgcccttgtcctctaaaatgcttaatgactgctttccgtgctcgagtgaagcgggggtgtgtccccgcatggctgccattgccaggccggagctgtttggctgccaagcccggcttgcttgggtggaggcagcggggggtccttcctggcccacgctggcagcacagaccaagcctgtgggggcaagagcacggctgcggggagacgaggaccctggggccttaggagaccacaggacagggtggcagtgcaggtcggggctcccacatcactggaacaggcagatctttgagcctgagttctaggagttgagctccttgggggactctggattcagagtctgaggagctggattccagctctgcctggacctacctgagcaccaggagcggtgaccatgccactggacacctctggtgctgactcctggctgggcagtgagcctccaccacgcaccacacttcacctgggagaaaacagcctccgagaagctccacagttgctcagtcaatagggggcaaccatcgctgccctccgctgcctcccctgggggcaccaccatcacccctgtttatagatgaggcatttgagaatcagagagattgggcaccttgtagcagatcacggaagtggccagaaagtgggacagctgctgggccctcagcctggatgctgtctgcttgctgcccccacatgagcctttgccagccctgggtccccctagaagtagtgggtgcagggcacaggggtgccatcaccccctagagcaggcaccgtgagactaagcaccacaggcattgtggccagaacagagcccagccacagcagcctctgtggctggtgctgctgagtggggactcggggcggggacaatgccagttcaccatggggttcactccaggcggtcctggccccaaagggcccccatgtccaggagcgaagttgcctttacctgggactcaccaccccccaggagaggaagaagatgccttctccatggggctgcctctgggcaggatccaggcttccccacaaggcctggggctctgaaaccaggttcacaggggagagatgaagctccagatccccaaatcagtgggccttccatccccagagtggtcagctgcttgtccaccctggggctgagagcagggtttcctagggtagttcccagagaggggagaagggcaaggctgcagggagaggccctaggggagatgccccggttccactcctgccccaggccatctgccctccatgggagccctgcagagttagccagaacatggatctctccagccagagcaggtcccattggcatacttggccttttggcccataggaggaacagctggggctggggcagctccatggcagagggaccggcagtcctagagcccaggctcggggctcccccaaggaggaggaggaggacaagtggcctctccaggctgctacagcctctggagttccatactcaggccctagagaagccacttctgctccttgttcaggagaccttgcagccaacagccttttcagcctctgccccagacacaggccctataggcctcagcccaggcatgcccccagggagtcctcccttcatgctgcagccctcaagaggggccgtggggccccctcactgctgaagaatcttttcagagggacaggccctgcaggtccctgagggcaactgagtcccaggcacccccagccaacagagaagagagtaggccgtgagccctcctggcccagctccagggaccgtggcacctcatggtgggtctgagatgagcccagctccacactggggcattagtgtagtttttctccactgacgccggaacctggctgtggaacgcgatggcctctctgagccgactgcctctggctccccaggaagggtcctcaggatgtgtctcttctgggagcaccaaagcgtgctgctgtgtcaggtctaggcatcctgcagggtccctgaaccccagcccctgcctgctgcaaccacacaggaggctgcccttccggggccacccccctggacactgggtgagtggatgggcaccatcagccctctgtgtggggtggggtttagacccgtcaaatagtggggttaggatcacccaaagaagcacctattagctgtgtgacactgggcagtttgtctaatttctccgagtctcagttagctcatccataaaatggagccaacagcaaagaagcagctattagctgtgtgactctgggcagtttgtctaatgtctctgagtctcagttagctcatccataaaatggagccaacagcaaagaagcagctattggctgtgtgaatctgggcagtctgtctattttctctgagtctcagtttgctcatccataaaatggagccaacagcagcatggaatacagaggctgttggaggagtggaagtctgcattgatgccgtgcataaaatgtcacccagtccctggcacagggcaagcatccacgaatgatagcttgatgctgccagcaccaggtagacctgtaagtggacatcctgaatcccggagaaagcgtctgtgacatccccaccccatccctagcatcccacctctgcattctctctcccagaggcgttgagctaggctgagccagcccctcccaaagcctgagccaggcaggagccccgctggtacaggcagcctctctacccttcataccaccctcttctgcagcccggacagagaagggagcagaggctacaccagggtggtgctgtcattgcaataaatgtcccttagccacccaagagacttgatgtctatttggagaatgagcagctctttggcaacccaagtgtctccccagaagtgcagcctctccccgcaccccactccaggaccatgccctgcagccctcaggaaggactgccctggcggtgagctgtgagctcggtcatggaagggactgcaggccaagtgggacaccctgaagagtatggccgcgctcgcccctcagcccgtggcctcctcctggtggtggggacctctccacccggatgagctgggctcttccctggcaggccatctctaggaagcacaagctagcttaacaggatatcatttctttctttctttttctttcttcttttttaaaaatctttcttaaaatggagaatattatagcttcataaaaaatacctgagctttttgctcagcaaccatttttatgtttcatcagggtgaaatagaaatggcttggaaataaagcctgacggcactggctctgtacctgggccttctactgccatctatcgctggggcagggctccacggctcccaccaaatgaggcttggcgggggggattagagcaacaggaggccttgctgtcaggctgacactctgccccaaagaggacatttggacccatgtgcttcaaggaaaggaagcaagtcgctccctgaggggtcctggcctccacatctgggctcagcagggaggggaaggtgtcccaggcctgccagaccctctgcgcaccatcccgcagcccagccctggtatctttggtgttataagcaccctgtgttaccttcagccaccaagagtggggacgtggctgatgccgaggtgcccctatacacgctcaccaccgtgcatggctcaggagaccacagccctggccgtgcgtgacggccactgagcgcttgatcagaaacttcaaggcctggcttttggttctcacagctaccctgggaaggaaacagggcaggggtgagttcgtcccagtgtttcatagaagaagaaactgagggtcaggaagagaataaggggctccaaaagacatagggtaggcagggccctggtccaggccctttaaacagacgtggtccctgtcctgggggagcccacaggccacagcggccaggcccaaggtgcacacatgtgcagtgagcagagatgagaaggaagagcagcttccagagcctggatgtgctggcctcacagggaccagtcctgatgccaagaagggcaagagaaaggttgaccgaccctgacataaaccccaagtttcccctgccctggcccttggcgtccctgtgaggctggggtctgatgggacctttcttccacacctttggccgccacagctgagctgaccatgggcacactccagagcacttggacctcggcaggggacactgagccagcccgctgtactccaaggggtagctggaacttggcagcagagacaggagtggccaggccctgacatttgggcccttggatccttgcatggacagcagatggaggaccctgtggtgtcaaagccatttctgaccctagcctagttggtggtccctaaagctggtcaagacggtggatccagagaaggagacacagaatgggcggggcggtcaggggaggcttcctggaggaggtgagcccaaagttgaaggatggaagaaatggggagggggtgtttccatgccctctgacatggggcaagcatgggtcacagtgctaagtgctcagtgagactaacaaggccacttgaggggtcccagttcccatgagccagttccacacacctcacccggcacagggctgtctgggaagaggccctcaggacaggtgtcccagcaccggtgccagccaggtgatctggaggggagcatggggaagggcctggaatcctcctgactctctgctgggctcagaagagagcaggacaggaagagcctcaccagaccagtgcatgcagcttcaacatggccatgcaagctccccacagctgacagtgacagcagtggccatcctcatcctcatcctgtcaccagtagcaataacaacagtcatcgaaggctgcgggcaagcactcagcctgcctgtgaggccagcatttagtcactgtcaccatgtggaaaggaggctgggtctgtgcttcaggtcaggcctccgcagcccccgccatgcagagggaaggctggctgaagacccagacactggctcgcttcacagaccttgcaggaaagacaagaccccagcagacgcttgcgccattagataattaggagaagggcaagggggtgtgagggaggccagggctccagcggtgccccaggtaggaggaaaccctggcaggagtgaccatggtgacactgagaaactcactcagtccagaagctgcgggccagggatagaaacccagccctggtcttagaagccgcctcgaaagcttcatctggactagtaaacggcaaagccctcctgcagctggggaggggcgggttttggaaaagagagttgaggatgaaaggttgtgtcagccagagggttcctaagctgcctcctgggtctggcttcattctagctggcagcttccacatctttctccatttaatgtcccttgaataacgtgacgaggagataaggtagacactgggaatttacggtgctgtgcaaaaaattgctcaattccattaagatttcaggacccttgccaaggctgcacggcagagcggacagtatttcccgctcagacatctttgcctgattgcagtttacgatgccaaggccactgctgtacccacctaaagcctccagaaaatatggcagagctcccaaaacggccattatcctctctgagaaaagtcactgggcattttctagaagattccctcttcccgattccttccttcacccctccccgcctctggggactgggcgacaggaggacatccagtcggctttctcagagggtccccttgcaggccccattgctcacccttcaccttgcagactgcggcggccaacgtctgctatgtggccagagccctctggggaggggcaccctctgctcccgccgtgtggacgagtgggtactgagtacaggggagacctcggggcatcaggaaagtcttcctcctggccacctatgtgggaccaccagagccaaaggttttgaattcatcaccacccttatgagccaagtgactctggccaactgaatcaacttctttgaaccttatttcctttttggtaaaataaaataaaatacctccctcctgagctgaatgggaagatgaattgagctaagacacacagaggtcttttggactcggcagccccctgggaagtggtggctgttttcaccccaccaggaccctttccagcagcttttactctaggggattggacgggtggaatagcagtggtcggggaagggggtcccctgagaaggtcctatccaacccagtttgcaaatggcaaaatgctaggcttgtgagatgcaactgtgattaggaacaaaactcacttgttccgcagcctcaggcgggaatctggtgtctggctgagtgagatggaagctctgccttctggcacttgtctcctgtgtgccaccctccccgagcctctctgctccacaccatcccctgtgactgccaccaggacctctcctggcctggcctgccgacgctcctctgtccctcagcccttagggactgggctgcccaggcttgactgggagagaggaaggatgaagcttccggagccgcagttccttagagatggaaattattaattagtcttattatccagaacttgtcagtctcttaatccttccgtcggcagaggggtttatgcctccacagcgtgtgctgtcagcttggctaaacaatcgcttttcatatacagccagaacaatgggcaatacagtttggttactatctttatcaagccaaacaattcctgccccctctaagaacatccttcaaagatgtggagaatgcagaagctgcttaatttcccttctagatggcttataatatggggcttttgtttaattatccttttcatgtaatcttcagctgacattgtgtccttaatattctaatctcctttggagcaaaggggagactgtagtttccaaagcaaaagacaaaactttgcctcaaggaaacactttctcttttgcctctgacgtgattcaaagggcaaagagtgaaatccagacgtagtgggacagaatgcagtggaagacgtgggcggtgggtgacccactctgcgtgtggacgtcagcagcttgctgggcctccagctgcacccagctggtgatgttggtctgtgtgggcgtgtcagagactctagctcaacaaggaagtcccatgacatggtgtcatcactgcttttagcaccattaatatttcagtggctctcgggatgcaggttgtatattcccacgggagacacaccacctgcttcggactcctggcaaatggttttgcctagacaggtgaagacaggtgcgcccaggtacccacaggtgcacacagctgtacacaggcgtcactgcgccacaagcctcccctctcagttctcctgccttcatgctggagtaaggatctggggtgggggtggtacctgaaggaggcttcttgccatccccatcaccaccccaaaatgggcaggacgtcctgggggattttatgctctttttccagacatgccagggtccctgtaggtgatggggaatattaacagagctgtcctctcactccacctggctgctgggagaaggcagccatgagcccagggtgtgtcttccccaggcctcattgggctgtcatgtgagatgcgctggtgctggcgagcctcctgcccagcccagctcagcctagctcagctcagcagcatcccaagcctgaagcctctggaacctaggccacctcccagcatgcagagccatcctgcctcatgtctttctttgctgttcctgcaattctgcctctctacctagtcccttatctgcttctgccagagcagccccactggctggcagccaccgaacccacatagccaagtgctcctgtgggttcagcttcccttcagctcagtgttctgcacccctagaagatatatgtgtgtgtgcatgtgtgtgaatgtgtatatgtgtgtatgagtgtatgtcagtgtgtgagtacacaagtgtgtatatatgtgaatgtatgtgcatgtgtgtgaatgcttgtgtatgactctgagtgcatgtgtatgtccatgtgtgagtccgtatgagtgtgtttgtgtgagtgcatgtgtccgtgtgtgtgcctgtgtgtgagagcgtgtgtgtgtgtgtgagtatgtgtgtgtgagcgcctgtgtccgtgtgggtgcatgtgtgtgtgcttgtgtctcagtgcatgtgtgtgcatgtgtgtgagtgcatgtgtgtacgtgtgtgtgagtgcatgtgtccgtgtgtgtgcatgtgtgtatgtgtgtgagtgcatctgtgtatgagtgcgtgtgtgtatgagtgcatttgtaagtgtgtgtgtgtatgagtgcatgtatatgtgcatgtgtgtgtttgtgcatgtgtgtgagtgcctgcatgtgcgtatatgagagtgtgtgtgtgtgtgtgtgtgagagagagagacagagagagatatcctcgcccctagttcccctctcctcctcttctccccctgctccttccagctttccttctcctccaggccccgatgaggctcttggagaggtcactaatgacctctgccttgctataccagaaggtcactgtgccatcgtcatgtttcctggcctcccagcagcacctcttcaggcggccattccctccttatgaacgctccctgctgccgagacttcccggctatctccctcctttctgttcttggcaatccctcttgctcaaccccccgatgctggactatccctgagctgctgaggccttctcttctctgtctacactttctcctgggatcatctcatccagccccacggccccagtgccaactgtatgctagtgactcccacgttcatatctatgtcctgcctcactgctctgcaccagatttttacccgactcaacatcctctcttaatgcagaatctgcatctccaacttctcacggctagagcaggactcatgatgatttcctccctgaactgctcttcctcctgccttagagcatcgatggctcgccgtcatgcagaggctcaagccaaccctccattatgcccctctttccctcactgcctctttcctgctcagaaatatgtcctgaacccacctccttctctccctctcttctgcttcccaaccctaagccacggctccctcctacccagagctggagtccctccttcttagcctgtgctgcactctccacaaagcggtgggggcagccacttaaatcccaaatcagatcacatcacccttatgcttcaggcagttcaagaagtctccacggcacttaatgtccaaaaccttaccgtgacctctgaagacctgtacccttgaccttggtcttcctctccctgctcactctccagccatactggcttctttctctcctcaaagagtcaggtcctttcgtgcctcagggcctttgcacatgctcctccctctgactggaggctgccctggaccttccatggttcacactaagattcaggtctcctttcaactttcaactccacatcaaagccctcttgacactccatctactgttccctcactctctggcaagcccttctgttcctccctccccagcattttatgatgaaatgtttatgatatacagaaaagttgagagaattgtacacacacccgtacagctgccacccagattctgccgttaacatttgaccatatcatttgatcacttacgtgttccacctatccagcaatttttcgaggatttcaaagtaagcaacagccacagcacacctcccccaagtctttcaaggtgcatagcattaaccaaagttcaatatttgcatacagttcttttttttttttgcttttgaagtaaagtttatacactgtgaaacaattgaatgcatacatgttaagtgcactagttgatgagttttgatcgatgcgtgcgtcagtcataccctaagcccacatcaagatttggaacatcgccatcaccccagaaagtacccatgtgtccctttgcagtcaatacccacttcacccccagaggccaccactgttctgatttctccactataggttcattttttctgttctagaacttcgtagaactggaatcctgcagtatatgcactcaggtatatacttggcttctttcactccacatcgtattttgccattcatcatgttgctactgcctactgtgttatttatgccttgtctatccccccaagcccagccccatccttcaagcataagctccacagggtcaggggcatgatctgttttgttcactgctacatttggagtgcctggagccatgcctagcacataagtacttgtttattggataggtgtgaatggtgtccatccatccagcaccgggcttcctgagggcagggccaggtcactacttcctggggtttctcctaggctctcccacagctgcccctaggtccagctgtgccccacgagcacaagcgtcagcactcggtaaagacaccagaatggatgcgctctccacgcagtgtgtccccacctccctccatcctcctgaagagggagaagacatgctctttagagatacagtttaaactggccttagcttgggcagaactaaagcatcagagagcctttggaatgcccagaaagggtgaccctggtgacaccaggcatgagaattctctgtgagcttagcttggaggattgagaaggaaattcggggcagaaacgtttgttgatcctgaattgctaaaaggtttcttagtttggagaccaagttctcagaaaaacactgtcggttccaaagaaatgagctcccatggggtctcattttgccctatctgtgccctcagtttctctgcagcagaggaggtggcattggggtgcaggcgtctcctgtggaaagtccccagctcaggtccctgatgcaggggctctgtcaacacctcctctcagtcagagtgatgtgagctgtaaatgtgcccaggccccaccccatgtcatcccagggtgagcctggagccagtgccagccaactggggccacctctacagcctgagagggctgcagaactccagacaggaggctgagccaacccctctgcattcaatatgtctcagcctctctcaggaagctgggccccagcagcccgaggtcaagggggaatccttcagccccctgcaggctcaggacatatttgagagcaggaaagaggcagtgagggaaagagaggcatgaaggagggttgcatggatggagatttgtcattgcagtcagaccggaggaagagagctcagggaggaaatcaggagtcctgcttcagccacgagaagtttaagatgcaaattctgcattaagaagggatgttgagttcaatctaaaatctggtgcagagcagcccgtggcagcgacaagaagccaccacggccagagactgcagtctgggagcctgggccggagggagaccctcagctcggggagctcttctccccaccctgaggaagggcagagacaaggaatgcagccccctcagatcgcagccaaagccactgggaagaagcaagttcccttcctttcctggggagaactgtaaaagcctctgggcagggagatcagccaggaaccagagcaggggctggaggattcccccttgacctcaggctgccggggcccagcgtcctgagggaggctgagagctggcatcttgctgaccccaggacagggcagtagcccagggcggggagcagggggttgcagaacagagtctcgtcccaccctggggagggaaacctcaccttcctgcagcctcctgctgactggaggactcctcaggtgcacagggagctggagaacgcagcccacaggccgtggcaggaccccaggggtggctcctggagtcggccagcccctgacctggctcccgtgagcagcctgagctccacacacctcctgggcctgttccctcctggggcagaggacctttctatcatttttattcccactttgacccttggccagggagactgggggagccccaccttggccctgcacttactaccctcgtaggtaggaagtgctcacttcattatgggctaaaatattgtagacccagcattcactctgagcctcaccaagcaagagacataaaacacagccacttgcagaccgtggcctggggccgcagggccatcaccagctcatcccagggcagacccggtgtgggtaggtgggtgagtacctggcacagaggggggcccacctcaggtccgccttccctcggggggctcaccagcctgactcaggctggcccccagtcccaggagactgagcctctccccaggaggcctggaaagggttgtcctgatgcagccgcaaggtcaggccctgggtgttcacactgacctgggttctaatcccccttcttcaaccacgtggagctgtgtcacctcgggctaattaacccaaaaccaggggctcagtttcctcatccgcagaatttttaaagcactttgcacagggtcggacatagaccagcattcagataacaatcgtggccgggcacggtggctcacgcctgtaatcccagcactttgggaggccaaggcaggtggatcacaaggtcaggagatcaagaccatcctggctaacacggtgaaatcccgtctctactaaaaatataaaaaattagccaggcatggtggtggacacctgtagtcccaactactcaggaggctgaggcaggagaatggcatgaacctgggaggcggagcttgcagtgagctgagatcgcaccactgcactccaacctgggcgacagagcgagactatgtctcagaaaaaaaaaaaatcgtggctgttgtcatgaccgttgtgttgttacaaaaccacgtgataacccctgatagagccgcccgtgctgagctgggcccacaaagaccccgtcctaggctctctcccctctctggccatcagttgagttgtacactgtgacccaccaggccactgcttccagcattcacagccaaagaccttggccaagcaccggcccacgctcaccatgggccatgcctgccctggtgactctgggaatgtccccagagctgcccggacctggatccagccccttctgttgcctccaaaaggcttggattcagaattccacaggaggatcttctctggctgcccatccccagtcccccaccctttcctggccaatggcctccctgtgtcccctgatgtctgagcctgaaagccacggcccttgtgcgcgcattacatagctgcagttgccagttgtcacccatgtctccatcgtgcctcgtctctcagggtgtgtcagagcagtcactcccactgccttaggggagacaagaaggaagccccatcccaccaccctcctgacagccactcgtgctccctgccacatgctgctctcagctccctgggatcagctgcctttgggggcagctggggaaggtgaaagggtttggtcatggagcctcttctgccaaagccataattctgaacttggagtagtatgggcagtgccgggctgagagccacagcagagagagtgcagcatgcttggggtttggggctgacgttccttgccagagtcactggcaggatcttctgctgctgggaccctgccaggctctgggcccctgggtgagtccaggagagcccctcccactgagtcacaatgactctgccccttccccaccaggcgaggcaggacttcagaaaccatccggcccagtgccttgctttgcatgggaaagctgtcacctagggcaggccaatgacttatccagggacacccagtgacttagcagaagagctgggcttgaaccccaacttcctgactgcatggctgggctctttctgagacttccctctcaatagagatggtgggcaacccacagcacttttaacactccagaccagcttctcaggccaccccggcatgcacctcagccgccagctgttggtgtctgatcagagagtgcacgctcacaacattagcccaagttgagcttaattagataaaagatcattctactgccagaaacagaccatgctttcccagctccagaagtgacgtttgcatataactgctgtttgagatgatgattgcctctttcaggaagagacatgcaactgctcctcaattcggtgtgacagtttgcagaatggccagattttcgtaggtgttcagattttgtcctgcaaagcagtggtatgctggaaatgcctaacagttggctctccaggagaaagaaaaaatttctgattggtaacgtttgccaatttctatggtgtaaataccaccactgtagctgtcttcaagctaccaacatgatatcatgatatccattgcaaaattctcaaaaatgtaccaggctgctttcatgagccagtacaggccagctccaacaacccagtcttgtattgcctctgcacatccaacctcctaggacctgtttgggcctctctacttctggccaagactgataatgctcatgccttaaggaatgaaaggcagggtctccctcttgagcctcccctggggcaagtcatctgtcgccatggagacttccaaggctgacgggggcctgctttaggcctctgagacctgacttccagggtggtctctgtcccctgttgctacagctcagctcctccagacctaaggcttagctaatctcaggctccctgtctgtcctgtgtccgggatgacccaagtgcatctttcatcagggtcatggcagtgccgctgttgggttccactttgatggtcaaaatgacactctgggtgaaccttgtctttcctccctggagctccatctccccaaggcaggatctgagggaaggtcctgcctctgaaagccctgtgagcaaccccctggatacagaagcggcggcttccccagtctgccctcccagcacacccaagctctacccctgacttctctagggaagtggcttaacctcagcctctctgggcctcagcttcctcacctgtacaacagaaatgagaatagcacctgactcaagggttgttgggaggggaaaaatccctaacaaatgtgaagcacttagcgtgatacacggcacatagtagatgctcaatgagcacagatgctcctgataggaggggctcctttctgacccgcagctggtctgtctcccatctatgcgtctcgtgttcctccctcctgtagcaagtgcatgaaggcccctccacggttatcggctactcttcaagctcctcagttaaccatggagcaaagagttgtggccaccaagagggaactaagaaggcagcactttggggtaagaaacctttactcagggtcaagccccaccccagctctggggccatgcccagctacaccaaagctttaaggcaaagggaaaaatcagtcagactgaccctgtctttatttaaaatgttgatattttgttcatcaaggattcttggattaattttgatattttaaagtattgcactgcagtggcatttgtcttgatggctgagtgtttgggcacctcttgagatttccaccctagtgccagctctgtctggacgtccatggaggacctgcccgtgctctctagcatcccattcagatgctggacctgctgcagcctgcaggtgaggctgaggctgaggatgcggtgtcttctcagctctctggtcccgcacagggcctggcttacagcaggtgctcagttcttgactgaagagcagagggacaagactgcaagaaactgagtgtccccaaaggctgcactttccagagcattcttatcgccccccagaggaagggatcccaggcccttgtctgtccttcaccctgatctcctccatccccttcccctctgtccaggttctttgctgtttctgctgagcccctcggttgctcacgtcacagctctgcctcaggaccccaggccctgctgggagcatcttagccattccccggagtggtgtcgtttgccgccacctcccacacagcctctcaggaaaagcctgcctgcctttggagccaggctctcccttccctttctctgagactcctcccatctactctctgcagtctctctggaatcttgctagagtctctctgggtctctctagaacctctctagaatctctctaaaatctctctggagcctttctggaatctccctctagaatctctctgcaatctctctagaatctctctaggtgcttgatcccaggagctctcaggtgaccagagcctttccagcagcagcgcctggacagggggctggagcagctgtgaggctgggccaagtgtgggtgctcctggtaggatgtgggatggaggcctggagtggccagggatggctccagaccctggtgtctggcaccccactggctccaaggagtcctcattacccccagcttcgctcctggagccccaaggagcaaagggaccctgagaggggctgggatcagggacaacaactcagcctatttctgcccatcccatcacacacacacaatacacacacacgcacatacacacacatgtacacacaatacacatgcacacacatacatctgtacacatgcatgcacatacatctgtacacatgtgtacacatacatgcatgatacatgtaacacatacacatacaatatacatatacatataagcacatatgtgcacacatataaacacttgcatacacacacatatacacataaatatatacatatgcatacatacccatagtacacataaatgtacacatatatacacatacatgtacatatgcacatgcttgtaatttgcaatataaatacacacatgtaatacaaatatgtaccttaacatcacacacatatgcacatgatatacacatacatatatacacacaatacacattgcagacgtgtacatatgtacatttatacacacatgcatacccatgcacacgtcacacacaatacacattcacacatacacatatacatacaagcacacacacacacacgctgccacccccagcgccacatgggctctgacatttctgcaaagagggacacagagcctctgggtaaatctgagctctccccacctcagtcaccttcggcaacagctaccacactccgtggcctcacatgcaagaaaaccaggatggctattatttggggcctcctttgccacaggtgggccctggcctgggaaggggggccatgatgcctgccgccccctagacacactcccatttgtttctgtcccccgtttccagatgctgaaaaagattcaacaacctagataaggccctctataggaccttccagaagagctcaaatcaaatcacagccaagagatctttcgagggtctttgcaggggaaggaaacagctgtcagggcaaggcatggctgatttgaggcagctctttagagagaggctgtgtttggagaagatgtgtgccattggcatgcagggcactggggctcccggcgagcctctgcatctcgttctccaggtgtcggaggaactcactccttaggcatccatgcgtgttaggggtcaggtagtatgccaggtgctagggttgcaggggtgatccagcccttaggaagctcacagtctaggcaggtggagactcacaagggacctggtggcaagttatttggaatgcaaagcattgcgcagaatttatccatttggtaaatacacactcgttaaagtggcacgcatccagcctccccaccctcctgaggctgtagtggtggaggcgatcctcattcctttcctgtccagccctccacaacccctggcccggagcagttcccatgccaggggccttcggccagcatcccatgacctagacgagggtgggacatgtccgtccccactcctccatgtctggccccgagcagacggggtgactggctactggcatcatcagcttgcttctggctgctcagcagatggggtgactttcagcggttacgggagggcacttggatccccgaggaaatgttccacgccgggatattggatctcacaggcctgctctgtggtgacgtcctgaaggtgaagccctccgcggcagcctctgcttcagggtgactgctttctgctacaggagtgactcgggcatcctagttaatgttgcagagtacgataggagcaaatagctcttctccccacatccaggaccagcctgtcctctgggtgaatctggtgctgagcttcccttgctatgcctcctcgcatgggattgcaccgtgcacaatgtggagatgtgctttccataagagatgcagttaggaatgtgcggtcactgccgcgggcatcgattgcccagaacacaacagtgagccctccataaagtcggaactgtcattatcaaaagcagtgattggccgggcgcgatggctcatgcctgtaatcccagcactttgggaggccgaggcaggcggttcacctgaggtcaggagttcgagaccagcctggccaacatggcaaaaccccgtctctactaaaaatacaaaaattagccgggcgtagtggcacgtgcctgcaatcctagctactcgggaggctgaggccggagaatcgcttgaacccaggaggcggaggttgcggtgagccgagattgtgccactgcactccagcctgggtgacgagagcgaaactccatctcaaaaaaaaaaagtgacaaagcagcccctctgccagggagtggccagtgtgacctgaggccttggcacccagccaccgtgcgttaccttttgaggtctgtgctagaaggtgctgctgccgcaggagtcctctgactgggttgtcaggccgagatcctctccttgatgcagaaagtgggaggtgctttcctctctcaggcaggatgctctttcctgggaagactttgggcctccaggctgaggacataaccccaaagcagtttaggacttctggcttcggtagcaaagatatttccttctgtgcttgtctcttccccactccagctccgatccattgactcagcttttgttctgtgaatgtcattttctttgaatttgtgtgagttttgttgtttgcaaataacctaatgaaactccttctgttcccttccaaaacaaaaaggaggctctagcatggtctacctccacatctgaactcctccaagcttttctgatggtgtttgggctgtacagcaccctgagagaccacccccggcctccatgtaccccctgccatcacctgagccgcactcaccaaggcagagccgggaggactccacccaccctctttcctgttcataaggtttctcaaggagcctcttgatgcttgtttacttaaggacgggcacgggtgaactctcacccccacctggtgatttcacaaacacaaaccatagaggggaaggctatttctctcactttctggaaaaggccaaaactaaccctgaatccccccgcccatgtttagagtagacacagagggaagatggttccggaatgttctgcgtgtactgccgattgtccaattgcttaaaacagggcttggcgtgcattgttttggtcattagttaaccaatctgggcggggaaaaaggcagagcgttaaataattacaagcacttcggtgatttttttttctactgactaaggttaaaatgaatagtgttgatccgttgcccaggcagcaggcttgttaaaggaaatggtatttaaaatgatttttgagccaaagcaatttggctgcttcaaggcatcctttatcttttgctttcaagaggataataatgtttaaaaacgaagtcactcataccatttcctgtcgcgaagccagctcagtgatgggcagagcttcctctgggtttgtttacttgctccatgatggaaaatgcaaacttaatgggctcccttctgccgaggctttggtgttccgacgaaacaaagacccatgctgctgccgaatctgtgtccacagctctggccagctcaccctggaagtcttgattgccacattgtggatgtcagaatgtcacctgcttggttagagcttctaaacaggaggctcaaggccactccctggctctagggtggagtcgaggaaacctgtctaggatgggacacgctcccactaggctcagggtgccctcccgtccaagagcatgatggtcaccccagctgggaagttgctaagcaagtcctccttggtagagcgtctttcccatcatcctctgcgaggaaggccagggcgatacactcagcttatagagtgaagtcggcagaaagcacaacttctcagtgaagaggataaaaggaaggcactacgggggcccaggacctgctctgccctgcttagggctgggcagggcttacgggcgtgacatgcatagaggctcagaagagctggctccggccttttgcagtctgggatcctcagctggggtgtgcacatgagcaagggtgctctatgcccctgccaccagcccccgggctgctcaggaggcagcagtgaaggatggaaagggtttccatggccatgaaagagagagagctcatccgctcctgcatagcactgtgagggcttgaacacacacacgcacgcacatacaaacgcaaacctacatacacacacgcgtgcacacacacacacaaatgtacatacacgcgcacacaaacacatacaatcacacaaacacaaacatacgaacacacacacacaaacacaaacctacaaacacacacgcaggcacacacacaaacacaaacctacatacacacacgcgcgcacacacacacaaacctacatacacaagtgcacacacaaacacaaacctacgtatacacatgcgcgcacagacacacaaacatacaaacacgcacacgcacaaacacaaacctacaaacacacgcgcacatgcacaaacacaaacctacatacacacgtgcacacacacaaacctgcaaacacacacgcacgcacacataaacacagacttacatacacatgcgctcaaacacaaacatacaaacgcgcacacaaacacaaacctacaaacacacatgcacgcacacacaaacacaaacctacatacacacgcgcgcacacacacagacatacaaacgtgagcacacaacacaaacctacatacacacacgcgcacacacagacatacaaacgtgagcacacaacacaaacctacatacacgcgcacacaaatacaaacacgcacacacacaaacacaaacctacatacacacgcacacacaaacgtacaatcacgcacacacaaacctacgtacacacgcacacaaacatacacgcgcacaaacacaaacatacaaatgcgcacacaaacaaacctacgtacacacacatgcacacacaaacacaaacatacaaacacacgtgcgcacacacaaacaaacacgtgcacacacacaaaaacacaaacctacatacacacatgcacacacaaacatacaaacacacgtgcaaacacacaaaaacatataaacaggcgtgcacacacataaccatacaaacacacacacgcgcaggggcacacataagaaagtgccaagcacagtaccaggcacgcaacgacggatccacacactttagatccttctctgacctttcttttattcctcaaaagcacagcatccatcccccagggaactgggggggggggggggtcagcggaagagtttgtccttgaggggacattgcccactctgtaaactcagggcaccttctcgaggattccctcaaagggttccctggccacgcatcctacagaagtcagcgaaatgcagttctatgaaatgaggctgttgggagattttgtagtcttgtgggtgtgtgctctgtgttcagcttgggggtcacgtggcacctgtcgggggcgggatgctgctgagacctctgcagtgctggatggccccatggggccatgtggcttcactccccgtctctgcctcccaggctcagcaggccacccgccggcctctcctgcccatctcgggagggctagcggggtaatttaggatggttgccactcccccgtgcattttaaacacgtttccaaactgggttcattctgcctttgatagggaggtggccttctgggtttttctttcaagagatgcagatttcatggactgcgattcttctccagatctgctgttcaaaaaaaaaaaaaaatgtaactcagaatttctatttgttcagagggggaaaaatctgcttgctattcaggccctagattttcctgagagattagtgtacttgcctgccaagatgttagctaaaggaaaacacatttgctatagatcagaaatatttatccttttctgggcaggagatccggagaagaacctcatcagaatgtacagcacctggaaatatgaataaattcaatctcctgagctgcaggcatctgccaggagggctgaggcatggaggggctctggccgtctccggggagttgaaaccatgagcgggaagccaagagcagctgctggggtctgggggatgcagaggtcaaaggaccaagaggggccgggtgcggtggcttacacctgtaatcccagcaccatgggaggccaaggcaggcggatcacttgaggtcaggagctcaagaccagcctggtcaatgtggtaaaaccccatctctactaaaaatacaaaaattagccaggtgtggtggcgcacacctgtaatcccagctactcaggaggctgaggcatgagaatcacttgaactccagaagtagagattgcagtgagcagagatggcgccactgcactccagcgtgggtgacagattgagaccctgtctcaaaaaaaataataaaaaataaaaggccaagaggtctggtccagatagaagccaggggaggaacaagtagggaacaggcagccttgaccagcaagccggcagtgtcctgaggaagaggacgctgacccttccctcctgttctctacgccctcagactggggctgggatcccgagactgtgggtgagtggggccaagccctctcctgcttcttgtcctgagaaaaggatcctaggtctctgttgggctccatgcagttgcccctcagtggctgcccccgtcgtttaaatcctctcaaactcaggctcttgtttggtagctgcagagaaataagagatgcaaacttataaataattaagaaacctaataattatctccaaccagacagcaagcctgcatcctcgtgagagacggaagatctggagagtttcggggggtaaactacaaaccattatttagcaagttttcccactgggctttgtcatgccttgatcttcaacgatcatgattagagttcatttgattcccgcagctgtgttctgggggctttgtgaggaggatcaagtttgggatgtgggtgagcgtagggagaggaggcgatgaattccttgtgacatcagagcccgatctaagatcatttgtctttggggccccatgttccatccccagaagtgatttgccttgaccaccagctggcatctacccggcttgggcatggcagggccccacatctcctggcacagccaggcagagcctgagtcgggttgtcaggactcttgatgcctggcctctcattcctggactggcaaagcctgttagcatcccagggctggaagaaacaccctacacactttgccttcttccaggcaaagaaggatccaccctggagtctccataggccctggccaggtgcggaatgaaaattcctacccccagatttaagtgtttatcagggagatttctgctcataaggactttgttaaccaagagactgtgtcatttaagccagagttccctagatcttgttggaacagagttcctctcagggctcctccaggctaaacccgcccaggaaagcctgcgagtcctgggaggtgacgggcactgcctgttcccagggtcctgtcttggtcttgcccagagcacctcctggccatcgtttcatttcaggtcgatgaaagctccttgcttggccctctgaactggggaaccatttcctctctctatcctggcccagggccagctctctgggctgccccagggagccggaggggagcggcctgtgcagacccagccgccaggacccagagggccggctcagagctgtgtggccatcctctccccgggctgcctttgcctgaggtcagcctcacacaggcagtctgaataggctgggggctcctttgtacttgaaaaatagtccatgtgcgggaggaggtgctggagagggaaagaagtgtgtggctgttgtgggctctctgtaagatggctctatgtggggcacgtgagctcgtgactttccgggtatgggcgtggcctgcagacagggatttgaacaagggtaagcatgtgggtgaggacatgaagccccaaagagcatgagactgtggggaggggcaagtcccgtgtgcactgtctgtgtcccccaacctgtcacagcctgcgtgtgcacatgcgtgcccaggtcctcctgcagcagacagggcggacatgggctctgctggctgcagtgtctgccctgtacccaggtggctgcaacgcctcagatgcagcaatgttcccctgggattaatccccagcatctccattgggctttgcttatctggtgttggctataattaaaaagtggttacttcataaaataaaggcagggagagaggacagcatcccctacccctgtcctgtggtccttggagaggaaggtgcttggaaggtcgtgttgttgatccctctgcctcccagtaggcaggggtccagcgtctcctaagagcaccctggccccaggcacggccagggaaggaggcctcccaggccccaacaccacctcccagggctgctagtcactgcacggtcagcaagcgcaacctcaggccagacacagcccaagagcctccatcctgagcagccaccgagacactctcccttcctaggccatgcaaaagtggcacagcccgggaagggaggcataaaagccaagccacggtccaccccaggggacctagggctcgagaaaaatagctgaggccaccaaggccacggtcttttcagtttcactgaacattaaactcatcacccaagataagcagaaagaaaagtggctgccgcttctcctgaggccactcgctgaatggcttctgtcagacgggagaagctgcccgtctcacacctcccctggagatggagcccctgtgaggccccaatccccacccatcagacacgatggctggtcacagacactgcgctgtccctgaggaggcctggagctagaagccagccacctcccccatgtcaacagctcacgcagggggccaagcccaggccccatcccatcctccaaacctcttggtgtctgggcaggcagaaagcctataccctggctgaaatccaccctggctctgctcctcactctgggcaaccttggacaaggcacggcccatctagagaacaggaatgacatccccagccctgcatgctggcaatctcttttggtgcacggtgccacaaccacaaatcagcctttgttgcttcacccacacgttcctggtgagattctagaatggaaatctctcacgtcacattgcgtggtgccttccatttgtgcttcttgtactctcatgaatgctaccactttcatttttcactgcaccttctcttaagggacttccctgactggagagacagccacacaaactcagggcccagaagagaatatgacagagctcagccatgacggcaggagagagcagacggactggagtgcgccttagtaaggggggcagcgctagacacctgggaggccattttcattctggagagttgtgctaatgtggattctactgtgcaaagtcaaaacactgaggcagagacagatgcaagcagcccacccacaacccaggcaggagagatgacggggctgctcggaagacaggccttgtctgctgggcctcactcgaggccctcagtgctccctgtgggagtctctccttggcatgttgggatgagtccagtccttcctggagagtccttatggaaagagggggtgagagtggggaaggggtgcggggagcatcctgaggagagggggagggaggaaacgtcccctgctcactagtatgagcaacaggatactggagatttgtgagtgtgtgtgcatgtgtgtgtatgagagtgagtgtgtgtgtgtgtgacagtgtggatgtgtgtgtatgagagtgagtgtggatgtgtgggagagtgtatgagagagcgtgtgtgagtgtgagcgtgtatgagcgtgacagtgagtgtggatgtgtgtgtaagagtgagtgtggatgtgtatgagtgtgtgtagagtgagtgtggatgtgtgtgtatgagtggatgtgtgtgagtgaatgtgtatgagtgtgtatgagtgtgtggatgtgcgtgtgtatgagtgtgtgtgaatgtgcatgacagtgtgtgtggatgtgtgagcatgtatgagagtgagtgtgggtgtgggtgtatatgcataggaatgttgtgttgcatgtgtgcatgttaatctacctgtatatgcatgtatatgcatgtgcatgtgtgtgtacgtgtgagtgtgaacatctgtgtgcagtgtgtgtatgagtgtgcatgcatgtgaatgtatgtggatgtatgactacattgagtgcatgcatatgtatgtgtgtatatgtgtgtgcacatgggtgtacatgagtgcatgtgcagagaggatgagtgtgcagaggattgtgtgagcctggtgtgcatgtgtatgtatgtgtgtgcatgtgtgtacatgtgtgtagagaggatggtgtgagcctggtgtgcgtgtgtatgtatgagtgtgtgtgtgcatgagtgagtgtgtagagaggatggtgtgagcctggtgtgagtgcgtatgtatatgagtgtgtgtgtgcatgtgtgtccatgagtgtgtagagaggattgtgtgagtctggtgtgcgtgtgtatgtatatgagtgtgtgtgcatgtgtgtccatgagtgagtgtgtagagaggattgtgtgagcctggtgtgcgtgtgtatgtatatgagtgtgtgtgtgcatgtgtgtccatgagtgagtgtgtagagaggatggtgtgatcctggtgtgcgtgtgtacgtatatgagtgtgtgtgtgcatgtgtgtccatgagtgtgcagagaggatggtgtgatcctggtgtgcatgtgtatgtatatgagtgtgtgtgtgcatgtgtgtacatgagtgagtgtgtagagaggatggtgtgagcctggtgtgcgtgtgtatgtatatgagtgtgtgtgcatgtgtgtacatgtgtgtagagaggattgtgtgagcctggtgtgcgtgtgtatgtatatgagtgtgtgtgtgcatgtgtgtacatgagtgtgtagagaggattgtgtgagcctggtgtgcatatgtatatgagtgtgtgtgtgtgcatgtgtgtacatgagtgtgtagagaggattgtgtgagcctggtgtgcatgtgtatgtatatgagtgtgtgtgtgtgcatgtgtgtccatgagtgtgtagagaggatggtgtgagcctggcgtgagtgcgtatgtatatgagtgtgtgtgtgcatgagtgagtgtgagcctggtgtgagtgcatgtgtatgtgagtgtgtgcatgagtgtgtgtgaacctggtgtgcgtgcatatgtatatgagtgtgtgtgtgcatgtgtgtccatgagtgagtgtgtagagaggattgtgtgagcctgttgtgagtgtgtgtgtccatgagtgtgtgtggagaggattgtgtgagcctggtgtgcatgcatatgtatgtgtgtgtgcatgtgtgtacatgagtgtatatagaggattgtgtgagcctggtgtgcatgcttatgtatatgagtgtgtgtgtgcatgagtgagtgtgcagagaggatgagtgtgtggagaggactgtgtgagcctggtgtgcgtgcataggtatatgagtgtgtgtgtgcatatgtgcacatttactgtgtagagaggattgtgtgagcctggtgtgcgtgtgtacgtatatgagtgtgtgtgtgcatgtgtgtccatgagtgtgtagaagattgtgtgagcctggtgtgcgtgtgtatgtatatgggtgtgtgtgtgcatgtgtgtacatgagtgagtgtgtagagaggatggtgtgagcctggtgtgcgtgtgtatgtatatgagtgtatgtgtgttcatgagtgagtgtgtagagaggattgtgtgagcctggtgtgcgtgcatatgtatatgagtgtgtgtgtgcatgtgtgtccgtgagcgagtgtgtagagaggatggtgtgagcctggtgtgcgtgtgtatgtatatgagtgtgtgtgtgcatgtgtgtccgtgagtgagtgtgtagagaggatggtgtgagcctgttgtgtgtgtgtgtgcatgagtgagtgtgtgtgagcctctggtgtttggcatctagttctctctgcaggtctggagaccttcttgagcaaagctcaggctactgcgcccactctgtgcacgctggtcttgaggacgcggccctgctcccctgggtgggcccgtgggtcctgcccgcttctgtagcagcagcagcctcctctcaagggccctctgttgctcaggccgtgttcctgcctgtggtcgcccagcttcaattaccacggctcaaagtcagaggcgtgggctggctccgtccagatggagggagggccggtgttcccttgcctcagagtctgcgggtggcttcagagagaagggagcagaacctctttcctttgctgccttaaagcagcaagtctcggtgacatcaggcagttccagggcagagcttgtggccgctgtcaagcccaggagacatcagggcttcatgctcaactggtcacacccaactggcaagaggggtcccaggcagaaactctgggaaccgtagcccaggccgagagccatccccaggggactgaggtagggtctgcaggaccaaagctgcctcacacagacctttcaggaaagcaagcacagatcctcggaagcggttaccacccacctgtgccacgcgccacccctcgtccttgacaccactgctggcgaggcagccgagagagtatgctgagtaagcaggttctagggcattctccccagaccctccagggaggctctccctggaaggctgcctcagtccctgcccttccagtcagcagagcaaggcatcaagctgagaaaagtccaacagaagggcgggaggcagattgctgagatgaatgggaagtgcaggccacaggtcctggcaggcaagaggaagggaggcctgagaacggcctttgttcccgggatctccggaccagatgtgccctcacagctgctgcttcaggtttctgtgctccagagcccgctggagggagaatgctcgccaaagacatctcattagggatggccttgggcttggcggggtgtgggttttggtgggaagaggagagagggatggtttgtgctgtcaaccctggaggccctggaggctggggtgcaggcttaccaaatttagcaaatgaaaattgtagatgcctggttacttttgaaattcggataaacaacagttttttttttattttagtctaggtatgtcccacacagtatttgggatatacttccacaattgatttattgtttatctgaaattgacatgtcatcggcaccctccactgtgggctcttctgctgtgggttttcctctttgtgccacctcctgctttcacaccgatttcatccactcctactaaagcaatagagtctgggggttctaggatgcatagacacccactgggatccaaattcctcagctgccggcagctcagtgggggctcacatgtgcagtgggttctccctgagcccctgaggcctccagctgagggctttgggacccctggtgtttgcagcaagcctgagtctctgagactgcagaggggctggggaggaagctaggggatcctctgccttggctgcaatctcaagccccccggaggaggaagcagcaaggcgcctgctggttttctgctcagggttagcacatgtggtgcagcggtgagcagattgcaggttgctaggatgggtccaaggtcaacgacagccccggaaggcagctggttagggcttacagggtggtctccaccccactctcccctctggaggtccagttctccacacccctccagaccctggccaacggcaagcctaaacccagtcttcatgcagagaagcggctttggaggaagtgtgtcctttgctctaggaaggaacatttgcagtcagggctgtgtgtggaatttttattcctctaatacagcctaggcaggatgtagtacacgagttctccagaggaaatgcattcaataaaaatttgatgggctccggcagctcagcagaatctccttacgaattccaagtgtttgtttggtccctggcttgggcaggagctcagccacgttctgcaagtggcctctttagtgagggagcccttggaggaaggactccctccacatctggaaagtcgccttcagcccccggctttcccaagaaggagcaggattgcttcaccaggtcgaggagtgggggggcctctggcctttgaccccaaggagaagcgaagccccagggctctggaatcgggccctcataaatgagatgaggacactgagcactggagggggattcaatgccgacggagatgtgaagtcagcgcaagaatagaaatggcctcgctgggcttagtgggggatgtgtagtacgtttccagagatcacccctgtacttcattcgctcagcacacaagagctcccctacaagggctgaagcgaggcaggcagccctgccctgtggcccctgccccgcaccccctgccccgcaccccatggctcaccctgggcacagatgtgcttggagggaaacacacactagaagcttcctgtgggcaacggccatgtccatttggctctctactctcccctcttagccggggcctggcacacagagtggggtcagtcagcgtcaggacaatggggtgggcgtgtcatgggctctgtggaatgggggagcctgctggccacccctctggcttgtgaggtaaatccaggcacaagccctagaagccttggcttttaccaacagggccagacgatcagaaaagtgccccgggctctgctgcccttggagagtcagggctgggggccgagagcaagggtccagggcatggagggccctcccgcctgggtttttgcttacagatggagaagtgggattattaagccagagggtgtgcttcagaaggtgtgcttacgaaggggctttcgggtcacaatgcagagaacttcctcgcagtgagcagccttgggtcctggggtaatacagccagcccaggtagaggaccatggagttggcctgggtctccctctggcctggccctggctggccaccttcgccgaaggggagggaatggtcgctgccctcccccaccatttccagggtcaggtgccagacctgggcctcatctgcctttgcagggcatttgggaagcacttagccaggcctgacagtggccaggctgcttcataagacgcctggtggtgagtaaaaccccaagtctagggcacctgaaggctctctcagggtagtttcccatttccgtcaggttcagctcagctcgattcttagatgtgtggccctcgggaggtggggggagcctcctgtttgtgtgtagcctgcccacccacagtgatgcccactcggatgctgtgcccaccacacctgctgacggagttccctgcaagtgtgacgcatctggccggctctgagccacctccgctgccccgcacttgtgtcccaggggacagaagcatggaggctggagaggagccagaggaagggctgggggaggggagtcaggagctgggggcctcagaacgggagaaccaggtgaacagtctgaccccaaagggcagccagaggggcctcccgggcaggagagggtggcagcctcagccgagactggccatgcctgccatcccaagggcctctgtgggcagtggtgggttcttaggataccatggccgggggactctgtgtcctcactgcggggaacgggtggggactgactttggacccaggccaagggtctgcaatcagcctcccgggtcctgccaggctctgctgcccaggaggtctcaggtgacaaccaggccatgcagccacgctcaccttcctctactgtctctcacagtctcatggccccgtggaacccccaggtgtggctcctggtacccaggcttggagaatgtgtccagctgtcctgcccccttgctgcctgggcttggcctgggcacagggctctgcttccctttggtatctgaggaccctgctagacagacccctgtccgtcagggaggccttctcagcctcgggcagggagtgtgggcctcacaggccacctgcttccagggccctcagagctgcctggtctttctgccaactgactccaagatcaagcttttggggcttccagcttggtgtggggttgaccccacctgcctgctccacctgcaagagggaagaggttggggatgcaccaaagatgcccacagccatgtactagaggggagaggtgaggtccagaacattctagagcagtggtcctccatgtttttcctaccctagcagtaaaaatgtctaggcccactgggaatagcggctctggaccgttagggcagcagaccagcctttcctagagggcatggacatctcacaagtgcctcttacagtgacacagctggcctttctcagaatgccatgcccaccacctcactgggcagaatcactgggcaggaggagttcagtgtagcgcacagcctccttcacgggcggacatggcacaagcacacagatgcctcatgggcacagctgggcaggaggagttcagtgtagcgcacagcctccttcacgggcggacatggcacaagcacacagatgcctcatgggcacagctgggcaggaggagttcagtgtagcgcacagcctccttcacgggcggaagtggcacaagcacacagatgcctcatgggcacatgcataatattcacctggaggccaagtgcacacatgtttgttgcacagctagctggccagtggcaggaaaggaggccctgagtggcctccaggacctttgcccatgggccacagcaggactggctgcagctgctcccaccacatccccggcagccaagtcgaggctccctctggcttctgagggctgctgcaagcactgcggtcactgagtttagggcctacctgaggggtgtgctgggacgtgggcgtctagtgcaaaagaaaaacagtcctgggcggcccaggacagacagagcgtgccaccctcccccagctccagcccaccctctccacggccccagagctgcctgctggagacagcgggaaaaggagcttgtgcaggcccagatggggccgggaggggacctggacttcagatgaggccacccacccagggctgcagtttcagggacctggcggtgccccaggggcagggtgttcctcccatggtcaggtggggggaccaggccaggagacagcccacccagaggccacatgaggcagcacatttgggtctggcagaagtgttgacagataaccttggaatgtcctcgggtggcacagggggacaccacagtccgctgagcagggtccactgtacctggtcttctcagtctgggacggtcttgggtgtccggccccagtgctcatggtcacctggggtacaggagcgagggctgctgaggtcccagcgggcacagctgacctgtgggcgcttcacctgcacgacctcacctggccctcccagtccgagaggcctcctcacccaggttctcaggcgggcaggtttggtgggggcaggctgcagcagtgtggaaagcagaagccagtggaaggggaggcagagctcttcacatcagtgatgacagaacggcccagaccagagggaagcggagggtggagaatcgcagaggaggaagccggccagaggctgcctggggaacagaccacccccaccctctataacctcgctgtggcactgggcttcagcatgaggacttgggagcaggaactgggaatgaaaggaacacaccagaaccaggaaaatcttccaggtgtggcaaaggagagcaggggtgggactgagtcccaggtgccccagggccctgagcccggttcccagaggagggaagtgagcccagcccagccctgccctggagccccggccccactcccagggggaaggttggaggtttgggcttcctcaacccaccaccggacacctgtgcactcagtcacacacagtctcatgctcacactcaaaattcacactcaaaattcacactctcatactaacactcaaaattcacactaacacttcatactgaaactcaaaattcacactaacatctcatactcacccttataatgtacacatgctcacaagctcactcaaaattcacacgcacactcacacgctcacactcaaaagtcacactctcatactaatgttcaacattcacactaacacctcatgctgaaacgtaaaattcactctaacatctcatgctcacactcgaaatgcacactcacacgctcacactcaaaattcacactagcatcatgctcacacaaaatctcacatgctcacactcaatgcaaactcacatgcttacactcaaaattcacattaacatgctcacacagaactacacccatgcttacactcaaaaatcacacagaattcacactcgctttcatactaacactcaaaattcacactatctcttgctcacactcaaaattcactcacacttatgtactcacaatcaaaattcacacacactcaaaatttgcacttgctctgatactgacactcaaaattcacactaacatctcatgctcacactcaaaactcatgctcacattatcacactcaaaattcacacttgctctcatattgacactcaaaattcacacccacacttacatgctcaccctctaaccctctcacattcacacactcacactcactcccacactcacacaacacacacgctcacactcacatacataacaccctcacagtggcacactcaccgatacacacttgctcacacaaaactcacgctcacatatttgcacactcgcacacaccctgccttttgcacacggctgcacacacccctaccagctccagctctccggctctccctgcctcctggctgctctgatgtgaggagccgtctctgcacaggtgcctgcaggctgcaggctggggagggggcacacgcctggcacgggggtctatcggagctgtttactcccccaagcagctcttggcctcacttcctttctctctcatctttggcacctgaaaaaccccaacattcccaggagggcaaacaggccctttattacctcgtgggctcagaacacagcatcttagtaattgaaagtggcttgactcaaattgcattttccgaggagccctgcaagatggaagtgcaggaaggagggaggcagggtggagggaagctgcaagcgccagcccccgagcaggcaacaggtaggggcccaggccccaggggcctctccagtctgctggcaactttggggcccacgggccacgtccagataagagcagacctggaccccacctgcaaagggagtccaagctctgagcgggcagcctctgccacctgcgccagcctcctaacaagcctccaccccacctccgggtcttcccagctgggcactcggtggcctccctgcctggcacaccgcagctctccagcgtgtgtctgttgaccgaatgctggtccaagccccagggctttgccacgtggctcccactctgtaatgcccacttgttccttcaccaagtcatgacgataccagtggggtttatggggcacttggctgtgttccaaacagggagcgaagccctcgcttatgatctcatcaaatcggttccgtaccctgagaaggtaggaagtggtgctgttgtcacattatagatggggaacctggagcccagagaggtggagctgggctttgcctggggccctgactctgagcttgggcttgaagcagggcagtgccgggcccgggcctccggtggaccctccacagacccctgtcacagccatggggagcaccagtggtgggcagagggcctgactcctgcatcccacacccgtcggaagaggcgcttcagaggcccctggaagctgggacgtggggctggtgaggcttgaaaaagcctcctcaaaaatcctgctactttgatttgtcgctagtcctgacgattattttgaaattccttgcagcactaaagaagactagcaaagcagggggcggactaaagtgggcgggaaatgctgctttcatgcatctgcgtgttgacaggtatgacctccctgctcaccctgagttctctgagtcacctctgtgcccccagcacccagcactgtgcctggctcagggcaaaggctcagagaatatttgttgagtcagtgaatgagggaaggagggagggaagagagaagggaggaggaaagtggggcaagagatgaagaatggaaggaggttaggaaggttggaagggtggagggagggaagggagggagggacagtcctagaataggagagggagcaggaagacaaggcctcccagccctggccctggaggagaggggcatccacacccacttagcctgtctgccaaaattaatgcattctagctccctgcaaaccttctccccctcttgatttctgcaactcactcagctaatgaggaagaaagggaaggccccttcccatacagggctggaaaacgtgcaaaaaaaatgcccatggcctgagaccaggcgctacaggctatgggcaggacaagcctgggcctcccttcccgggtctgtcctgggctccctggctgctgtgggtccccccaggcaagatactcaccccactgggatggctgagcagagagctggaggcagcaaatggaagcaccatctactgggaacctcatgtccctaaagaataagcaggttgcttctgtcaccacttttttcaatttaaaggagagtgtgttggaaccgtcttacaaatgcatctgttacatcaaaccaaagcctgggcgccttttctctctttcactttatcccatcctcacgctaaaaatacagctggaagataaacagagcagcgctggccagatgacagagctgccttccccagagccaggcaacacttgggggtcgggggagccaggattcagaacagagagaaaacaccgtgacacgggtttgatttctaaactgtcggacccagcaggctttatagtccacagacacttgtaccattctttcccctcctggtttactctatttctggattattgtctgtaagtttcagaatggcccaggatccctgagtggtttataaattagggctgtattctgggagcacccagtagtgctgctgtattttaggtggtgtcagagtttccattataaaccccatttctcagaggtttataacttggccgtaaaaacgtactgaggcctgaggctgggaccctacggtgcacagctgctgggtcccttccatgcccccaggtggggacatccagtcggcctacaacagagaacaagaggctaggagacctgggctttgcctcctggtgtgaggggatgtggacatggggcctccccttgccagccaggcgagctatgtggtccaaagtctgctcataaaggattttccatgagttcacaaggccatgaagctttttagcagcccagcgaccaagggggaaaagctaccctgactctcagtgaccacaacctctgtcactcccgagtcatcctgcaaaaacaaacaaacaaacaacaaaaaaaaaaaacactgtcctccgaggccatccaggccccctttgtacaagctcctgacccagtgacccaacagatacatttcagactgattttcacatcaggaggagattccacgcttggtacgacggcactcgagataacactccccgttttcattaaagggcaagctaccaagggtcacctgtttgggatattgaaggggtaaaggccaacagttcttaggtctaaggagtttgtaaaaaatatgcaaatgcctgggccccacccccgggaattctgggtgccccactctggggtagagcccagaatggctgttttgttcagcgattcccaggctggcattggagggtccatcccacctctgacacctgctggcattgatgcaccttgcttcgcccctgggggctcacctgtcccatgggaaggaaggtagtgccaccttcccacttgttaagaggatcaggggcagtgccctcccaatagtgacacataggtcacagctgtagctcgtactatgactgcgatgggcagagcccagtctgccacaggcactggagaaggaagaggatttcacacagaggttccagagtccatcaacaatccatcagaaatgacgtcaagaatctttcaagtgatgaaattcttggggcgagaatgtgtggtttatacaagcagcctttacctccagcctttccagaaactcacataaaatgagtttcctccattgtgtttaccctactggggacagcaggacctttgtcctcctgctccaggatggctctctaccttccaggcatcccagttcataaacacacactgtaattcctacttttgtttgagagcattgcttggggtcccggtggtttgggagtcactgtacctttgccagcgtgaccctgccccatctgcctgtccacatcctacaccctccatcgccccactctaaagccaccttttccagggaggctcctgggagcttcgagcctcccctctttaaactctccgtgtgtgttactccttcggcactcgcccgattgcccgaggcattctttccacagccagaaactcagcacctgctactgggtgtcagccgagcctcctggaaggcaggaactgtgcctacgagcatttccaacccccttcccaattagcagggcaccttgcatagtaggtttatcaactttcagttaagccaggataatgcaggatagcaccaggggacacttcagacttcgaatcagaaagccttgagttcacatcctggagggacaccctagtagctccgtgaccttgagtgtccactttctttcctgtaatgtggggatcatcacccatatattaagtgttatgagaaaaagaaataatgaatgtaaatcacttggcatctttgtggcatttaagcatgtgcaggatgataattatcattatcaccatggacacaagctcctgttctgggagaatagcccaaaggcacaggatcctggggtgcccaggtgttcctgagatatgtctgtggctgtctctccatcacatggaacatctgggaacttttccagctgctgctaggcattccccacatcccggggtccagcagaagggaaggaagccatctggagttctggagttctgaccagtgtattctgaccccaccagaggcagtttctcaccagattcttgctgccagatctcaaaaggctggtgaggtttcctggacctcccctttccctagaatctggccaggtgtttcccgtggctggggctcctgggcacttgggacctgggcagagactgtggagctggcggctttcctggtccccaaactccactttgtagaggaaacacctaatacaccatcccctgggagacaagaacacaggccagaagaaatcgcagtctgcagggagctctctttgttttctcagtttcttctgaggttcctagaatttctaatccagattcaggaaccacaggcttatctggatagatgggttgcctggctctgcgctcagctgccactcagggactgggagccactcagctgcctggaaggaactgaggcctttccttgggagagcacaagctgtcagctcatgaaagtgctttcattcattcattctttcattcatttattcagaaatgtttactgagcacctgctctgtaccaatcactgttctgggtgtctggaatatgccaaagataaagcagagaaccttgcatcaggggcaaggagatggccccaaacgatgggcagaatcatcagttatgtaacatgtggaaggtatcagtgttatgggaaagaaacaataaagccagacaaggcctgtaagggggagattggggtggtcctggagggatgacaagatgcaatttcaaatggtggggcaagggtagcaaattagtcaggtttgcggcaacactgctcggtaacaaacagtctgggaatctcagcggctgacaggaccgcatagttatttgattgtaggcagattcagtggctgtgtccaggctgaggggtggcttcaagtctattccaggggtctcgccctggacctggactggggcttggttttctgagagcagaaggcgggagggccgttggccatgcaagctgctgctcagacacagggaagtcatatccactcctatcacgctggccagagcaagttacatagcaaaacccagcatccgtaacatagagagtggggaaggaagcaatactagctgctgaacagaagtgcatcctcccaaagccagcaggacaagcccctgagaaggtgtctcctgtgagccatgccttggaggctgggagggagggagccaggagaagactaggtaggacagggcatcagggcaaggggacagtcagagagggcagagacctctttgtggaagtgagcagaggctgcaaaatggcagaagaaaaggtactagaaagtgccagaagggaagatggcaggggtcccttgagttgctggaaaggcttggcctcccactgagcaaggtgagaatctggtgggttttgagtgacaggcactgactcccatcccaacaccaccccgtgcccccttcactgcagggacaccataggggaaaaggggagaccagggaggtgcttgtgacgacccaggtgggaggtgatgcggacctccagggtagagctgtggggtggggagaagcggccgattctgggcagattcagaggtcaagccaccggcctgccagatgctaggatgtgggagagaaagagaaacttccaggctgactcgtggtcttgccatcgtaatggcagctgggtggggtcaggagagccaccttggaatttcagcttggagaggcctgtggggacatcagtgtgagtttcccagggcagccatgcaaagcagcgtagactgggcagcttaaacaacagaatctaccgcctcttagctctggaggccagagtccaagatcaaggggtcggttccttccgaggctggaagagagggtctgtcccggccctctcccctggcttccagtgtttgctgcaattccttggctgtagaaagatcactctgacccctgccttcatgttcacatgatcttcttcctgtgtccatggctttttcttaccaaaacaccggttacaggctgggcgtggtggctcacacctgtaatcccagcactttgggaggccgagatgggagtatcacctgaggtcgggatattgagaccagcctgaccaacatggagaaacctcatctctactaaaaatacaaaattagccaggcgtggtggcgcatgcctgtaattccagctaccctggaggccgaggcgggagaatcacttgaacctgggaggcagaggttgcagtgagccaagattgcaccattgcactccagcctgggcgacaagagtgaaactccgtctcaaaaacacatacacacacacacacatacacacacacacacatacacacacaaacaccagttacactggatcagggcccaccctactccaatgaccttatcttaactaattgtatcagcaatgagcctttttcaagtcagatcacattctggggcactggggacttcagcaaatgaatttgggggatgtgaatcaacctatgacaacatccaaggaagaaggacttctccccagagagggaacagtccctcacatctggctcagatctccatgcctcggagcctcttccagctccctagcacaaggaggaaagaggaggattctccttagacctccagcccttcctagccagaccccaccccaagaggaaacaagcaaagagcagttgcccaaacacagggcagacaggcagtgcctgggccagagtctctctgctcaggagccaggtgctccagaagggaagggcatgagtggggaagggcattgacttgttctgcattgagttaacattccttgagcacctatgatgtggcatggcatcacggagcacttgcagatgtgtcagagggagcaccaggggctgggaaggggctggaggtggcctcctggaaagactttgaaggacatatgagatttgtcctaaggagaaaagagagatccttttgcatagaaacaactcatttgggaaatgcaagcagggagagccctgtgcccagactgcagggtaaggccccaaggggcagagacctgtggcagggtgcttctggccaaccagccaaggggcatgagcagacagtgggaagagaggaatcctcttcccactgggcagcctggtcctggtgcagacatccacctggagctgtggggcctggagtgcctgagaatgttccattcggggcccaagaggcccgccccccaccaccccattattcgctgcagagcacctgcttgggatgcagactgagattcaaaacagtcccagaggaaaaacctaaagagcaaatgtctgttcctcctactcccctttgagagccaggtggtcctcctgggctccctccacccaggatcatcaggccggccctcccctgctcccttcacctgggatcatcaggctggtccttcccggctccctccacctgggatcatcaggctggtcctccccggctccctccacctgggatcatcaggctggtcctccccggctccctccacctgggatcatcaggctggtcctccccggctccctccacctgggatcatcaggctggtcctccccggctgcctccacctgggatcatcccaggtgtccccttgctcatgtcactcaccggcagagcttatctggccctggcagcttcctgctcttgtggccttggaagggttcctgagacatcaggaagaaagaggccttaaggagcattgcctaagtctcggactgtggcaccaaaacacctgattcctgtccgggctctgcctctgtatgtgacttcaggtgagtcattcaacctctgggtgcccaatttcctcatgggcttatgtatgtaagtacttagctcacagcccaatgcccaccacatggcccagtcaggggtggctgcacagccagggatgggcacagctgagtttaaacccgggccagggctcttgacaggatttggggctgcctcttagccaggatgacttctccctacaccctattccaccccccgggcagctcatctcggagcgagaggcaccagtgagcaaatccagagtccaggctccaccaggctcccaagttcccctccttcgtcccctgctaagctaacctctcgcgagccctggacagacctggtttcactttttcccaggatctgctggtctgctaagactccacgactcttttccttccttgagtgatttcacagacccatgggcgcagcaggtcgtgggacatgggtcccaaataggcacggtttgtctgatttcagcctctgagtgggaacagccgatgcaaagggattgtggagcctggtggctcttaccccaggtctcagggactgatgtcccctgagtctttgcatatgcccttgccctgtgtcacatcctcccaagctagagaaggtgggctctgcatcagccttcctggaccggcccccaccagggcaggagaacctaccccactcccgcctccatcagcaagcctcccagccggctggggaacgtgcgctgactttgtaagtctccaccgcttaacacagagtcgtgggctccaccacagaggggttttgtttggaacttaaaacacttgctcaaattaatgaccaaaatgtcagatgtgtccacagctaattattcattagatgcttaattagtgtgggatgatcatgacattttaatgttattaatttttatactgtaataggaattaaattgttctgctgtcccgaagcctcctgttggagtcacactgtggaattgggggctgggaggaggaggggccgtggagggcagctggggcagccagggagctcaccggccagagccagtgcacacacgcccctctgctggctgggagaagcctcttcagagctggatgctttggatggctgggctgacagtgggaacagctaagaaagaggcacagggtagaccagatggctccttgaggttccttcctgcttagacatttcaggatttcatgttcttcatttctccaccccaagacaagaggaatgctagggaactgtcctgcaaaacccacacagaaaagaggaagggactgaggtggtcacacccacaagagaccacagaaggccagcagaatgtcacagacctgttttccactccccacaggccagaagaaggggctcactgggaagaaatgttgcatatttttagacaaatggaaggaagccctgtctgccagcaaagggagtcacacaggagaccctgagagggctcttgtttgtaaaatgggcatagctctattgttatttctcattatgaaaataatccatgcccatgtttaaaaatctaatcattaaaaaaaggtagaatggtaataaaaatcgtgtgaaatcccaccttccaaagatagtaactcttcagattttagtgtctgaacttctgagctctttctgggcagatattagccactgctatcttgtaatctactttttttgctgacatgagcatcttttcaagctgatggacatagatctgcataatcctttctcgtggccacgttatattccattctccaaatactccatcacttatctagccagtccgtgagcgtgggatgtttggattattcctaattactcatcattaataaccaggatccttctaattatccttttcatgttggtctggttatacccttgggataaatccctagagatgggattgctgggtcacaggggaacctcacaggagagttccacttctacctgcaaccttggccaaggactttaatttccctaaagctgttccccaacctgtgaaatgggtacacgaatcctgttctgataatggcaaggattgcaggacctggcacagaacctggcatttagtaggttctactaaatgttagctccttttctgagtagttgctgctaactctcctttcacaaagtgctttggtatatatcatctctttaatgttatgattccaaaggaaggaaaaagtaaaacagatatgaagtctcaagaagggttggggaaattcctgggtgggtgactgcaattgagcaggggctgacggctggggcttattctcaaatcttcagggtcagagacacttagagcaaccaacacatcctctgtctaccatgtctgggcatcccccatcagggagagaacacgatatccattcagtcctggcgatgtactttcggagtacacccctggaggatgtccaggcagaggtttgagccaaggtcccttaaagagaagtcctgccatgagggacgatgatccccccaggaggcctggaggacccctcctgcacctggctctgagagcccagggttaagccctttgcttactgagcctgggcaattgactgaaccatcagaaactcttgattttccagcctagataagagggccaagggctcagagaagcttctcccactgggggacaagaggacatatgagtagctaagtggtgtctgccagagctggatgtgagaagtggatgggaccgtgatcccagagtcaggttatatttagcaagcacgtgtcagggatatggctcctatcagcaactctcaggctgcttggagactgtgtcttacacaatttgaaaaactacctggtaaaacgaagctggcagttggattcccagacttctagaagcccctcccggaggtgtggcgggatctctccagaggctgagctgccctatggcttccatccctaatatggctcttctgttccctccaccggcctctccatcctgggcctgacccctatccacatcaacttcaccaggagcccagtgacacccccaaggtcagtgtctccacccatttagaagggcccatttaggtgaaggctgattgcagagcccctgaagtccccccacggggcagttgcctgtgggagaagcaccatccctccctgaagacagccgatgaacagagcgtgttgtcgggccgccttggggtccaggagcctgggccgcccacactgccctcaggagaaatggacctgtgcccacccagcgctggttccaggagaagggccgggctggcctggtgcagggaggatggcatgtcttacagctccacttagctgactcctggaaaggaaggtgcccctcactcactgcctccatctctccagaagccaatgtcagaacaaaaagtcaggaggagccacacatccatcccatgggcagagggagcctggtgcatactcatctcccttctgaggtcaaacttggccataccctcattgagtgctcccgaaaaaatggcctgtgatggctccaggcctgccagccccagtacttgggatggcttgggtccccaggggagggggcccccggccctgtgccaggagcagagccctcctggggagagcaaggcagttctcaaggaaatcttctggccttcctccctgccccatccatcaccagacagcccactccagatggaaagggaaaaggaagaaaaaatgttaatatgcaattaaagttgagatcataaacaggtgctctaattagaagtcttctcaaatcatcaaaagctcatttacaaggtgagatgccagaggtgccctgatgccggctggcacagagctttctgccactgaggaggagtttggggacagccctcacctgtctccttgaggcttcggcaggtgggcaggggccaggagaggtgggggcacaggggaagtcttagccagacctggaggagggcagctcctgctcacggcagctccacaggtggctccccagcatggccactgctcaggctgtcttggcagaaggagctctgcacgcctggagcctggtgtggagggggaagcccaggatccctttggaggcattcaaggagccttggagatgcaggcagggcttctgccaggctttgtggttcttcctccagtgttcctcagccagggaccttccttggccccgtctcactgaatttctcctccctgagccacctctgccactctcattgcccgggccaatgatgccaaatcctgaaatctagcctagagccaaccctgagcttcaggccgcatacacagctgtgtacagacatgccccctccctcagtagaggtgatgctgggctaatcctttgtccccttactcctcctcaggggctccttctctccctgacaggtgccaccatctatctggtcacccccacatctggatgactcaaacctggtcagttctactcctacatgttccgcagtggtccctgcccctctatctgcacagccaccaccctcctggggcttcctcacctctctctttgactactgccttcgtctccctgttcatctcgggcacatcagttgtcccgtgctggcccacagtccacagcaccatcagaacgggagcttctaaaacacatcactccatgttgttcccctacccaaaagtcttcagcacaaaaagcaactcccctagcagagctctctttgtggactccccaccagtccaccagccccccaactcatttccagggctttgcacttgaagaacccaccctgttgctttcagcacctggccgcctctcaggcctcagctgccctggctggactgccgacctcctcctcctcctcctcctcctcctccctcctcctctcccctcctcttccctcctcctcctgcctaaaaaccaaatgagagtctgctctggtgaggctctggagcccacctctcccagggtcctgtggggtctatggaccaccacaacttggggctgagagttattcgatgtgtggacaggcgctgggttacggcccctctccgaagtgctgagtacaagtgtcttggcagggaggtggggccagcaggatacagccttgggttccagtctcaggcgcccatccatcatgagtgccacaggcagacatggatccccacaggaggggtctggctgagtgggagtgtctctcccacagagagggaagagcacatgggcacccgtcatctgcccaccttgctagggtggctgccccagaggggagcaggggccccttctgggcacccagctggggagcactggctgcagagttgggcggtggggaaccttctctcagcagtcccagctaccccaggctcctacgccaaggacctaaagagccacacagcctcgtgcatcttgctgtggaatgtgtgagaaggatgttggtattggcttcttccagtccaagaaaggccctggcacctcattccccaggtatccatagaaccttccagaccagccttcctcagcatggccagacactgcaaaatcccctccagacagacagtcacacaaacacacacatgcacccacacacctcaccttccccataataatatataactagccagcacttgatattagtggttcccaaatacttgtcttcaatcctgtattgcttgtgatgaaactcttatcagtccatggggaaataagaaaaataaaaaaaatgtggtgggcttttcataagctaaatgttcattttcaaaggactgtcctctattctgagactgatcttcccgcttttattacactttaaaatgtcctctcttttatgaaagcatggtgatggtagacagggtgattgtttcttaatgacttatttggcaaaattaaaagatgataccccatcagcgcccccatttttaattgaaatttttagtgagataattgtaggctcatatgcagttgtaagaaataacacagagagctcccaagtactccttacccagtttcccccagtggtaacattttgcaaaatgtcggcataaatatcacagccagaatgttgatacaagccaccagtctcattccgttttccccatttttacttgcatttgtgtgtgtgtgtgtgtgtgtgtttcattctctacaatttattatacatgtaggtttgtgtatccaccaccgttgcatgtccacagttccttttttttttcagatggaggcttgctctgtagcccaggctggagtgcagtggcacaatctcagctcactgcaacctctgcctcctgggtcccagttcaagcaattctcctgcctcagcctcctgtgtagctgggattataggcacacgccaccatgcccagctaatttttgtatttttagtagagacggagtttcaccatgttggccaggctggtcttgaactcctgacctcatgatccgcccacctctgcctcccaaagtgctgggattacaggcgtgagccactgcgctcactccacagttccttcctttttatttctgaggagttattccatgttatggatgaaccactattgtttgaaccatttactcattgaaggacgtccggatgtttccattttttgacaatgacaaatgaagctgctgtgaacatcacatgtgcgttgttatgtgaacttctgggataaatgcccaagagtgcaattgctgggtcctgtggtagctgcagatttagcctgccaaaccgtgtgccagaacaactgtaccatctcacatccccactaacggggtatgacggatccggttttttcacggcctcaccagcatttgatgttgtcactattttttatttgagacattttgataggtatgtagtaatgtctcattatggctttgacttacatttctttaaggctagtgatgttaagcatctttcaggtgcttacatgccatctgtatatcatctttgccgagatatctctatgtgtcttttgcccgttttctaatggaattgcttgtttttactgttgaattttgagagtttgttattatattctcagtacgagtcctttgctgactatgtgatttgcaaatattttctcccagtctgtagcttgctttttcatcttctccaaatgagcttttgtagaacaaaagtttttaatgttgatgaggtccagttttagcattttccatttatggaccatgcttttaggactaagttgcccagtcctagatcccaaatactttctcttgtgtttttctacaagtattataattttacatttaagtccgtaattcattcttagttcacttttgtttaaagcataaggtttaggtcgaggttccttttgtttctggggtttggttttttgtgttttgttttggttttggcctgtggatatccaattgctccaataccatttgttgaaaagtttatccttcctccatttaattgcttttgtgcctttgtcaaaaataagttgagtgtgtttgttggggctatttctgggttctgtattctgttctgttgatctctttttttggttttttgagacaggagcttcgctcttgttgcccaggctggagtgcagtggtgcagtctcagctcactgcaacctctgcgtcctggattcaagtgattctcctgcctcagccttctgagtagctagaattacaagcatgcgccaccacgcccagctaatttttgtatttttagtagagatggggtttcaccatgttggccaggctggtctcaaactcctgacctcaggtaatctgcccgccttggcctcccaaagttctgggattacaggcgtgagccaccgtgtctggccctgttgatctattaatatatgactgtctctcctctgacatcacactgacttgattgctataactctgtattaatcctcagtatcaggtagagtgggttcttatttattcttctctgtcaagcctgttttagctattctattctaatattggtatctattctaagccctgtgcctttccatataaattataggatacattgtccatgactatccgaaatattgctgcagttttgataggaattgtattaaacctatagataaatcggaagagaattgacatcttcactaggttgggtcttccaatccatgaaaaaggtatgtgtctcttcatgtactaggtctttgattttcctccattggcatgttgtcattttcagtatacaaattctgtacacattctgtgaagtgtaggcttaagaatttcatttttggccgggtgcggtggctcacgcctataatcccagcactttgggaggctgagacaggcggatcacaagctcaggagatcaagaccatcctggctaacacggtgaaaccccgtctctactaaatatacaaaaaaaaaaattagccgggcgtggtagtgggcacctgtagtcccagctactcaggaggctgaggcaggaaaatggcgtgaacctgggaggcagagcttgccgtgagccaagatcgcaccactgcactccagcctggacgacagagtgagactctatctcgaaaaaaaaaataataataataataatttcattttcttggccgggtgcagtggctcatgcctgtaatcccagcactttgggaagctgaggcgggtggatcacaaggtcaggagtttgagaccagcctggccaatatggtaaaacacctgtctctactaataatacaaaaattagctgggcatggtgatgcgtgcctgtagtcccagctacttgggaggctgaggcagaagaactgcttgaacctgggaggcagagattgcagtgagccgagatcgcaccactgcactccagcctgggcgacagagtgcccaggagactctgtctccacacacacaaaaaagaatttcattttctttggagctattatcaatggtattgtgtttgtgattgtggtggccacatatttatgatgaacatatagaaatgcaatcaatttttctgtgttgatcttgtatcctccagctttactggattcactaattagttctagattttttttgtagatttcttggaattttctatttaggcaatcatgtcatctgtacagacagttgtatttcttcctgtcccatcagtgtggcttttacgtctttctcctgctttactgcctcagaacttcctgtactgtgttgggtgagggcggtgcaagcagacatccttgccccattcctcatctgtggaagagcactcagtcttccaccattaaattgatgtgagccagagggattttgtagatgctttttatcaagctgagataatttcctgctattcctgacttgctgagagcagttccctcatttgttaaactttgctgcccctgaaatcagaaactttgggacccaccagtttgtaccatacccaggactgcttttcattcacatcctgcccctcacaggatcctggagggcccggtgggtaaggggtccacagcctcccgctcaggtttttgactcgcaatcctgtcctctaccccaccgatccctctccccttggctgagccttctgtcctgtgccatgttcccggcccctcaggaaaaggaaccctgacaaaccagtgtggaccattcacacattcacatatccactcattcattcattcattcagcaaggcctgcaccctgtggtacagaaatcaagggctgcagacctgcccttgagaaatgcagtctaacacccaaactccacccgcccccgcgtcggcccccgtcgcgctgcatgagacttgcatcccctctccagggggctggccagggctggctgaggctccaggagttgctctgctctaccattttccttttccaggaaatgtgtatcccagacagcccccagcacccactcttctccgggccgccctgcagcagggtgggagcagtgtggtggtcctcaggcccccatctcacccccctacacacacataccactagagcctctggcccacagcaggcagaggacaagccccctcacccatcccagctccagccctgactctggaaccttctgcagaggctcaggctccccccatctccacatccgcaggatggtacgctattgatgttcttgtgtgtgttttttttaatcaagggaacaatttctttatatgcaaatctcttcaataatattattattatcagtgtggcctcaggcagaggctcacagaattggagagttgccgagttgatggtttttttcatagcgactctgagcatcatcaggccagctcctgggaggacagcgaggctcattttccccagaacaatcccagctggaaagatgattgcaggtatcaagagatacggggtgatttcatcctcatctgaatatctgtgaaaccacccctgcaccctgctcctccatctcaggtcacagccaagggtgggcagccctgaccagtgggcactccttccacgagcatctactgagcacccactgcccgcatgtcacttagcgcccagggccaggcgggcagctgctcacggtctgaagagggaggcaggcaagacagtgtgggtcccctgatcccacagacccacggcctgtgggagcccccacccagacctgggaagcctggcagggccaggaccagggtgaggcactggcatggggtacaaatttaaggtggtacaaaaaaaaattgtgaagccaaataatattttaatagaatatttttgataatcaagattaatgcaaaaaatccatgataaacacaaaatcaacattttaaagaaaggcaggacacctacgggaaggcttcccagggaggagacattgtcactgcaagcagaaggagaaggataagcaggacagaagcacggggaagaggtttccaggggtgagaagaaagagagatggcactttcccaccccaggggctccaggggctctggaggctggagttccagtctgaacctatgcatctccccgagctcccccaccgcccaccactgcaccaaagccccaggcccacctctgcttctccttcctaagcccgtggctactgcacacccctgccccccaccccacagtctgcacggactggacagaggctggccatgggcctcccctgcagtggaagaggctgaggcctggagccctgaggtctgtccaggccgtggatactgcacacagaccacagctgtgagctggcctcgtcggggttcagaacaaagcagcaagagccattggaaggcggaggagtcctggacagaaatccaagggtgagggacaaaggtgggacaaagcatgagtgtgtggtgattcatggcagagaagggcatgttcctccaggcctggctgaggggcgaggccagccactcacttggagaacaccagcctgcgttctagcagtgagccttctggataccctcagggcatccaaggccaggccagggcctgcccagatgaccaggctgacatgaggaggccctggctctctgttagcagatggggctgggtgaccacccctccagccagggctggccacccccaggagcagtgtctgaagagttcactctatttgtgtctctgggcattaagctacgttattccttgcccagctgctggggcctgtgtttccaagaaagcagcctttccaacagggactttgactgctgagaaggtctctccacccccacggctatcaccggggcatgcagacctgactcttcctgccccaggccagcggctgctcctctcccctgtgaggattggggtacccaggcctgcctgactgtgcatcctgagaaactcaaagccaccactgactgtagccaccatgatcagctttatatctgatgatctcgtttgactcataccctaaccccatgaaggagtgactgtttccagagaaggaaactaaggctccggaaggtgacctaaactgccactgagtgacagatgaggatctgaatccacagaagctcttcaccatgacatcatgttggtcccagcctacagccatcatctcccagacgatccacccctggagagtcatccctgggctagaaagagaaagctggaagacaagcagcgccaggtcaacctctggcctcaaaatacagagcagcttctccaggcagcttgggactttgagacatctaaactcgctcctaagacaggaagtctgaaaaggagctgagaccagaggcaagagtatagcacagagcctgggtcctggccctgcagaggggctggatggggcagggccagggaggtagcagggaaacacagcacagctgacctggggccttgtatcttgagcctaagaggccagaatgctcatcgggcacagcccaggctcttcctcttggaagtcactagaagctgcctcgacccggagatagggagctgaaagcccaggtctagtttcatgcccccaaccagctaaggggaaagggtgcctcacttgggagccccacaagtggctgcggttctccgacctcacaaattcagcctgtacctatctgttctctcccagcctccaccccaatccctgccctttctggaacctgccagaggttgggacaaacagcagcaccaatgctctagagatcgctccaagaagctggggaaggtttggagggcgcagcggcaagagcctagaaagggactctgaagccactagagacggagccctggggttaggaagcccgtgaccactgctgcaccagtgggaccaagaatcccacagcccagacaaaggtgcctgtggctctgcctgtctccccacaccatcgctgccttgggaagaaaaagcttgctctctttagattgacgagagcagactgatcttgttcctgagcttttccacgcatttctttttccttgttggtaatgaaaaaaaacaacaaaagtcgactcagggcttagccctcaaggaaaaaggcctgggggagttagtgtttcactgccttccttagctttgttatgacactagcaatccatgttcattgatgaaaacttagaaccttcagaacagacaggaataattttaaattaaaatagcttcaaggcctgacactcaaagttaaccacagctaatattttggttttttaaaaaaaaaaaatctttctaaagataaatacaactagggatctcctagagggccccggagatctggcctcctttccaggagcctgggttcctcagctctgagtcaggctggtatctgacttttgctgtcagcgtctgcattggtctcggggaggagcttttgcatgaggcctgggatgtgccctcacagtggctggtcctgggaaagatggtggcgtgccctattgacagatgggaataccgaggccaggaaacttgcaccaagtcagtgagaaaggcagaattggaattagaaaaccacatagctattgaatgaatgaactgtttcttggccttttggctaagatcaaatgtaaaggaatgaaaggatggatgaatgaatgaatgaatgaatgaatgaatgaatgaagtgagtgaatgaagaataattatgctgtactccatcctgaagcagctgacaatgtctgtgagaatgtgttccatgccttctgttcccctgtgtagggtagaaactcctgcacagggttggtgccagtaactagtcatgccagtaactagtcatgccagtaactagtcatgccagtaactagtgacacccagggaagtcagctcactgcttgcagcatctgcttcctagcaactaaccaggagtttctgccaagccctgcccatcccacgggtctgttgtggatatggaatgaagggggcctccataaaactcatagaaaggtcaggacagcctacagaagtccaggatagctcttggagtcaagaggacctcatggcggggaggagtggggcagagatgggcatggggcaggcttgctcaaggtccctgtgaccttggacattcctccacctgcttctctgcatggcatgggctgggtctgcatctctcctcttgtgtgagctggggctctctgtcctctcggtgcataccatgtgggaatctggccccagtaatgacgcatacctcctggccttgcactgaccccgtgcgacagtacccgctcgctgagcccccacagaacccttcgaggtagaaaacattgttgtcacagacaaggaacttgaggcacagagagcttaagtaacttaacctgagctcacaccacatggaagtgaaggatctaggatttgcaccgtgcaggcaggccccgagtccacgttccctgctcctctgtgatacttctgctgtctatgggttaaaaacattcacttatgggccccactggctggatgtagctcccagatctgctggctacaagctcttgacctcagacaaggaaccttaacatctctatctgtaaaatggggcaaagcagtcactcccttataaagatgtggttgggtttttaatggaaatggtgtaatgtaaagcccatcacatagtaggtgtttgataaatggcgaccatgaccaggataaagtgtaacccagaagtgaggctgtcctgggaggccacatgctggcaacatatccagaaaaggctggataagaagcttcctgcacaggtgggcattcttggaggggcatctgctgcccgtgcccagcatgctcccctgccaccgaccaggagctgagtggggtctctctggggcccagcagaggttgacttccctgtacctggggagggctcgtcagctccacccacagcccttgctaccctcccttctctggcacctcggcaccctgcccagacccctctgcccacctgtggctgccacccacacagaaagatgcagatgtgtgtgggcacagcccgtgcacagccaccttggcctcaggctacagctggccccagctcgtcctcctccctccttgatacaaacttaaccagagcttcatgaaaggaaccgaggctaataatttaagaagtaatttgttattagtgtggcactgatgcactgagctgaccgaagtgcctttcagcagattattattaaatattaagtctgttgattcgaggcagagcggcactctggtcggtccctagcagctggggacatgcatttgtttcggtgatttatggaaatcaagccactccagggagcctcacaaatgtcgctgtccactgtaacccaggtatcctcccagcagtcccgggggtgggttatagatgagggagggtctgagaagttaaggaagctgcccgaggctgcacagcagctaggtgaaaaaaccaggattcaaacttggatctatctgagtcaagtctctgccactttgaagctgcatatggagcacacagtagggactcatcacatgtgcattattattattatcatctttccctcccaaacgtcagctccatagccatagatcagaatgtggatttttttttttaatttactaaagtatgtccagcactgtgagctcttgttttttttttttttttttttgagactgagtcttgctcttgtcgcccaggctagagtgcaatgtgcaatctcagctcactgcaacctctgcctcccgggttcaagcaattctcctgcctcagcctcccccaagtagctgggattataggcatctgccaccatgcccggctaatttttgtatttttagaagagacggggtttcaccatgttggccaggctggtctcaaactcctgacctcaggtgatctgtatgcctcggcctcccaaaatgctgagattacaggcatgagccaccgcgcctggccagtaacctcttaatatgctcaataaatgttaagatgaagggatggaagcatggatgggagggagggagggagggaaggagggaaggtgggaatagtaaagtcccggtgagagcaaagagtgacctaagagtcacttttcctgccttgttgtcactgtgcctccaccgaagtctcagagtctgtgatgttcttacctctccatgcctcacgctcttcacctgtaaaatgggctgagtcatcacagtgccacctcacagactcgctgggggttccatgagcaaatgcatgcagacctgctgagtgctttgccaggcaaggtgggcctcagtgtcaaccaccatccttactcgaaaaacctgcagaggggactcctgagcacctcgttccccagactccgggagaggaaccccaagtccaggaaggagatctccaggaaggagatcaattctggcccactacgggtctcagaccagaagcaggcctgagagaagtgtgcccggatcccctaggctgggggacccagaggagaggagcctccctctcgccaggtccactcccagcccctccctctacctctttgttccttaaagtcttgaagttgagctgcctccagaagcgcagagcttctgagaacagcatcactgaataaacagtccttccatgccgtgcctgtggtccacagagcggctgagacttcagaggactatgacggggcaggttgccctgtgagctggtcaggtggtcctgttccacttctctgggtgtccatctggggcggccacagaacctttgggctgaatgttggcttttgaacagatagtaatttttttctaacgcacctacaaaatgccccaaactgctggcgttcttgaggcttcacaccatgctagtcctttagatgttcaataccatgaaggaaatgaaagcagtggaagaaaggcagagaggaaggggcaggggcggcgaatgagtgacagaaaaggaggcaggtgactccagcggtacctggaggctcccgggcccacccgagccctaagctgcagcccttgggacgtctccattgagccagtccttcctgtgtggccttcggattcttggtggaggggacattcttgcacactagtgccctcaagtcaggactgccactcaccctccgaggtggccatcttctcagcttctttcatttctttctattttttttttagagacagatttcactctgttgcccagactggagtgcagtggtatagtcacagcacaccgcagcctcctgggctcaagtgatcctcccacctcagcctcccaagtatctgggactacaggcacacacccctgtgcccagctaatttttattttatgtttgttttagggacggggctcttaccatgttgcccaggttggtcttgaactcctgggctcaatcaatcctcccatttcggccccccgagttcagcttctttctttaatccatcacttaggccacagatatttaccagtcaggtattgaaacttacaaaaagcatagggcttggcaacctccctcttctccctggagttgaaggcagtacctgcctccccatcagcctggtagtgactgtttacgatgggtgcccaatcgctgatagaagaatgaatgagtggatggatcaagggagatttaatccatgctggagaagaagaaagaaagggaaggaacacagaaagagaaacaggccagcagggccccacgtgctgaatgtcaaagggtggaatggaccctggggccccaaagagttcaggacagaagactcttattggaccagtgcaggtggcggctttttgggaagggtgggatttcatctggaacaagagatgggaggcccaggtgggagttgagggtcccaataattagtacgttgttttccctgcctgagttctgaacctactgagagaaacaagagtaaggcagttggaggtacactcctgggttaattcctccagcgctgtggtgcccgggtgctgggcagcagtggggatgtgcccaggagtctccctccagcgtccccagtcagtcggggggcacccctcccctgctgcacgtgccggatgggtcccgagcctccctccaggggcaggcccttccctgccgggctccactccaggctccactgaggtagggcacaggccggctgtgccctctgcaggcagctgacagaagagagggaggtgggccagggttacctgccctgccctcaaactaaggaatcaagagagaccctcctggcaccaagcagctggggctgaagaagggctgggtccttactcttgacctctgatagctttatccccaaagaaggaactgccaagagggaccaagggctactccgaagggaggtagaggtggggtgtccctgcagcaggaagcacggagtcacatcctctccctactgagtgtgtcagagaggctgggggtgtggacagttggggtctggggctcctggacttctccagctggactagacattagaaaacgtcggccgggcacggtggctcacgcctgtaatcccagcactttgggaggtcgaagtgggcagatcacttgaggtcaggagtttgagaccagcctggccaacatggtgaaaccctgtctctactaaaaatataaaaattagccgggcatggtggtgtgcacctgtaatcccagctactcgggaggctgaggcaggagaatctcttgaaccctgggaggcagaggttgcagtaagccgcagtcacaccactgcactctagcctggatgacagagcgagaccttgtccccccaaaaaaaaatgaaaagaaaaaaagaaaacgtccaggcttcttcccttgaagccaggagcagggcccttctggatgccgcatggtcaagcctcatctactgtacctggagccttctcctgaccctgaaccctgcccttgcccagcctggctctcctgggggctcatgggactcctgaggcccctcccatcaccggtcaccccgcccgccaggcccctggcagcctcatatctgccaatacaaagccatacatcttggtgtgtgacaaatcactttttaattgcctgaaggaagaaatccattagtctttcctttccgtgagaaacatcataacgttcagcagagcccaggctggctggaggccgaggctgggggccgcggggctatttttagtttgcgtcaacatccccctccaagcatccattctagaaagggaggaattaaatcttcctgacaccccggggccacacggggagagcttgctgcagacccggggaggagaagccactgtggatggagtgttatttgtccaaatgaatttgtgtcacgtttcacaaaaaatctgcttccctgtaaacaagtggcagtcctcaccctcctaggcagctgaggcccagccctgtggggtggcactacctgctccccacctccccggccagcccacaccctctgtctttgtctggcatgtcctcggcggcacgggctgtggccgcagaaggccagcagctgtccagggtcacagcagtggacgttcgggccgaggggagctgaggccacggcggggactcctcactcctccttcctaagaccacagggggcagagttggggcctggggggctgctgctgggtcagtttggggttccactagcagtcctcaactttagagaaaggccagcgaaagtgaggtttatggcttgtccctgaggctgccttggggccagaggaagtgggtttgccttttgcctggtacagatgactctgtctcgattttgaaaaagatgcagaaagaaggaaagaaagtggagggcagagggaagggaagaggaggggaagggagtgaaggagagaggaggggaggggagggctaggaagatcccatccaaaaaaggggagtcaagggagatggctgggatgtggacaccacaggccgcccgccccaccccgggccagccacccacaggccgttgaggcagcaaggccggcaggtccatgccaggggtgagagctgagtccaaaggaggaactcagtgagtttcagtgaatgaatgaacgaatgactctggtgacaaggggctctgattggccagcatgtgtcttctgaagtcaggcacccctggcagggcccccggtcctctggggcgatgcctgctgagggctgggagctcttccttgggctggggaagctgcagtgcccagggagtgccgcccgcctccacccccaggtcttttcctgaagaaagcctgctggtgtgcaggggcaggctcaatctttacgtcagacagagtatgtgggctcaggacctgccctgtgacatggtcctaaagtaaaacttggaggggctctgggacgtctgggctgcgagcatggcccagtcacccgctagagatgggcaaagctgcgctttctcagtgcagcttctgtacccgggaaacctcagcactttcttgggtgcaggactggagacgagtggccacttgcaagctggagaagaccttggaatatgtcactgatgcaaacacaggagacttggctgaagaccacacctcctgaacctcacctggcaggtttaatagacagccacctagtattgtcacctctctgtggccaccaccctgggacacaacctatgaccccaggaggtgatacctcagccagtccctgtactttgagacccacaggcacctttcaaagaggcttctaccccacaggaacctggggcgctgccacaggtgtgaaaatgttttagcaagggaagcccacagtgggtgagctccggtctttttgctgttgttgtttgaatcagaacaaaatgcactacacgattatttctgtgcatgaaatgcaaggttgccaagtttaggttccacctgatgctaataaccttaattgtaaatcctttatgtatagacttgggctataacaacctcctcgtggcattaaactaaacgctgacaaaggtagagtgggccaagcatccctggcagcccccagaggtgacatggcagcccccagaggtgacattccagcccccgtcatcgtgtgtattaagtgacagggctcataaaaccccacagctcctttccccaccccttgcagtctggctcccagaggggcagatagttggagattctcatgcaaaataaattgctctgcactttcattaaaaagtaactgcaactgactcagcactttcagggtgagcggcagggaggggctttgtggcaaaatcaaaggacggggaggaggtgcctgcccctgggttcactctgcgtccctgccgctgcagcctgccctttgctgtgggttcggtttctctgcatcctagtcccaagtctgtgaccattgggtgtccttaaacaggcagctggagatcccagaatttggatcatgattttactggagctgggcaggccttgacaggggctctagcccagggttccctattctggaacaaaactaggaccgggcagggctgctgggggcagggacggggctgggacaccggcccctgggtccagcgagtgtgtgaagggctgcctccatggtgcactgggctgaggtgtggacgcagggctttctgcacggcaggcgcgacgctcatttaaatagcagatccgaccaaggccttccctctgctccacccgcggagtgctgccccgctgcctgcagcctgaagccctaaccctctaaagagtcccctgagctactcccagggatcccagctggccaaggtctcactgaccccaggcatcaactctggtggctcctgcccccattgatctctcgtccccctccctgcccacatcttcctcgtccctctgccatctcaagacatcacctgctccagagagcgtcctggaccaagcatggtcaggaagccctcggcttaggcaggggctccctgtccagtcaggtagcagcctctgagcaggcagcaggtgacattcatctgcagctgtgggctacagcgggcgcctcctcccccacagctgagaaatgcagcattcggagctcgcaggcatgtggcctaagcaggagggacgcattgccccacggtttatggggcgaagcatgattgagtggatggggcatcagggctgtctttggaaaggacacctttcctgtgatcctttgcccgtcggcagccagtccaagcaaacacagcccctgctccaggcagtcggcaaagtggcctcccccacaccatgaaggacgctttgagcccctgggagcagccagcagccaggtgcagccccaccagcttcagagtgggcaggacagagaggcccctgcccgagcaacagcagcaacacagccctggctgccaaggtcctaacaacccttctccaaaaggcgtctgtgcacagcggggctgactctcaggctgccaccagctggaatggggtggggctgagcccacgaggctgccagaccctggggacgctggtcctcaaggcctctctgctgaagggcatcgggatacaggagctggggcaggatcttccctagaagcttctcagcccgtcctcactgatgaatctcttcccttaaaatgaatttaggtcctttagccccagacaaatagacacactctctagcccctggaaggaaatgagattttaatttgggatgattttattcagcaaatgcccccaaaccatgcacttttcaaagggaaactccaggttcagtctcgccttttggggatagaaaaaaagactttttaaaatctttttcattcccagctcaaactgagaagggaaaacctgttcctctcaaaggggtcttttcctattttcttctacttcagaaaacagtctttcctcctgtctgacgtcgtggctctaggtttttctctgctctgttcttcatgggcccctgcctaataaatgtgttacgatcagaggcaagtttaccacggagctaatgatgctcaagcttggagccctcatttgcacgtgcagtgttgtgctggtagctgttgaacaaccagctctctagggggaaaagcctgatctgtggcatttgccaatctccatagtgcgagtactcccaccacggccaattctcaggctaccagcatgatgtcattgagtgcaaagttgagaggaaagatgtataattggctgtgatgagtcagtgcaagcagacatcagcaggccaggtcacaggctgtctccaggcccctgcaactgaatacacaaggagttatgtattcttttcattaaaaaaaaaatacccaggctgggtgcagtgtaatcccagcactttggggggccacagcggggggatcacttgagcccaggagttttgagaccagcctgggtaacataggagacttcgtctctactaaaaagaaataaaattaaccaggtgtgatggcaagtgcttgtagtcccagctactagggagactgaggcaggaaaattcttgggctcaggacgctgaggcggcagtgagccatgatcacactgctgcactccagcctggatgacagatcaagaccaagaccctgtctctcaacaaaaaaaaatgaacaaactatatagacctcagaccccaacaaactgagtctgcctcattacgatgtaggggtgggggttcttaaagaggtagggcgtgtgaccagctgaccagctgcctctccattggtggccctgccccaggctatgcttagaccaggcagcatagagctatcagtgtgggtgaacccacctttctactttgacactggaggagcatggagtttcctggcttccggtcatttgaacttcctgaaaatgtacccaagcgctgaactactagcaccttctagcatgtcctggccagaggggtcccagcctgctttccttccctttcatcctccccatggttcagagttcccctcggagatcacagcctccagatgcaaacagcctgccaccctcagggccagggttgcaagcacagagccctcgggccttccagtgttttatacatatttgaacccacatatagaaatctgggagtttcacatgcaaacccagatgtatgacttttcttgaagaatcagaagacctgacctcctggccctaaatccccacatggctgcaacaggcaggactgatggacagccacagccttgggggacaggacgtgggccatctggcttcccaggccacaccctctcaggctatctccccagtgctcaggctgaagagcagtggccttttcttatggtgtctgcacagtggtttttcttaaagaaatatttccctctacccaggtttcttccaaaagtgggaaatgaaagatagtacaagtgggccatgtgtttcaagagaaagcacgtagcatatttctttgtatgagtgaagaatgttcctcttggggctattgcgctgaaccattccaggggatatatcactccgaagtttgtgggaatggcgcctcctagagttgtgcattgcacagcacatgcagcctgattcctctgtttcctatgcaaactggaacagtgtcaaaataactccacttaggatgctatcgttctcatacagaattggctacatcacacatgcatggtggagtctgcccacctccaagatctcacagaaattccagccaggaatgatgagggcagacataggaaggcagggccagacggcagggccaacgtggaaggtgcctgcagagacagcatgagaactgcctgataggcatctcatgagtcagagaactagcgggccaggtagaaggttggcctgagttgagattcaggcaggggatcaagcagcgccctctgctgggctgtcccttacttttgcatggatcaccttgcagacttctgttcctccttcagagcccagctaggatgctgactcctccaggaagccttaccttctaggacgttagtcgtgccctgccctgggcttcctctgaaccctgtacacacccaacgttgtacatccttctctgtgtgctgtgattctgttgccatgatctggccccactccaagaacagtgcctggttcatgattgtgtacctggtaatggggacagtgctggtgcataagtgcgactcaatgaataattaattaaatgcatgaatgaatggagaaatggatggatggatgggtggatggaagacacgtaggaattccagccctggggacccaggctggggcccagcattagaactggagtacgggcagggtttagtcagggtgagctcctttggggaccagattttaccaggagagaaccctaacctggagtctctccatgagctcctggctgagtttctgaaatcctgccaccccccacccaggaaagcagctcctgctggggagaatagaagctggaagggtagcagtccggcatccaggccccagctcagctccatggctgtgagttcaatagatgtctacactttccaaggacatgggtaactggtgcaggaaatgttgtgcacattcctctttgcacgacagctggattcaccccccaaaaccgcccacctctgtgtctcagggacaccaacctggacgtatgggcctaattgctggcccttccagagtacaagtggaaacacgtgggccagttgagggtaaaaaatgcagtaagttaaaggcttctgagagatagttacatagtcaaaaaaaaaggtcaagaaaactattgccaaaacctgaaactctggtccttgattaattgactcaatcatagaggctttggcctacctctctgaagttgaatgaattagttgattagttgcacaaagttgctgcaccaacaggaggagggaagaggtcattggtctttagctaatggcacgtcccagcaagttgcttacaacctgccctgggcacgtcgacctggagaactggaggttgcagggtccctccgcacactggctgttgccaaaaaagggatgtgggggctgtgctgggcaggacagagtgaccttcctcgaggctccagctgtacatggcccagattttatgcccttcctccagcctcctttctttctcctgcactcctccctcccttcctttctggttccctccctccatgtcctcacgttttgacgctttgggatttgttttctgacccttggcctcactgcatgggcaagccccctgcctgtttctctcctgcctggagaagggagaatgggaaaatgatacctctagacagatctcgtccatgctgccttggctttgaggaaagaaatcaccacccttgtcataattattgatgggaactggatttgctgagttagaggttgggagaagggttgatattatggccacaggacttgatttggtcaataaagcaaattggtttaagtgaaaataaagcagcgctcacaagtatgttagaagaataaagtaattgctgcccaaggtgcacggaatataaatctctgtttgcttgaaattattacaatgtcgtattgattacttagaacctgccattgccttttaagttatagtttattaaagggtaatgtgtttaacaaacattttccccggcatgcaccattgaaacacacagaagttacacgggcgcgttcccccaaacccccactgcagcctttggttgttctgtggtcacgtgattaactttccaggctcagcttgcaggcaccagggtggtcacccacaggggttctggtgaactcaagatcctgccagaaccctgggagaggtgcatggaagggctcagaatgcgctgaccacactgacgtgtttttttgtttactgctctgcctggccaacaagataagtccatgaagtcaccagcaccgtccatgtttctcactgcttcctcggcgttcctccagaaccaagcgttacaccccaacacaggatgtgtgccataaatactggttgcatgaatggctatttttttttaacttcacttttttcttaattaaaaatttttaattacaaaggcaaacaggctcattataacaaatgaatacaattttaaaatatttttctaattagaaaaattaggcgtactcatagtagaacatttataagacatgggaaagtactaaaaggataataaaaaccacctataatcccatcacccaaaaataacctctgtttacattttgttatatttcctgccagtttgttgttgttgttgttgttgttttttgctatactcatgcctatgggtattttttcttttcacaaagttgataatataagatgaggtttagtgttttgcttttttttcacttaccattgtataaaagcatttcccccgtcattcactgtttctcaaaacatatttttttgttttttttgtttgtttgtttttttgagacagagtctcactttgttgcctaggctgcagtgcagtggcgtgatctcggctcactgcaacctctgcctcctgggttcaagcaattctcctgcctcagcctcctgagtagctgggattacaggtgtgtgcctcctgagtagctgggattacaggtgtgtgcctcctgagtagctgggattacaggtgtgtgcctcctgagtagctgggattacaggtgtgtgccaccatacctggctaatgtttgtatttttagtagagacgggatttcgccatgttggccagactgatcttgaactcctggcctcaagtgaatctgcccgccttgacccctcaaagtgctaggattacaggtgtaagccaccacgcctggcctaaaacacagtgtgtgtgtgtgtgtgtgtgtgtgtgtgtgtgtgtgtgtgtttgagccggagtcttgctctgtcacacaggctggagtgcagtggcgcgatctcggctcactgcaagctccacttcccgcattcacgccattctcctgcctcagcctcccgagtagctgggactacaggcgccctccactacacccggctaattatttttgtatttattagtggagacagggtttcaccgtgttagccaggatggtctcgaactcctgacctcgtaatccgcccacctcggcctcccaaagtgctgggattacaggtgtgaaacaccacacccagcctaaaacacagtttttaatggctgcgtaatatcccatcttctggatatgctgtaatttagtcatttcctgttggacatctgtgatgcttccggtgttcagcactataaataatactctgatgaacatccttataaataaatttttcatctcatccctgggtattataaaaggacaagttcttagcccttttcccatttgcactgagaataatccccagcagcacttgtggctgcagcatttaccccgagatagctttgacatgaaatatctcgcttttattattattttcacatggctctagtatatcgactttggaaacaaaagacctcattctatttttagcattctgtgtttagtagtggtatttccatttacaaaatatagcagttcccgaacgctgaaaatgtcaaatcctggaaaacgcagcatttctacatgtgatgttaacattgttctcaaacagttgttggctaaagactcatttgatgaatccgagttttctgaaatagacaattctgatgattcagatgattctgatgttagttctgtttagaaataactccaagaacagtttttatattttattttcacattgaaaatcagtgagatttgcttcatcctcaaagagtgtgtttatgtaaaattaaatgagtgctggcagcgagcagaacttttttttttttttctgaacaggaaaagggttaaagcaacagctcttggcagatgtcatggaaagggacagattctgggtgtgcaacctgtgccgttgtgttaaaccaagcttagtttaatgccttgctgccgtattctcaaaattcttaatagttcttaaaaaagggatcccacattttcattttgcaccaggtcccacaaatcatgtagcccatcttggttggtgtattagtctgttttcatgctgctgataaagacatacctgagactgggaagaaaaagaggcttaattggacttacagttccacatggctggggaggcctcagaatcatggtgggaagcaaaaggcacttcttacatggcggtggcaagagaaaaatgaagaagatgcaaaagcagaaacccctgataaacctatcagatttcatgagactttttcactaccacgagaacagtatgggggcaaccgccccatgattcaaattatctcccgccaggtccctcccacaacatgtgggaattatgagagtacaattcaagatgagatttgggtggggacacagccaaaccacatcagttggggaagactctttcccaccggtgttgaggagtcaggccatctctaaccattgagggtctttgtgccaggtctcacccttcatccccatgaaaatcaaagctcagagcatgatctcctctgtgccctgctgcactgagcctgagaattgtcgtacaaagagaactttctatgcagctgaagtttacccttcaaacactgagtccatttagtgttgctataacataacacctgaggctgggtaatgtagaaagaaaaggggtttacttggcacaggattctggcagctggaaggttcaagactgtgcagctgcatctggtgagggtctcacgcagcttccactcatggtggaaggtgggaggagagccagcctgtgccaagataacacgtggcaagagaggaagcaagagagagaaaccgaagaagccagactctttaacaactcgctttctccggagctatttcattccctcaggaggaagaaattaccccttcgggagagaactaatctgttcatgagggatctgccctcataacccagacatctcccacatggccccacccccaacactgccacactggaaatcaaatttcagcatgggtttcggcagtgacaaaccatatccaaaccatagcaaacaccaaaacttatatattatcgtggtcattcatgcctcatttatattgctttttatttgaaccataacttgcttatgccgttatttttgtttcttctttgaatttccaattctccctttcactttttcttaaatcttgaaacaatcagacatactaaaaagttgggagtacaattcaaagaaacttttttctgaaccatttgaaatttgccagcctgatgtcccatcaccccccaagtattttagcatctatgcaacaaaacattttctctgacaaaaccacatcagaactctcaaatcaggaaacaaacattgatacatgtctatcaactaatcctgtcttcaatgacattttaccgattgttccaatgatgtcagcatcacgggtcacatttaatagttgcgtccttcagtctcgagcagttcttcattttgtcattgacttttgtgaccttgacatttttgaagattacagaccagttactttataaggctgcccctcagtttggttttgtctgatgttttcttgtgattagactcaggtggtgcatcttgagcaagagcctcacataagggatactgagctctgtctggtggcccaggatttccaattttttttttctcttcaacttttaagttccaggatacatgttaggatgtaccctggatgtgcaggtttgttacataggtagacatgtgccatggtggcttgctacacagatcaacccatcatttagctattaagcccagcatccattagctattctttctgatgctctccctccccacccccaccaccaggccccagtgtgtgttgtccccccggacatgtccatgtgttctcattgttcagctcccacttacaagtgaaaacatgtggtgtttggttttcttttcttttcttttttttttttttttgagacggagtctcgctctgtcgcccaggctggagtgcagtggctcaatctcagctcactgcaagctccacctcccgggttcacaccagtctcctgcctcagtctcccgagtagctgggactacaggcacctgccaccacgcctggctaaatttttgtattttttagtagagacagggtttcaccgtgttagccaggatagtctcgatctcctgacctcgtgatccacccacctcagcctcccaaagtgctgggattacaggcgtgagccactgcgcccggcctggttttctattcctggattagtttgctgaggataacagcttccagttctatccatgtccctgcaaagtacatgttctcattcctttttatggctgtatagtattcaatggtgtatatgtaccacatttttaaaatccagtttatcattgatgggcatttgggttaattctgtgtctttgctattgtgaatagtgctgcaatgaacatacacatgcatgtatctttataacaaaatgatttctattcctttgggtatataaccagtaatgggattgctgggtcaaatggtatttccacttctagatctttgaagaattgccccactgtcttccaaaatagccgaactaatttacattcccaccaacagtgtaacagcgtttcttcttgtctgcaacatcgccagcatctgttgttttttaactttttaatgatcaccattccgactggcatgagatggtatctcattgtggttttgatttgcatttccctaatgatcagtgacgttgagcactttttcatatgcttgttggctggacgaacgtcttattttgaaaagtgtctgttgatgcaggatttccattttactcatgactggtgatgttcaccttgaccacttaattcaggtggtgtctgcaaggcttctccactgtaagcttactcattttctgtttgtagttaataaatattttgtgagaaagtactttcatagtatatgcaagtattccccatcagactttcagtttttattcatttgtttatgtataaccttattttattcaatggattataatctattaccattgttatttatttcagtgttcatgttgtctcagatttggttggtggacctccattcaagctggtttctgggtcatttgatataagcccaatcattctttgagcacttccttgctttctgaacaagatgttccaggcatatcttgtactttcctgaaatcaaccatttctccaaagaaacctggtttcttttagtggaaagtggtgtttagaagccaagatctgggcctgagtatgctcactgctcccaggcctctctcagtagatagagctggggaatatatgtatcatatgcacacacacacacacacacacacacacacacacacacacacagagttggccttccacattcatgagtttcgcatccgtggattcaaccaacaacgggccaaaaatatccaggaaaaaaattgcatttgtaccaaacatatttttttcttatgattattccctaaataaaacagtataagaaatatttacatagcatttacattgttactaggtattataagtaatctaaagatgatttaaatcaagcttgtccaacccatggcttgtgggctgcctgtggcccaggacagctttgaatgtggcccaacacaaattcataaactttcctaaaacattatgagacttttttgcaattttttttttttttagctcatcagctaccgttagtgttagtatatttatgtgtggcctaagagaattattcttccaacataatctccctgtacacaaccagtctcacatctctgccaccccatgtgggccccctccaaacccagactctgacaccccttgcaagggcactccactgtgtggaccccccactcacccgtcaatatgcccttatgctgttgtaaggaggattctgaagccatctccaggctcaggggaaacagtgacgtgattgattagtaatgtctgccatgaacagagggacaggaagggttcctgccacacatatgctggccccgacttaagatggtcagtgtgagcatttatattgatcaggtgaccatatcgttttgagagagaaataagaattaacaattgcaaacaataaaagttgacagttatgctgggcaacaggcattaaccaggtcactggtcatgccctgtatgggtactgaggaagcacagttctgggtctgctctgtggttttcgaccctctgtgttgggcacatgtctacagtttccagcagctcctttgccacctcccccaactccttgccctcttctgtagactgtgggagggtctggcaagcctccttaaggaggaagattcccatgcagggtgcgccttaggaatggaggtgcccatggagggcaccccttaagggtggaggtgcccgtgcagggtgccccttaggagtggaggtgctggtggagggtgcccccttaggagtggaggtgctggtggagggtgcccctttaggggtggaggtgctggtggagggtgcccccttaggggtggaggtgcccgtgcagggtgccccttaggggtggaggtgctggtgtagggtgtccccttaggggtggagatgcccatggaaggtatccccttaggggtggaggtgctggtggagggtgcccccttaggggtggagatgcccatggaaggtgcccccttaggggtggaggtgcccatggagggtgcctccttaggggtggaggtgcccttgcagggttcctcttagaggtggagatgcccatggaggtgtcccttaggggcggaggtgctggtggagggcaccccttaggggtggaggtgcccgtggagggtgcccccttaggggtggaggtgctggtggagggtgcccccttaggggtggaagtgcccatgcagggtgccccttaggagtggaagtgctggtgtagggtgtccccttaggggtggagatgcccatggaaggtacccccttaggggtagaggtgctggtggagggtgcccccttaggggtggagatgcccatggaaggtgcccccttaggggtggaggtgcccatggagggtgcctccttaggggtggaggtgcccttgcagggtccctcttagaggtggagatgcccatggaggtgtcccttaggggcggaggtgctggtggagggcaccccttatgggtggaggtgcccgtggagggtgcccccttaggggtggaggcacccatgcagggtccctcttaggggtggaggtgcccatggagggtccctcttaggggtggagatgcccgtggagggtgttttgacttctactcgggactcaccaggtcccttctcattttcttccgggttgaccttgttggcagcaggaagctgaccgtatttgaccttctcctgccaccacagaaccccttggccacctccctcatccttattcccccgattggtgcccacagaacctgtgcttggctgtcagcaaaggcgtcagaaatgggatgactcatttcctctccaatgccctggggcattcagaaagtctacttgtggaaaaagtgctttagataaaatgcagttgtggactggcccagctttagtttaaatcttttcatctcacaaatatttttaaggacccactatcaatcagacaatgtcctcaagtgatatgtgaggttcatgagtgattaaaacaaagacacctgtgggccgggagagacaaacagaaaagaaaaaaatgagtaactcaagcatgtcagaaagtgatatgtgttgtaggaagaagaaagagctcagagtaagaatgggagggtgagggcgggagggtttcattcttcaagaacttaggagagcctcctgtgtgccaagcgcccaggcttggccctgggggctcagagaagaggctggccccatctcagagaccacagcatctatagagagaggaacataagagacagaggttaggggctctggtgctcggaggaggagtctcaaaggaatctgaaagagggaaggaaggaggaggagggtgtgcaaaggaggagaatcccaaggagtcattgcaggggagtggaggagagggtgcagggagtggaggagagggtgagtttctgggaggggctggagtgaggctaagggtgcccagaggcagaagacagctgagctgacctagtaactttggatttaaaaatctgtgaatccacagctcccagagtggtaggaagagaagctgatacagagggttaatggagtgttaaatgcagatctttctttggagaccctggtctgggaggggaagaacaagatgatggttccggagtccagtgagcaagtttaacctgggccactcaccattcctttttgcctcaagagtgtggccctgatccagagtcctgaatggggaagcccagggcctcccactgcctgtgccacccagccactcccacccggctttctcccacctggacctcccctccctggccctggccacctgggcccctcccatatggtaggggcctcgccctctgtcccctccccataatccctcccacctgggcccctcctacctggccctctcctacctgaccctctttaacgtgatcttttcctacctggccccctcccacctggcccctcacctaaccacacctacctggcctcctcgcagctggccctcccctacctgactctgtctcacacagtcctctcctacctggcccctccccctgactcctccccactgaaccctgacacctgcccctcccacccggccctctcctacctgaccgtctttcacatggtcctctcctacctggcccctaccacccggccccctcacctgaccacacccacccagctgaccctctctcacctgggcctctctctcccaggcccagcagcagcccatagacaccccagctctctctgccccctccccacgaggaatctcccttggcctccttcacaggaaggcaaagtacccccgcttcattttaatggatttttgtctaattactgactggaacagatgcagagacaacctcattgaaaggtctgggaaggcgcaggattggcctgggagagccagtgtgaccttcaccctcacagggagggaagcaccacgaggttactcactagtccctcctggtctccaccccagtctccaccctagccaccctggggcttccctgcccagaggggagaagcaaggaagggaggagggtgcttatcacatcctgtgcccagctgggctccggaggtcggacaagagctgcagggccaaaggacatgtgtgcgcaggtgcactgagtgtatgtgcatgtgtgtgtgtgcacatgtatgtatctgtgcatgagtgtgtatgtgcatgtgtgtgcacacacacaggtgtttatgaggaagaaaacgcagggcacagaggaggaaggcacccagctagttcccagacgcttgttccttctctccattcgtaacagagcatgcctgaagtggccttgagctccagagaaccgtgtgtcttccaggcaacttcctgtgtccatcgggtcacgtcctcaccgcaggctcccagcagccccctcccctactggggacactgtggctgctgaagcttcctgacactccagagaatttaatgcaacccgactcccctgtggctttgcctgaatagggcctgatcaggcctgggtccccgtggccctcagagcctgtccctggtgtccagtatctgtggcccttggagcctgtccctggcactgggtctctgctgctgggactgctccctaagaggttctctctggtcttaccagctggctggttcccaggggtagaaggacacctcttaggcttctctccattcctgatggcctcagcacagaaccaagcacagaaaaacccccagggagggagagttaagtaggactgggactccagtgtagacctcagccaggttccaggatatgcactttttaaaatcctctcatttaatcctcaccagaatcctagaagtgggcctgtaggtgaggaaagagaagctcagagaggaccagtgacttgccataggtcacacagtgggagacggtagaacttggattcaaaccccagtctgaccccaaggggcaccagcctcctcctttgacagagcaaggctgatggccagagggactgatgaagtagccttctgaaggccaccacacccccccagtgccacccagcctagctctggaggcaagggaacgatgcttctgccacaagaggctgcatctctggaccgccaagtcccagaacaggacctctgagcccggacctcactcagcccctgcaaggtgccgtaaagtgtgatgcagagcttgctgcacagggtcaggcaaaccatggccccatttctccatccacccaggagccattcccagttgtgttcactgggaacagtggatgtgcctgtctcggccagactctgcttgtgaaacagcattcagcagactctcctgtgtgtgcgcctgacacacaggggtgggacaggagcagagcactggccgacaggagggaaggaaggaggaagtccagaagctggctcgcctgggcttcaggccgcagccactgtgagccctgtccatcccgggtcactgcccacgcatatccaggaggttgctcattaaactgaaagcaggggaggactggctctcctgcttcctgtccaaacactcagggctctggagcagcccgcccagttccgcaatggtgcactgcagcaaagcagggaggctgggttaggggaagagctggtggaggcccctgccacagctcccgggatggcgtgctcagagttgacctccagagtcacagtgaaccaggaggttacagtccaaggagcacggagccgcacggagagcctcttaccctgtttctctcctgccctgtccatgttaagcagtagctgagtggggatgtcattgtggcaaaccttcccccaacagccggtgaggacagagggacctctgggagctgcaataggaacagccgcagtctaactggctttcagagaagctaaagactgtgctaagattggtagtgagaacagggcctggcacacatgaagtaccttgagtgaatgaacgaatgagtgagtgagtaaatgaatgagtgaatgaatgaatgagtgaatgcatgaatgaatgagtgaatgaatgaatgagtgaatgcatgaatgagtgaataagtgagtgaatgaatgagggaatgaatgaatgagggaatgaatgaatgagtgaataattgagtgagtgaatgaatgagtgaatgagtgagtgaattcagggctcagctatgatgaagagggcacactggcagtgagggagagctgtgcagaaatctgtgctttagagaaagtgtagtcatccattcccagagccatcagctgtgtattgagtgctgccacgtgtaggggctgagatgcaggacccatcccacagggctcccctggagggagctcacagcctagtggactgaaagattgaaagcaagagggataagcgaagctcagggttctgtccctgaccctctttggtgtcccccatctgtgcacagaacctggctcagaggtgactgcacagatttcctggaggcccagatgggggtgctgaaaggtgctgagagaaacttccctggtttaagcctcaggaaaggaaagggcagcttcccagacatctccaggcaaagtgtcaggaaccctgggtcctgtagctctaacaagaattctcacctgcaatcaagagcttggattcaaagagaagggaggtcgtgctctgcagggctatctcaacagtgactctgagtccaggcctgaacagccacatgatgcaggggcgtgaaatcagaagtgattgtcaccctgtgctaagatgagaccaacatgactgcccccctgctctgtctctggggagtctgtactcaggtcctagcaatttgtactcaggttctttcagtgggccacaaagtgatgggttctggactctaaaattcctggatgtgggctctgttctagtgcacactgcagggaagtgtctggaagcatgagagaagagggaaataaatgtagaagatggcctgggtggtggtagctgaaaatttcctccacataaaggaaggcaggagtcattcccgggttcgtttcattacatggaagaagaagggtgttttcctgccaggtacctcccttcaagctcccttgctggcccagggcttaggaattccccagaagtggtcatcttcctccatttctctaccctgcactccttcactctttcagctggttgcttggcagatatctgtagagacctagtatgtgccaaatgctgttctaggtgtgaggttgctcttcctcgtcttagttctaaaccacttgccttacatgctgcgataacaaatcaccagctgccaccttcccctcccgtgcccagggcagacattactaatggatcacagcacattttccaaatgcagtctcagaatcctgcccagcctggccctacagctgtcagctgtcagtagaagcccatgaataagagaaaagtaatttgctatccctgctcttgccccctcctgtcactgcctccaccctgatcatctctgacctgttggctctttctgccattttcagcctcacacaaacactgacgatgtccctcccaccctctccttagcgtctgcctttgaccacaagctgggttcttcctcctcccccaggacttgagtttcaatgaccttctgaggttgtcccagttcctggaaccccttatcttggcttgcttcatcccccccaaccccatgccaaaaaaagaagccagatttctgtagggcagaaacaaaacccagcagacttcccaagccagatggtgggggcccaaatctgagaactgaatttttctgactttttttttcaagcaatctgctaatggaggcgagaacaagactcagggagttatcagctgcctctgtcaacagtgggtaatgatgtgtgaatgctggcacctcccagtaaactgtgaacctcaagggtatccccaagtgcctttcagcctgcttgccctccaggagaggggattgctccccagctgccccttcaaagcctgcagcgagatgggtgtgttctgggagccggattggcctgtggctttggaaatctatttatgggacacacagagctcgcccttttttagaactagaggaaactgacagcttcgattgacagaaagctccgcgaaaaggaagggagcatttgtttccatttttaaagtgctcaagcttatttgggggtgcatgtgggtaggacccaggagggcagctgggaccagaatttctcagagccaaagcaagcagcccctccattcatgctccctccatgggtcctgtgggtctgctgccctccacccacctgtggccaccccacagccctgctcctccttctcctctttctctcctgagacccagagctgtgccctccccaaagccactctctcatcattccccagggcagacagagccagggcctggatatcccaagaatcacaagcttggaactctcacccaaggagccgaatgaggtcctgctcctggaacaggcaggagaaaagcccctggctcccacggagctccagggcccatgggtggctctggtcacatttgcagcctggtgtccctgtctcccccagcaccaaggcaagcacctagcacgtggtcccccaaaccaagctcaagcccaggagtcattcattcacctcctctgtcacattccacccccaggtcaccactaggtctgtccacctgttctcctaaatgccccaaacccaaccacgtcctgcatctcacaccagctccaatctaagccgctagggcccttttttccaaatgcgggttgtattaatatgcagccatggtgaggctagcagatcagcaggcggctgcctgtttaagatggtttgttactcatagatcccatgaggagggggcaggccacgtcacacaggaccacttggggaagcagggagtccatcaagaggcagagggagccgggggcaatgtgggcagagcctctattgtggtttttgcaggaaggaacaagtaagacggggtgagcaggctttggagaaattcctggggtaattcctgcgggctctgggcggagaggctgcccctaagttgtccctggcctggggtgactagggcagctagatggtggcccttgggggaaaccctgatagaggaggttgtggggtatgggctctgggtgggttggtctgaaaggtgggttcccaggccagtcctttgctatctctaggaattgaccagccctaggggggcagtccctccaggttcagcaaggccccagaggtcaaagcatcagaaatacagaaaataaaatggcatgacgactgtgccttcttccggaccctggccaaggttttctgagcatgctctcacccttgcaaactcttccttgcacagtggctagcaataatgatcctcatgtggtcattacagccatgcacacgcacatcacctcgccaattcaacaccactgttctaagggtggccactgtggccattcctgctctcaaaccccatctcaaaccttgtgccccaccccacgctccagacacactggcctcttgcaggtgtggaatgcactcaattcgtctgcctgggccatccacctcccctcctctgctcacacccactcagccctgtgacccctgcctaaggatcctcgaagaaccagctcccctccctcactgcttgggcctctgtggtgggaattttggatccaaaagggccaccccactcagagtgagcattcagtggggcatgctgggcaccgatgacagggcacagctcatggcgggcactccagaaatagctatagaagagtttctcaaatcttcatggtgaccctttgaggcaggtgttcttgtttatccccattctttagatgaggagatggagcatcttaacccattgttaacatgttcaacagccaggcgcggtggctcacacctgtaatcccagcacttggggagaccgaggcgggaggattgccagacctcaggagttcgagaccagcctgggcaacatggcgaaacccggcctctactaaaatacaaaaaattagcggggcgtggcagtgtgtgcctgtaatcccagctactcgggaggctgaggcaggagaattgcttgaaccagggacgtggaggttgtagtgagctgagatcacgccactgcactccagcctgggcgacagaacaagactccgttcagaaaaaaaaaaaaaaagatgtgcaacagatcccatcacatctaacagcaggagtgtccagagcccggccaagcggacagaccagctctctccccaccctgagccttcacttcctaggctgaacagtgaggatttgggctggatgcttttccagctgttccccagctgtgacattctaggatccggtatgtttcatagccactttctttagaggtctttattttcttgcagaaaagcaaatgaaaaacataattttcattgcttctaaaagttattggtgaagtaatacacattcatggcaagatgccagaactcagtgggcggatttggcccatttctcccccagctcccttttgcccgtcagtcaattgctgcatatttactgggcacctaccgtgtgccaggctctggcccagacacagacaccgggtgagttagctggacacagtccctgacctccaagacctgcagccatagatccttgtgatgtttctggaggggctggcaggaggcatctcgggatctggggtgaccgcaagggtcttctctgggagcatctgagtggaggaagaaaagtgagggaggactgtctggggctgcagtggacagcggggtgggggcaagtctggtctgtgccaccagccccgtgagcatctttacctcgcggtgtggtgtccgtggggcttccggctctgggctctgtgcctctcgcctctgccattcccggcatcctgaggtaaagtgataaccaggcctcctcctcgcctggctctctgccactcccccagccaccctcctgtgacccaaatcccctccaggcccctcgctccggcagcctcttatctcctgcttcccagagccccgttcttcccagtccagctccgcctcggggccgcatggggcctgtgctgtgcctgctctcctgctcatggcgccagggcccccgcccgctgcctctgctcctgtgggactggattcaataccaacatgctgcggcgtcccccaggcatggcaggaagaggggggtcaaggccgccagggttgaaggcggggagcatggagcccctctggatgggacccaggagccaacacgccgtgcccctccagccatccaggacagggtgccccagcagggcccagacagctgcttccctcactcctgagcagacagggaggaactcggctcccttctccagggaaaagtcttaaaatgtatttagggacccactgttgttccttccaaagttgcctgctcggattaagtccactagggctgatgggcagtgggcatggtcctgaagatgggaaggaatacctcagccatgtacatccctgtccccccagccccgaaacacacggaactcacccgctctgcgggtctggggtgcagaggagaagcaggggcttccgccaccccctgtgtctgcagccccaggcctctatacagtgaaaacccactcgcctgccgaggctgtcagaattaaagaaggatttcagcagctgtagtcattaagataaaagttgcactaatgactccagcgttatttagttctgatatcttaatttaattggatttttttaattaagaaaaagacccataatcctgcaagcactgagctggtgcagccttttcacaagttacccttaaagggctgggtctcggacccccgtcccccctgcctgaaggccagggtcactttgggagaggagggacaaagggccaggtgtctgaactgagaaggaagcaaggagccaccaggagagaaaggccaaggctcccccacatggcagccgctcaggaaggaggcggcagctggcaccggtggtgctgtctggcacggaggccggctgtaggcattgccgccacccgccaagaggggcccgagtggtagccattctccacccccagagcctcccacgcaccccagacatgggccttgtgcctcctgtccctccacccagaagccccgtccttctcaagggcacacggccctcctgcacccagctctgcccaggggaggggaggttctcaagctgaccctcctgcctcctggccctggacggccacagcacctcttgccctccctgccaccttcccctccaggctgtctcagccaggggctgcttggcaacagtgattgatggtttaccaataggagtggaatgaaattttaatagtctcagattaaaggatcagagagcagagggaagcggggagcctgcctgccgacttggtgttttcacgccgagcacagctcggagccctgcagaaggacctgctaatgccacggtttggggaggtgttggaggggtctgcactggaggattcctgagacatcaggcaggctctgagcctgcgcctgtcacagggtgggccggaggacacacggctccttggggtccagagctgagccccaggagcttggcatcctcactgaatcaggatgcaccccaggatgcaactgattgcaccccgatgtcctctgagcatcctcctccctagatctgggctgaacttccagcttctgggaggccaggggaggggggcctcagggcctgactgcaggagaattctagaaggaaacacaagtcagactcgcagcgagtttccggaacctgtctgggttcttggatgagagcttggttctctgctgttcttaggaaaccatgatgtttctgttgtttgggaattctgtgtaaaataaatgggcacttcctccaaatcacatgtgactctgggaccccaaggcccaggctgaggatggatctaaatggggatttgacctccagctcaggagggggattcttctcctctcccccaactgtggggtgattgttcctatccttgtccctggtcccgaagggggaatgagggcagcagggccccctggcacctgtgtgggattctgccaccacttcttgtggccctctaaggtgcccctgcacactctcctttctgcaggccccactgcccttcaggtcccctggggtcgcttgtgtcccctgaggcaggtgctgaggctcaccctgcagcccaggctccaggcactgagccccaggggtgagaggctgagcagagtctaacaggtctctgcggcagcatgggctgggagctggagccgggaacatgagatgtttctgtcctctgggcctcagttttctcctctgtgaaatgagccatgtagaagatgggatggccaatgtctccatcaggccccaaggatacttggccatctgggccatgagtaaggcctatgcatccaaagccagccattaggtcctcagacgtgcagacaggcagggctggctgtaccacacgggccaggggagtatgctgtgatggattgtgttttgaggtcaccgcggccggtgtgcatctcagctggtgtaagaccctgtgtcactgagcacggtaacccactggctggctcatgcgactgcctaggactgctttggtgccatcagcaaagagcatcatgagaacatgggactcggggcaggcactcaggtggggaagagagaacacacaaaggctgggagctggggcctggaagggcagggacaggcagggctggaggtgacaggaaggaacgctggggtatgggcctcactagagcccagatttatccagcagtgccagctgggagcctggaagaacaggagtccctcagtgggggtgactcgtatgactgtgaaggacaggctgggacctagaagccctggccctctgcgctcaggctcagggggtgacgctgggctgggcgcttcccatgaggcaggatcctcattgctgtcctttctgaacaacgcccaagaatccaggcatggccaggggctggccgaggggggccggtgggtggtgaatgaagggctcccagcaaaccacagccgatccaggcaggaagagcccaacaggttcagcaggagcacctggatctgatattgatcatcccagcccctctaccatctgctcagctaccaaggctgaggttggtgctcctggaggagcctccaggagcccagctggggtgatggagggacagagggacaggcagagaggccggcgggcagcaggccaatgggccaggcaggtggggcaggagcctcctcttgggagtcacatggcccctgagggcatgggactctccctgctgggcacaccccagcggcaccagcacactcctcatcctctaggatgagcccaagcagaggtgagagaaagcctcttgcctgtaaactcgttgcaggcgcagggatgggctggttcagggaggaggggagactgtgggcggcttgcgcagcaccctctgcaggcagagctggttacatgcagcagtggcacaggatcagcaggcaaggctccatgatgcccgtcagaggccacccctccccagccccctaggccactgtgttagattcttcacgacgcctgtcagaggccacccctccccagcccaacaggccatggtgttagcctctccacgctacctcccacaagcagaaatgactcggggatggatgagaacgaaccctcatccctgcctgcacgccggcctggaggaggaagccatcctcgaggcagccttcaccagcatgtgtcaccaggcactccatttcctgggctccatttttcccctgacctgcccagtcctgtgttccaggtcagaagagcaaacgcagtctccagagagatcatgaggctttctgcagactttgtccccatcgaagggtcgtggccaagatggtgattgggagatggtgttcagggaagcctttgtgccccaggaaaagccaggccaggcgtgcctatctcctgccagcctcactacccgcaccaggattcacgggttgcagctgcccagtcctgaggcccggcaccccagctccggcccctcccaaatctgctattgtaagcactacacaaaactttaaagaatgtgtgttagacaactgtcactcagcatatttgatggtgttttgccttggtttgaatatgtaaaggcactaagctgtttaattcggtgcttcctgcatcgttgggcagtgtaactcagttgggtatcagggctggtggcagcagcagggcaggccgcggcagctcagctaatttaagctttgtttgctgcgatgctggaacttctgcctggctctccgcattcttcccccaggctggcagacggctctgcccactcccgcccgcctgcgacacctgtcctgctgctccccttgacagctacctggcccctgacaggcagcagtacccgctgtcacgctgcctgcatgtcccagaaatgttatctcctctttttcggagatgtcacccacaaccgtccgaagagatacccaaattgtacgccactgctcagatggtttatctgaccccgcagctggcacggagatgctgggagaagggtctgatatttcccgcatctgccgttaaccctcgccaggccagcagtagcccaccccacttcttgttctcatggtccccaggacccccaagcaaggcggacgggatgacaggccctctaaccccaccgcccactcacctgcagcctgtcaacagccagctccgggactctcccagggccccatgggctgtttagccagagcttggggcccacccaccccagctggtccttgaatctggatttggttgggggctgtgaggcccatcacagaggtgctttctgggtacactgcttcccacattctagagacgactctcaacagccagcccctgctgggacttttgtggcctttggacgcccaccagcccctccccagccccaagctattgtgtccagtgtccagggtccctggtcatcgggctgtagcccccaggcatcggggcagccccatgccccctgctcctttctgtcctggacttttcctcacacatgggggcaagcggccacagagacaggacactaagtacctgccagagtcttccgcgcagctgctagaagcgaacctgcttttggactggcccaactccttacggagaggcagggatgggggtgggtctgtggaaccagccgcacctcaagaagcctggtttggggagatggtcaggactgagacctgcagcacagcaggacctgggaggtcagcgaggctcggtgggacctgctagcagctcccgtgccttctgttcccactcgggccccactagagcctgctgtccaggcccaaggctggcctcctcatgtggagtgggcccagctgtagcaagttttgtcttcagccttccacatcagggtgttagcaacccttggcttggggtggctctgatggccaccttgagactggatggcagccagtgcgtttgctcacggccttgtgatctgagtggtatcagtgcttctgcaaagaacacagcattctgggaccacacatctttttatgcccattggggaaactgagtcctggagagatacagcgacttgttgaatgctatatggctctgcaaagtagaggctcctgcatttacccagcaaatattattgtgtgccctgcaaacaaagcagaccaaatgcctgcccatggaactgcattctggagaaggagacataagaacaggagagctaagcagaacctgcagaatattccatgggggtaagcgctgcagagggagggtaaagcgaggaggggctgggtggggggtagacattcagacccaggccttgggtgtcatgactgatctagaagggtccttttggttttaggtttttagaattcaaatgaggagaatcaaatagaagttgaatcctattctccagaaacatcgttctaggtgctaggcccattggggctctccggatgttccgaccccatgtcccctcctggggtgcacccctcctggcctgtggtcctcccagaccctctatttccggctattgggtagggctggcctttgtcactccacctgccaggctggcttctaaggcaagagtctctccctgaggaggagacgccaactcagctctaatcttccccttcccggagacggcgtgctgtctggattatcgctactgatgtgatttgtaagggccgtgggagggacagcggttatagtgaaccctgaaaattaattagagagggcggcgccttcacagggcaagtggctaagaccttgcttcttcagaagctctgtaagctcccatgccgtgggaaaacgggctcctctgccctctgtttcctgggatggcccatgcaccaaaaatgagacacagcaaatatgagtcttggttgcctgtgcatgcctgcgtgtgtgtctgcaagcttgtgtgagtgtgcatgttcatgtgcgggtatgtacgtttgcaggcgtgtgtgtgtgtgtgcgtgtgacccccagacatggttgtcgtccaggaagctctgcaggccctctgccctcccagtgtccagtggagtgagggctcagggactggaaggagtagaggggtcctgggaggcacgtgaagcagaggaggacaagcaaaaggctgtgaggattagaaggagatggagactgaggcagaaaaaaggagagttgagagggatgagaacaaagagacaatgaacaaaaacagtggggtggaaaaaaatagtcaaggagaaggagggtgggggacagagaaatggagaaggagagagagaagcaaaggaagcaaggtgggagagtatgagagggatgaggaagacagggtgacaaccacgagatcaaggtggatggggggtgggagcagaagggcaaggcccctcagggaggtgagggacccaaagcagaggggctgtgggtgccagggggctccctggggagactcctgccagtcacctgtgctacctggatatacccctcacacccccaccctccacttgccagccgatcactggggcagaaggtgggatctccatctgtccctcctcattccccggagaagcacccagagagatgtagctgccataaagggctggagaagtgggcgctgcctttggggcccacgggcctatggggatgggagtgaggcaggctgtggggcagtggggtgagtctctgagcaggggcagaaggctggtgagggcccaggggagcctactgggacagctgacccaggcttctaggccccagggacaacccaggtccctgaccacgtggtagagtgaagaggccaggaacagagggcttggctgagtgtccacatcaggggctgggctttccgcagagagcctggctctaggctgtccggaacagcaggacggggctggcagagcttgggaccctcgaactccattgggcctacctgactgagaccccaggagagccaggtcctgctcctttggggaggctgcctgggggcctcagccatactgtggggctccttggggaaaggaattcctgggtattttctgggggctgttttatgttgtttgttttgtcctcgtgtcttagtctactcaggctgccatgacaaaataccatagaccgggtggcttaaacagtagacatttacactctcacagttctggaagctggagggccaagatcaggatgctagcgtggttgggggctggtgaggactcccttcctggcttgcagacagccgccttctcgctgtgtcctcacatagtagggagagagagagagagagagagagaatcttactcttcttagaagtcttccaatcctattggattaggaccctggccccatggcttcattgaaccttaattaccttctaaagctgtatctctgattacggtcacactggggctttgagcttcaacatatggatgtggcaggatacaattcagccatagcaccttgaaatcactttggaaaaaaagatggaggttttcctggatcctgcctgtgctctctagagactggagacaagggatctggtgcgagccgggctgggcccctgggtgacccccaggcactcactgtccctctctagacctttctttccatttataaatggcaaagagccatcgaccctgtctctggaggatgttgggagagatgattaaggttatttttaagtatggaaagcagcctttggagataggcctagtgtaaataaggctggttttgttactcgtaataaacatttattaagcacccaccgagttgcaggcaggcactgcacagaataccaaagagaacccagcccagcccctcaaacttcccaccagcccctgcctcgcttcctttcttccctccctcccgtggttgttgatgagcagagagaacctggcctaagcaggcaggcagccccagctccaagaaaatcacatgaccatggctttgcagatctcaaaaccgatgtgacacccagacctcagcctggctgggccacagagccctccacaggcacccagaggcctgagtccctctgggctgtgtcacacttagaaggctctctcagcctcatccctgcacatcaggagggaagacaacgagatgtccagtctttcccttctatgcccagtgggcttcatcgtgcggggagggcaatgagaccagcccaagccccagattggcactaggagcatttcacatgctgccagactcccgagcaccccctctgtgcccacacggacacagtcttcatgggccagtcttcatggaccttgcctgctagtaggaaggagctaaaacaagtgagcgtagcagatccatgaaaatggggacttttgtgtgtcccaccctgggtcagggtctgggatggaggaggctcagagcagacagctgttagggaaataagtgaggccagctgagtgaccttggggacggggacctcaagtgtggataataactccagagcaggggtccgttcccggaatgtggttctggaaggcactctgaggaggcagcttggctggcaacctggcagagtagaaggggcccatggtggcagcggaggaaggccactcaccatggaagcatggagggcaggccctgaggtctgaaccacaggcgaagtgtggtgatgaggaccagggcaggcaggactgctcacagggaccctgaaggacaggggagggccagctgcaggagagcctccacactcgacatgcaattgcagacatacacctgaatggcaggcagaagcagaggtaagggacaagtctgagtatttgaaagctctcagccaagctgtagcagtgggacagggaaatggtggcgtcaacacaggtggtggccgatgacagggaaagcagtggatggatgggagacgtgctttggagacaggccaataggcccaacccctgtgccagcccagcttcctggtgggttgtttgcactggtgggtcccaccttggtcctggattatccacatgtgaatcacccaaggaccttatgaaaatgcacatcctcaggcctgggccacagagagcctatagtggctgtggaatatgtattttcacaagatgctggggtgattcagatgggcagtcagtctatggacttcaagtctgtgccatgtattttatcctgggctcaatcaccacccattgaaaggtgaagagagaaaactccggtcccaaacaaactgagatcacagctgggctctgccactgttaaccatttgtcctcaggtatataacctaaactttcattgcctgtttccacatagtaaagtgaggataatactatcacctacctaactgggttgttgccagaattaagtgagttaataaatagcatgctcatagaatattgcctgacagatataaggtgatcaataaatgtttaccattaccaccgtcatcactaccaccaccatctccatcatcatcatcatcaccaccaccatctccattatcatcatcatgatcactatcaccatcatcatccttatcatcaccatcactaccaccatccatcatcaacatcaccatcatcatcaccacatcaccatcaccaccaccatccatcatcaacatcaccgtcgtcatcatcaccaaatcaccatcatcatcatcatcatcaccacatcaccatcaccaccaccatccctcatcaggatcaccagcatcatcaccacatcaccatcatcgacatcactgtcatcaccacatcaccatcaccaccaccatccatcatcaacatcaccatcatcatcaccacatcaccatcaacatcatcaccacatcaccatcaccaccaacaaccatcatcaacatcaccatcatcatcaccacatcaccatcaccaccaacaaccatcatcagcatcaccatcatcatcaccacatcaccatcaccaccgacaaccatcatcaacatcaccatcatcatcaccacatcaccatcatcatcaccatcacatcaccatcaccaccaccatccatcaacatcgccatcatcattgtcaccaaatcaccatcaaaatcatcaccacatcaccatcaccaccaccatccaacatcaacatcaccatcctcatcaccacatcaccatcatcatcaccatcacatcaccatcaccaccaccatccatcatcaacatcaccatcatcgtcatcaccaaatcaccatcatcatcatcaccacatcatcatcatcaacatcaccatcatcaccgcatcaccatcaccaccaccatccatcatcaacatcaccatcatcatcatctcactaccaccatcaccatctccattatcatcatcaccaccactatcactatctccatcatcatgatccctatcaccatcatcatattattaccattaccatcatcaccaccatcattctccatcatcatcattaccaccaccatcatcaacatcaccatcatcatcagtgtcatcatcaccaccatcaccatctccatcatcatcaccacgatcatcaccatctccactatcatcatcgtggtcactatcaccatcatcatccttatcatcaccattaccaccatcatccatcatcatcaccatcatcatcatcatcaccaaatcaccatcatcatcatcacatcaccatcaccaccaccaaccatcatcaacatcaccatcatcatcaccacatcaccatcatcatcatcatcactaccaccatcaccaccaccaaccatcatcaacatcaccatcatcaccacatcaccatcatcatcatcatcactaccaccatcaccatctccattatcatcaccaccactatcagtatctccatcatcatcatgatcactatcaccatcatcatatgattaccattaccttcatcattctccaacatcatcatcaccaccaccacatcaacatcaccatcttcatcatcacatcaccatcatcatcagtgtcatcaccaccatcaccatcttcatcatcatcatcatgatcactatcaccatcatcatattattactattaccatcactaccatcattctccaacatcaccatcatcatcaccaccattgtcatcaacataaccatcagcagcagcatcaccatcatcatcaccaccatcatcatcatcactaccaccatcaccatcatcaccgccaccatcaccaatcaccatcattattattactgtaccacccaggtgcagacagtgtgtcctggatcccagcccctgcagcctccatcctagctgccatcgtcaggtccccttagtcaggaaacacccaggaagtgagttttcccataagctaactgccctgcctaatcctttggactcttagtggaaaaggttctaaaatcatgtgtccatttccctgccttattaaagactgtatcaatttaaaatggcttttgctttgatcattaggggtcctgggaggccttggggccgtcttgcttaattctaccgagaccttgggtgggagatcagggatcccttgctgggcactggggggatccaaaactccctgcaggactggttgcccctcacgccacctccttcctgtgatccaatcctgaaattcatccaggagagttcttttccctggcttctgcttttgatccctgaggagatgcaacccttcctttaaaagttcctacattccactgtaggtcaattacactgtaacctgaattggggccctttcagagagggccggagaacttattgcttaagctggaagggtggagggaggaagcacggggaggaggaagccaggggcaaacccggaccagcccgtgcatgtgccaagggctggcccaggatgtcggcagtcaccagcaggagtttggctgcacatgggccccagccagagacctggaggctgttctgctatcaacttttaattaaggaaagtcctctagtgccattgaactttgtcctgaaagtggaaggcaggggtgccttgctggttggttcatccagtttgttctctgagcctggcactgccctgttcaccaaggccaaggtcctgtcagcctcctgctgtgtcagcacagaccctgcctgggacccctgcttccccaggtgggtttgaagggcctcacctctgctctccatcaccccccaccgcagagggaaaatcagtgttatcatgcgaggatggggatagggtacggagactggagagagcctgggagtcagaatccaagcctggcctcccccatgaaccagctgggtgatgtcaggaggctccttaaccactctgagcctcagttgcctcaagatgggcagcctttctgtgtcgccggaggttgtgaggattaaaggtggtgtatctgtaaggtgtaaggtgtccctcccagagccaggcctgtgcatgctctgcaacaatctgtgcccaactgccttcaccttcatggaaaacaaagtgtcttagtccattgggctgctatagcaaaatgacataaactaggcagctttcaaaccaaactttatttcccacagttatggaagcagcgagtccaagatcaaggtcccagtagacttagtgtctgctgagggctttctggttcatggataaccatcttctcactgcgtcctcacagggtggaaggggcaagggatatctctcaggccttttttctaaggccattaatccagtttatgaggattctttttctttacactttttatggtttattttaggttcggggtacctgtgcaggtttgttatgttggtaaacttgtgtcacaggggtttggcctacagattatttcatcactcaggtactaaacatagtacccaataactatttttttctgatcctttccctcctcccaccttctgccttcaggtaggccccaatgtctgttgttcccctctttgtgcccatgtgttcttgttattttagctcccaattataagtgagaacatgcagtagttggttttctgttcctgtgttagtctgcttaggaaatggcctccagctctatccatgttgctgcaaaggacatgatcttgctctttttttatggctgcatagtattccacggtgcatatgtatcacattttctttatccagtctatagttagtggacatttagattgattctatgtctttgctattgtgaatagtgctgcagtgaacatatgcatgcgtgtgtctttatggtggaacaatttatattcctttgggtatatatccagtaatgagattgctaggtcgaatgggagttctgttattagttctttgaggaatcaccatactgctctccacaatagctgaactaatttacactcccatcatcagtgtataagtgtccccttttctctgcaacctcaccagcatctgttaccttttgattttttaataataggcattctgattcctgtgagatggtatctcattgtggttttgatttgcatttctctaatgattagtgatgttgagcatttttcatatgcctattggccgcatgtatgtcttcttttgaaaagtgtttgttcatgtccttttgcctatgttttaacggggttgtttgtttttagcttgtaaatctgtttatgttccttatagattctggatattagacctttgtcagaagcatagtttgtaaatattttctccaattctgtgggttgtctgtttactctgttgacagtttcctttgctgcgcagaagctctttagtttaattagatcccatttgtcaattttggcttttgttgcacttgtttttggtgtcttcatcatgaaagttttgccagttcctatatccagaatggtattttctagcttatcttccagggtttttatggttttaggtcttacatttaagtctttaatccatcttgagttgatttttttatatgatataaggaaggagtccagtttcagtcttctatatatggctaaccagttgtcccagcaccatttattgaataaagagttctttccccattgcttgtttttgtcagcttcgtcagagattagatggttgtaggtgtgaggcattcccattcatgtgagctccatccccgtgactcaatcatctcccaaacccccacctcctaataccatcacctgggggtttaggatttcaacataggaatttgggggaagacacacatgttcagaccagagcagaaaggaagcttgctaaagacagaagggaaatggaagacgaagataaaaggctgccagggctggccaagggcccagtctgataagaaaccgcacctgtgatccagctatctgtatggacagccacccccttgcccatccctctcagccccagcccagccccagctcttccagaaacaggcagccggcgcctgaactcaccaaagccttatgcctggcctgtgttctaccaggaagcaatgtcttattttaagccatatttgtttttctggttcagaagggtttactcctggacaagactcaagttcttgcactgggcaaacctaatggagtggcatgcaggaacagggttagcatgctaaggatcgatggaaactggggaaagaaaaacctggcaaagcaccctacttaaccctcagagtgccagggccctgctccccagaaccccttgcacctttgcagctgggcacaccatggagtttacacagattgacaaaccctcttgggcagtgggactatggttcccattttagggtcaaagaaactgaggctttggagagtgaactgctggtcagcctgaggtttgcctgtgctcagcggggccacagctgcttccgtgccatccagataatggtgtttctatgaagggaacagtggtccctggctgccctaataaattaccactgaccgggtggcttaaaacagcagacatttatgctctcacggtgcaggagtccagagatgtccaaaaccacagcgccagcagggccagttccttccaggagagcctatgcccggcctccccgcctccgctggctcctggcaagcattggtaccccttggcttgcagctatgtcactctgatctcggcctgtgtctttgcagggccttctccctgggtgcctctagtgtgtctctccagctattgcatctaggaccactctaccgcagcatgacatcatcgttttttgggtttttttgggtttgttcttgttgttttgagacagagtctcgctctgttgcccgggctggagtgcagtggcgccatcttggctcagtacaagctctgtctcctgggttcaagcgattctcctgcctcagcctcccgtgtagctgggattacaggcgtgcaccaccatgcccggctaatttttgtatttttagtagagatggggtttcaccctgttggccatgctgttctcaaactcctgacctcaggtgatccatctgcctcagcctcccaaggtgtgaagattacaggcatgcatgacctcatcttaacaaattacttccataaaggctcaatttacctgagccaggagagggctctcagggcttccctgcaggtgtccacccgacaggcggcagcatgtgggccgtgcagggagtaacaggagaaagacacaacaccatgtgccgagctctgagccaagggctgggagctgggagctgcgagctggtcctgtgcacctgccaaacagaccttccaagcagacactgccaggcgttatacatgactgtggaaatggggcggtgcctgaacccacccaggaaggaagggcagcccactccccttgcccccatcagggagccctggcaagtgagctgtggtgttggggaacacgtggcacctcgtttgcacagcccaggatgtgcagggatgctccctggccagctgagtggaaaaataaattacctgaggggctgactcaggccggtcattttgccagtgaagctctgctaacgctcactgggcacgggccacgatcaatatgcctctatttttaactccaggatcagcagggtcattttccagagaacacgggctgtttatttagcttcctctcgacgcgatgcagagaggtccgcctggccagctctgtcccgtgccaagccaaccggctaacctcagccgtctgtgccttcctggggacagtctttagactttcaggggtcaggtagagagaggccaggtgtcaggctggctgagatggaagaaaagttccaggcttcccacctccagccaacttggcttccacctgccagtttcattttgcaggccccagacccacaagctcttggcttactgagaggtccgtgccccaaccccagcccagtcccagagctccaccagggaaggacggacatgtcgaccagcaatagtgctaagcctagtggcagccgcatgttgagctctgggctgctgcttcatgcacattccctgcctctgacgcagcaggattctgcttctgtctgtgcctctgtggtctcatctgtagaatgggctaatattgttgccttggatagtggtgaggatcacatgaaataactcatgttgggtgctcagctctgtttctggccaatgataagtactcaatagatgtcagctgatgcctttgtggttattctttgctgaatgccacaacacctcaagctgagagtcaagcccaagggactcagtagcctgagctgtgcctctgcactgaattcctctaccccacactgccccgactctgtctctctggatagaggcctccttgttttttagtgcatcaaaatcactcccaccaaacagagaggcagggaggtgggtcagacgtcctcccagaacacaggccccatatcaagctaagttcctcctgtttcttaggggcagaatccagtttacagaacatggaaccagagtttgcagatggcctgtcatgtgtacagccctgaggcaggagaaaggaaatgagatctaagcctgcctctgcctcaaatgcccatgtgactttgggctagtcacctccctgcccagggcctcagtttctgccccagcaaaaccatggccaaaagggttcatcactttaaataacatgtatcaaggaggagtctgagttctggctcagagggaaagagtgcagtgattgattagtaatgtctggcccaggtgtaggcagggaaagatgaggcacacttgttacttacttgtcatagagctaagtggtaacaccttattggatgagaccctggggaagaggaaagctgagggaaatccactcggagaaggaatttgcactgccaggcaaggccattctcagtgatttctgagggccctccagttcctgcttccctggagacgtcagggagggaggtggcagaggggcgatcaaggaaatggagcaaggaggcgggcctgactgcaggaggctcagcactggggctcagttttgttttgttttgttttgtttttgagacagagtcttgctctgtcacccaggctggagtgcaatggtgcaatctcggctcactgcaacctccacctcccaggttcaagcaattctcctgcctcagcctcccaagtagctgggattacaggtgcccaccaccacgcctggctaattttttgtatttttagtagagacggggttcctccatgttggccaggctggtctccaactcctgacctcaggtgatccatccgcctcggccacccaaagtgctgggattacaggcgtgaaccaccgtgccaggccaattaagggccttcctgttacagaccaaatgtttgtgttgtctccccaaaattcatacattaaaatcctagcccccacagtgatggtattaggaagtggggatttggagcgttgtttaggttatgagtgaatacaattagtgcccttataaaaccttataaaagaggcccaagagagacacctcagaccttccaccgtgtgaggacgcaagcaagaaggcactgtctaggaaccaggaaggggcctcaccagacactgaattgatggtgccttgatcttggactttccagcctccagaactggaaatccatttctgttctttataaaccacccagactatgatattctgctatcacagcccaaatggactaagacatgtgaggtgcagaatggattgagatgccacacggtggagagtgatgggagcgggtgctgcagctgaggggagcagtactagggagccagcaaccatccttgagagagtgcatggccccaggaaggtcggattgtaggaaagattgcctggcaggggtgtgcaggatccaccagagcagagaggtaggaggacgggggattggccatcacagatacagggaatttgttaatgaagatctgtcttatggctctgaaagtggagaaaggggctgaatgcatggggtgccaagaataggtactcaatagatgccagctaatgcctttgtggttattctttgctgaacgccacaactcctcaagccgagagtcaaacccaagggactcagtagcctgggctgtgcctctgcactggggagatgggactgattggtgtgagggatcaacaagccagcatcgtcctcccccggaggcccagtgtgcttggctgtgagatcagaggcctggaggagacgttcctcagatccctgtcacctctgtttggctaggactgtggcctccctatgtgctccagaaactcatctggtgtgtagaacgaggtgtgccatcactgaaaagggcccccccttgtgcttattttttgcagattaacaaactttaaggagtagccccaacctctcccagcccctcaggagggaagcaaggccacctgtgtcagcactccttctcaccgtcacagaccatggctccctctaacggttgcctgtgactggtcgggaatttcacaggctctgaccattctcactcaccagccggcctggaaggaagtcccatctagacacgtgcccagggactttgttttggagatgcccctacaaccctttttttttttaagcattgaatttccttcctaactgcaaacgctcccggtggtgtaaaatgggttgatgttcttcacactcacaccgtcctgcatgtctttacagtggtctcataaggttttatttaaagcaatggtcagccaattttttcttaaatggtcagatagtatattctgctttgtggtctctgttgaaactacccaacactgccattgtagcagaaaagccaccagaggcaatatatcgatgaatgcactggctgtgttccaataaaactttatttacaaaaatagatggcgggccagatttgggcctatggactatagtttgccaacccctggcctagatcatcattttcaaaactatagttgaaggtcaccgttatttgctgccccacaaaaacaggattctgccgtcagatgagttcagggaacactgggtacaacaaaggttgatgggttttcccagactgtttaatatgttaatctcacattgtgagtccccatgatgggagttactgtgcacatgttcctaacgcatttgactgtgagccctgatttccgagaggacctgggaacttttttttctccctacacacccctgttcatgtctctcttgaaacacagtttaggaaagttcactaaaagaatctaggtggtcacacccaggtgccctctgtggatcctgttggaggggaggacaggggccgtggcctgctccagggtcatgcacatcaacaatccagtggcttctccacaaagagaaagccgaggccctgggtcctccagggagccgggagcaccaaggacaaagccacgtgtccctccccgccaggctctcacagcagcttgctcgggaagaccccttgttcccagggcaagggccaagcggtgtggaggctgggtcccacagatgccactggggaagggctggctcacctgccctccgcccctaccgacagggtcgccggaaaggacacgtgcatccaagcggctcccatatccgtggcaatggatggccgtgccctgtggatatggagctgtcttagtctgttttgtgctgctctaacagaaaaccgcaggctgggtaacttacaatgagcagaaatgtatgaatcccactgatctagagggtgggaagtccaagatggacagatggccccatctgtgagggcttcttgcttcatcatcccatggaaggaggcactacgtggcaagagagagagcaagaggcccactctctcaatagtggcacgaatgcgtgtatgggggcacagcccttgtgacccagtcacttcctattaagtcccccaaaactgttgcattgggaattaaatttctaacacatgagctttaggggacacattcaacccacagctgtggcaaaggcattcataccatccccgtgggaggctctcccaccactacccctgctccagggagcacagcctccccgctttactgagtgcagaagcctcaggcttatggagggattgacaggtggaaaggtctgtcctctacatcaagaggccacattgagacctggggcaacagacgggcagtggctgaggccacatggagagggacgtgcctgggggagattgggcactttctggtggcaccaaggctgcccctccaccctcacagtcctcctagccctcatgcccaagcctttggacactttgaccattgcatggttgccgtccctggcctggcctggagaagtcttgccagcctggcgaggcttccaagcagatctgtgccacagcaacaaccgtcacgatggtggcatggatggagggccctgggcatggcagcgtgggcttggggaacctcatgacagccctcaggtgctgttattacctgccgttgtgtagacaggaaaagctcagagagttcaggaatgtcccaaggtctcggcacctggaggtggcaagccaagaggtccatttggttttgctctaaggtccactttcttttcttttcttttctttttttttttttttttttttttttgagatagagtctcactctgtcacccagactgaagtgcagtggcacaatctcggctcactgcaacctccgcctcacaggttcaagtgattccctcacctcaacctcctgagtagctggcactacaggcgcccaccaccatgcccggctaatttttgtattttcagtagagacggggtttcaccatgttggtcaggctggtctcgaactcctgacctcaagcaatccaccagcctcggcttccccaagtgctgggattagaagcgtgagccaccgcgcccagccttaaagtccactttcttaagtttctggacagaactctagaaaaatatgtccttctcctgcgtcactgggacagttctgagatctgggtcgtggcacccaagtgacattcactgtgagaagtgggggctccataaacttggggcagctcagctgaatccaccctctctccggtcaactcacaactcacacatgcattctggcctctggcctgtgccaggcacacagctaggagctgggccttgcggaccacagggagcatccctgcccacagcgggctcacagtccgagaggacactggtatgtgaactgaggcagcgggaagagctcctggccaaggtctttgtgttcagaccagaagaggaaggagggctccctccccctggggctgtggaggctgaggctcctggggggttgtccacatctggaccgtgggagctgttggggggaatgggggcaggtggagaagaggaggagctttctggaaggaagccctgtgaatgaggggaacccagggaggaaggggctcagatgaagcaggtctgggggagaggaaggaagacaggtgagggggctgatgggagccatgatgaggtcccaggggtagtgtgccccactttgggcatggaagacatcatggagacctcagagacacacagccctcttcccatgagccaggtggcagacaggacacccgcacatggaggaaccactaacaagtgccaagccctcccacgtttggggacagccgtgtcagagactgataatactgctcattctcggtggcaccaaaggtccctgggcacctggccccgaggctggctgtgcccagcactgtgcaaaatccctcctgtgctggtcttcctggatgggctgccggtcggagggaacttggcatttgactctggctttggagggtttggttatctcctccccaaccaagatctcctccaacccgtgcccatcacaagcccatccttagagggttcagagtcatatggtgtgaaacaccctgtcctgactgtgtgacctcgagaaggtcacatgacctcgctgggcctcagtttcctcatctgtaaatgggataataatagaaaataccctaaaaggttgttgagaaaatggaacgactgcagagcttagtaaagtgccaccacacatacgtggtttttgataactcggtgccaggggcactggggagccatgggaagcgtcagatcagaaaagcagggcctgagggcccccgcccctcctcccacatctgctgggcaccgtgttgcgagaggacaagtttgaggggtatctcttggaatcatcccctttccctggcaccaaccagctgcagccccaagataggaagtttggttgtcattccaatatggctggaaccccagaaactttttcctggcaatcatggctgcctccgaagggcctgcagcaacgttctctgaattgctaagcaacagtgtccgttctctcacatggagaaaattgaaacattgattcatctatttgttttgcaactagcactagcggcttcattactctgttccctggggacaccctcccacacactcgaattgaaaattaactctttttacctaggaacagccacaatgggtttttaatttggagaaagtacagaaacaatggtggggctgggtgccagaaatcaggaggcaaagctgacctgtgacccaggggccctagacaagagcaccctccctccactgggccgtggacaagctctttggaggtgggaccggccaagagtgggccttgcggtccttgaggccattaggggcaagtgttcacacctgccacgtgtggcctaggtttctgctcctcaccggagcttttgcggttctggcactgggaggctgctagcatcctcttgctgggaattttctggaatggaaggagcactgtttctggagttcaaacagctcagttctagtttctaactctgtactgaggggctttgagctcctcctttaagccatgtctcagtctcctcatcagtcaccagagggcaggaatgtgtctgtgttccttgcatggctgttgtagggtttacacaaagctgcacagcccacaaggatggtgtgatgatattcgtgtgccggcgaagctctctccgtcttcttgtctctctgctcttgttggctttctggggatacgttcccctggaggacagaaggcagcatttgttgcttccgtaactttcacatcacgcgtaggccagcagcaggaggagctggctctgatccctgagctggagtctgtgctccaggaggctgtccccagcaacggcagggtcctctttagctaggaaacagcaacagccataaatgatagcccacgtggcggttgctcagagaaaggagctctctcctgtcagtttgcagagagctctctgtccttctgataatgcaatgcgttactgacctgatttcctaaatcctctccttcccccactcctgagggcctcagtgccctgattcacccaccccctaccctgcatccttgggtgtgtccatgaacgagtctccagcaggaagatctgcctgggctctggattctctggggttgggttcagctgtgagtggcagaaaatctaagccaacagaggctcaatggataaaggttctcttttctctgtaaacagacacagtcaagggctagtgtggtgactgcacaatttccaagggacccaggctccttctagcttgttgctgtaacatccactccagcagcttctggtccagtgtggctgctctaactccagccatcgtgtcttcatcccagccactacaaaggagagaggcacagcccctccttttaagaacacttcctggaactcacacatactactttcgctcacaaaccactggccaagcagagtcacatggctagctgcagagggagctgggaagtgtcacacagctgtccaggcagctgtgcacccaggagactggggactgaggaaccagaaggaaatgggccctgggcacaatagcagcctctcggtgggtttcatggctgtaacccagaccttaccctggcccgtcctctctcagcacagtatcacctgtctgtctgcccctagctgctgggtgtaaaagagccctcttctccaagtgtggtctccttggcctggagtgcacacgctccagaaccttccagtggccatcagctaagaaggaccagaaggtgaggctgaggactgggcacatcccagtggtgaggcagcgccctgtctttatcagcagggagcagggggcgttagcagggggcctaaaggggatcccttccccaacctgcccatcatcctggggaagagaagactcagttccacattgcatgggggtgtgtggaaggagggaggagccaagcagaggcccaggtgtgtggaaggggtgcagagactgaaccaggcctgtcctgggaagccgagaagatcagccccctacacgatgggaagtaaggcagcctgaggatgccggacacactgtgggctgcagggtactctgagctctaggaagcagagctggggccagcaggtgggggctgcaggattttggctcaatgaaaggaaggtgtgactaactgctggggctgtcctctggtggaccgggctgcaccagaagagagctagatgtgagcaggcagaggctggccctgcatggaacgaggtgtggggtaggacccagcagtcttcccctgtgtggaacctgctctgagcatttctgccaggacaaaagccacatcccagagcttatccctgacactctctgccgcctctggggggcagtgaccagactctgagggtcgtctggaggctctgtcccgtcccaagtccactctgatccacaaggtctgccctggtgcccagacctgcacaggtgcacaggaagacacaggggggttcaactccacacggtgagtgggtgtccagccacttagaaggtgccgtctcccgggaggtagacccagatcactgtcctcaccctagggatcaatagtctgaggttggccacgtgagagtggcatcagatctgggctctgggaagctcccctgggaccctgagctctgacgggtgctcttgcatccccaaagatgagctgggatggagaatggggcgtccatggcattctgctcagagagggggtgtcacggacattctgataaacccttagggtggggactctgctagaggaatcatataacactttctttctttgtgccacaattctgtattgttaaagaaaaactttattcatgatgcttgttaaagatgataaggcagacgttattccaggggcgccatgactgtaggttcagggaccaccatggggtcttacagtaggggagagagatcaggctgaactctgactccagcaaggagaagtggggatttatcagcaaggagcagggggcatcaggggacggaagctgactgagaggatggccaagggtcgggggcttccggctgaactgtctcgctcggattaggcctgcaggcaggccaggaggagatgatgtggagggtggtcagatactaaggtgggggtttctgctaagctgacggcaggattgtggctcacactggattctcccacgacagagagggaagcccgagtttgggccgagtcaagcagaggactcagtagaccctaactaaagttttagtcaaaggaaggaatctttgtcagaattaagtacccgctctggggtagacaccactggatgctgggtatgcagcagagaacagaagaacaggggttctgcccccatggggtttatatttcatgtaagcagataaataactggagagaggtgcacagcccctcatctgaaacccctaaggccaggtgtacttagctagaccagaggtcctcacatggggcaatctggcagtgtctggagatgctatcggttgtcacagctgagggtggggctgctagtggcatctggtgggtggaggccggggacactgtaaacatcctgcaatgcaccggacagcccccacggtggagttatccggcctacgacgccagtactcgtgccgaggcttagaaacgtggcttgagacttcagactttgcattttagaaacagaatatggtacatagaccatatattatgtaatgtccccggcgggatgtggagtagcaccccataatcagatgcattaatatttctgcagcaaaatttatgaatattcacacaaagagggatgaactgagactataagtagcctcacatcagttcaggtcacgttttgccaccaaatgagttatgaacaagctgtggcttttagagctttatggattttggaattggattgtgggcctgtaatataatttaagatagtgataaatgcagtaacgacagccaggcagagtaaaggaaggggtacgggagggttgcggatagagtagccaagaagaggcctctgcggaggggcacctggcagagccctgagagcggtgggatgggctgggagcagatctagggaatggcagtcctaacagagggaagagtatgtgcaaaggccctggggtggacataagcttgaagtctctgaaaaacagccaggagcccagcctactccagtgggttcccataggagtgacgaggctacagaggtgaccaggaccagatgggtccagcccatgggcattgtaaggacttggggtttcaccgtgagtgtggaggggagccagtgaaagaacgtgaacatgggatcacgctggctactggtgcagagggcaagggcaggaggctgcaggaggacaatgggccatgggaggacaagaataggtagcctcaaggggcaggaggggaatggccaggatgcggggtgcccagttcatacatcctagaggggggctctcttgtggacagacaggccagagacacggctcatctgtccctcatccacctccagcttcctgctgcggggccttagtagactcagcccccacctcccctgcctcccacctcccctctcgatgcggctttcattatgtaaacctgtctggttcccagctgggctgagccttcctctctgtgtcccccaggaccctgggtccagctcctcacatgcactcacagggcagggacaagtttgcggtagaaatccccaagattgtgggaaaaggctggggtagccagggcagttcccaaacagacaaggtggtgagaacaagctggaatgagaaccagaggagcctggaggaggaggaaggcgcccactcccagccaggctccactcccagccaggcacctggctgcatccatccctcagggccccgggcaccctccagtgtgggcggcccctccctgcagctgcatctcagggcccagcggtggggatccgcacttgagtttaagcctcgagggctggctgtggacgcactctgaagacgaaagtccagaaattagggaaatgtccttggctcaaatgtcggagtcctccccgttatcgcagaaggcgccttatctgcgctccccagaggcccgagataaagcccatgctgcaagccaagggcactcttcagcctccagcctggagttctaaaccctgcagccacaccgaacctcctggcagcttccaaacaatactgacacctaggcgtgacttgggcgcccaggccaggctgtgaagccctgctccagggcccaggcctaactggcaccaccccgtccccatgggcctgcagcctccctcctgccccagcactcctctgccctcagctcaccagctgggcaacaatacctggaaagggtagaagcatacccccgcctgggcacaccagccgacacggtctcctcctggtcccactgggtcctcaccacatcagggatcaggggtgggggactgtcgacagccctgagatgtgaccaggaagataggaggggctcagaggggccccatgctgtgcaggggtcatgtggctcccacggtggctgcggtggaactgaggtgccccttgctgtggggcgggcagagaagcacaatagcagtgtggatggggacgtccccaccttgtggctaggggaggggttgtgccactcaagaggggttggtggactcaaagtagcccagatacaccagggcaggggtctgtgatgtccccaaccacccccgcccccatgaccacctgcacccaccaccagctcccccagaaggggaggggtttcaatgcctagaattgttcctattccccagtcattctatctgtctgtctgcacgccttcccttccccactcccatcccagaccaggtgagagggaagaggcctctgtggcaggaggtggggggcccacacagccgccacgaagaattcatagcctattggagttgagcccatccacccgccgcccctgcaggcggccctgctgtgcctggcagagccctggccagacagatacccccaccctagacccccaccctttccccacttctggaaagggtgaatctttccttcctaaagggctttgctcacagatccatctaaacccaattaccgggagtgtggggcctgcgtctgcggtgagtcggcagcacgccctccactctaaccgcccgtgatttcagcgctgaatatctttcagagttatttaagaggttcttcccttttttcccattttgatgatatgtttctaaattatacattaaacttatcagggtgagtaatacctcgcagcttccccatgtcaggcctaatgttacttactcgtctgctgccttgtgtttacatggttgagggggatatgctcctttcagatccatttatcttcatctgaagtgtttagagatgagaacctcagatgggttgcagacacctgggctcccccgagcgcccagcttctgcaggaacctctcctcctgcaaccagggtctgcagtgtcatgtctcaggctggcaggaacctggaggcaccccttccccatgggagggtcatggggaacagagaagcccccagagagagcagacctgagaggtcaggctcagagatgaaatggcttttcctggaaggaaacgtaaagcaccgggtacctccccagaacccgcctccctcggcccagatggcagctgtagcttctgggagaacaggtccttgatcccctatcggtgcctggccctggccattcattcctcgttcaagtgcgtgtggcagcctccaccgtgcaggtgggcactgggctggcctggcagtggcccagggtgctgttctgggtcactggggctatgggactagaccccagggctgggatcccacagaaagtcacaggccctgcccattggcaaggtctctctctgcctctcagccaggaaaatccctaccccaggacaagctcctgtggccagacaacccccgccccagttctcactgcctctgacacccacgctggtgtggccctgctggggaccccgggtctgtcaggtctggtgagaggtggctctgcagtctggagccctttgctctgccacacacagtcgggatggtccgggcgggggatggccccaggggctcaggaggccctgggcttcgtaatcacactacactaacgcctctgcaagcatcgttttatcaaaaccctcaccattgccatcaccacctccatttgacagctgagctgaagagcttggtgtgcccaaggccacgaagtggagcccaggtcttgcagactccagaccttggactctcgggtcccatgcagctccaggccagggcgatctgagcagccccagccacagtggcccatgttgttccctcccttgcagggcaaccccagggccacgactgggctcctggcagcacggccagatggacctctgctctctgccagtgaggtacctgcccctggagcgggaccaacagctccaggcaggagattcacccaaagggaagtgacggggcaatttatcatatcaataaacttgcttagagtgcactctgtcttctgtaatgaaatggggatgcagtcccaccatgttattgggcaccagggcaaccccgcatcaggtgcttattattttctgccacgatcagggaagactgatcgtgcttggataagtgcagcttaaaattgaaaaccaagcaatttaccttcaatcgcttctcagaattttgcgcagccagaaaaccgactccctttccattttaactgcttccattagcattcgtttcctccgtgagaagagggcttagctgggaagggaattgtagtgccatcacatttcccccttctggagaaagacgcttgccccaggctcctctttcttgagggccgacagggtcagggtgttgtggtccctccccttcctcctggcagagccaggcctttactgggcactgggctgggcattgtgcctgtcctcaggtctaccaaggagagggtgcccaagtaggggtgggtgttgccctcttcctgggggctctacacaccccggccgctgtggcagggttccccacatgtcccctgcatttgttcaggtgttgaggagcagatgtcctcaagtcaattttcctgtgacattttcgtgtcatttccaagtgaaggaggacagcttgactgtgggatgcttggggacccaggggaggcaaatcctcttggtgagagcagtcagcgcttgtggcttgacggcttgacgcatggtgtccgtcattctgtgcaggcctgcagttctgaccagcagtggttgtctccgctggctccagatatccttccctcgacctctgtcgctcagcatctgcggggtaaatcctgcaaggtttgctccacgttctaggaaagaaattctctactctagtgatattgacagggaggctggatgaggcctctggacagacccccaaagcccttgcctcgatgttccttttatcccaggaataataagaggagggttttctcagatgcaaatcatcctccacttgtaaatttcacagttacctcccgaggcccctccatcaatgctgccaagataaactgttgtgatagcctcaaaccccggctgcccttctggctgtgtggcttcagccctggcctcctcttgtttgatcagcctccctcttgctggctgcacaaggcggggttgtgtgcagatgggattttaaagccctttgcacaccctggcttggtacgatcgcatggagcttgcccctgaaagaagaacttgagggccaggccctgagtttggatccttttcctggaagtctccgccctgaacttcaacattgcctatttgcccgtacagggtgtcccagggctagcatctccctaaggcaggggtgaggacataagcccccaacacggccctcacaatcaaggcagctctaggaggattcatgcacagctccgagtcatcaaggccctgctgctgctatgagtccctggccagggctgatcctgagcctcttacgtggaagcagtgagataaagggaaggaaaatttcaggcagatagagcagcacattccacagggtcagagcaggtgtgggccctggtgggggcagtttggatgagtactgggaccctgtactcatctacccaccacaatataaccaggccccgctggctcttcaggattaagggccagggaacctgcagtggccccttgggctggcatctctgatttgagacagtctggctttgctgcctgcaccttggagggtggttcatgagggctacagctggaggtgcccccacccactagcatacttggggtgggcggttggctgacagccagccagcattccaactccctcccctccaccagacagcgctaattttggggagaaccttagaggtgtcccaaagcacagccctggtcactttatggtcctgctttcaaaaggaccggcacctttgcccaccctcagagagactgggcagtgggtgtcagactctggcagcatcagagaagagcccagagagagaggggagtttccccagagctgacggcagggcttttccaggaggccgtctgagaatcaggatcaccagacaaaacctctctaattatttttaagtatatttttactttcacatttgctcttgtttttatcgtcatatatactgtacctacagaaaagtgcacggaacagataggactggtgattccgtgattatcaagtgtgtgaccacaacccaggaccagaaactgacactgggttctctgcggtctgccatttcccccataatgggaagagtaacctgggactagaccctcactccgaaactgaagtatttctgtgcagttcccgggcgctgcagcaaaccctaacccaccattgattcttgttccttcctggtctctgagaaaggaccgatccaaagatgacaggattcaaaagagattaatttgttattttagacctttagaaagtgcagttgcacaaaatcggaggccctgggtcataacgaagttcagatcaattaaaacaatttactttgctgctaatgatttcagaccattgtaatttattggtaagtaaatgacttcaaaagcccattcctttgtggttgcacagagggaattttaacaagttcttggataaattaagtctggaatttgttaacagactgttactgtaaaacattgaaactaggcctttgcacactgctccaaggcctcaaagtttccaggaataattaaaacttctaatcagttcttcattgtttaagcaaatcaaatggcaagaaagggcttgtgataacaagagggaaaccctcccatttggagggtcagtggccactagaatccctcccgtgactcctgttctcagggtgaaatccaagttaccactctggccagaatgcgccctgcactgtttggttcccacctgccccgcgggtctcagtttggatctctctgcccatggtccaccgtgctcaggccacgctggctcctttccttcctgcaaacaagccaagctcacagcttttccctggcagctccctctgcccgccacgcctccctagacttgtgtggctgcctggatttcacagtttgtttgtttatttatgtatttatttattattttgagatggagtttcgctcttgtcacccaggctagagtgcaatggcgggatctcagctcactgcaacctccgccttgtgggttcaagtgattctcctgcctcagcctcctaagtagctgggattacaggtgcatgccaccatacctagctaatttttatatttttagtagagatggggtttcatcatgttggccaggctggtctcgaactcctgacctcagatgatctgcccgcctcaacctcccaaagtgctaggattacaggcatgagccaccgcacccagccacttttcacagtttagatctcagctcagtggccctctttgaaggccccttccccaaccacgcccatcactgtccttgccatcactgtccttcccctttgtgctagctcaccggactggcagcagacagcatctggtcacatctctctcgccagtgcgcctcccctgcggcacattcggtaggctgggggtctgttggatcctggcaccttgcagtagtgttgcccgcttcctaacaggaacaggacagatattcatggagtgattgaattggtgatgattccaagcatgagacataggtagggtcctattggaatgggccagcaccctctgggggtcctctgatgaccagggcagggactcttagggacacagggccgtgggaaagacctgctgtcctgcaagccacctaccagtgcggaatgagtggggagtgtccaggcgttgctgcatgagttgcctctgggaggctttgggtcaggtcggaagcttgtctgtgccctgaacataggacacacagtgtcctcatggagtcaaccagcatctcctgcatcctctaccttggaaaatgaggattctccgagagctcctccccaccctcacacacctcagcctctataacagtaacaacagtaatagctatggccatgtgttaaacattagggcgggatcaggcatcatgacctcatgaaatgcaatattgcattaaacctcagcagggccgagaggcagaactgctgttccaaggaggaaactgatgctcagaggcttattaaggaatgtgtccaagtcccacagcatctagatggtgggattgggcttcaggtgcctacatcccaaaagccattatgccatcctgccatctgagcctgttaaagctccttcatgccactccactctggggcagtgatttctcatccaggcctgaaagcagccagagatggctcggtaaaggtccgggttttgccagtcaagacattccagggggagaaacagcatatcttgcacagtgaatcacctgggacaggtcctaggtctcacttatgcattcctcaagatttattggagagtgtgtgccaggcatgattctgggtcttgggcatttggagtcctggagtctctgctctcatagagttggtgacccagtgggaagaagtagatgataagcaaataaacaagaaaatgctatctagatgcgtatctagatacacataaggcctgtgggctttcctgatcaagggtcgaggaaggactctggccaggtgaggtggctcatgcctataatcctagcacttttttttttttttttttgagacagagtcccactctgtcacccaggctggagtgcagtggcgtgatcttggctcactacaacctctgcctccagggttcaagcgattctcctgcctcagcctcctgagtagctgggactacgagcatgcactatcacgcctggctaactgttgtatttttagtaaagacaggggtttcaccatgttggccaggctagtctcgaactcctgacctccagtgatccacccgccttggcctcccaaactgttgagattacaggcgtgaaccactgtacctggcccctaacactaggaggccaaggcaggtggatcacctgtggtcaggagttcgagagcagcctggccaacatggtgaaaccccgtctctactaaaaatgcaaaaattaacctggcatggtggcatgtgcctgtaatctcagctactcaggaggctgaggcaggagaattgcttgaacctgggaggtggaggttgcagtgagccaagatcgtaccactacactccagcctgggcaacagagtgagattctgttaaaacaaaaaagagaaagagagagggagggagggagggacagagagagagagagaggaaagaagaaagaaagaaagagagaaagaaagaaagaaagaaagaaggaaggaaggaaagaaggaaggagaaaggaaagaaagaaaagacaagaaaggagggaggggaaggaaggaaggaaggaaggaaggaaggaaggaaggaagaaagaaaagaaggactgtcagaggaggtggtatttgagctgcggcacagaagcagccttttaaggacctaggggaagaatgttccagacagggggaccagccggggtaaaggcaccaaggctgggaggaaggaaaaagaaaggaaacaggggcagagctggtgagcaaagggacccgcaagccctgggcacagggcagagtgtgtgggttttattcaaatcgcaggggatgccttggggcatttcaagcagggcagtgacatgatctgattgatgtgttttaaaagctccctctggctgctttgggcaacatggttgtttgcaaagtctgggctggcggcctgcagagctactggaaggccctctcagggtccagacaagagagggtggtgactgcaccagggcagagcagggtggggagaggaggacagaggtctgggacctattttgaggcaaggttgacaaatatgctgatggtttggatgtgaagttaagacgaagagaggacttcagagcaacacatggattcagagcttgaagagctgcatggaaggttcttgtcctcagaaagggaggcccagcggggaacaggcgggatgaagagctcccctcgggtcatattgcagtcgaggtgcttgtcggagatctgggtagacagatccagcaggcagtgagcactatgggttcggaattggtgaagttggaatgtgattcaggaatgaaggagtcaagggtcaggcgatgggggatcacccaataaaagaggagaggcctaagactgagctgggataccccaacatcttaggtcatgagacaggaagcggagggtgcttggatggagctgatgatggggactccataaactaagaagaggggtctttcaggataggggtcctgggtggatctctaaacaaaggggtgcggtgcgcacttcgaggcagccctggatcatcatattgatccaaaagagcgcctgtgtctcagatcaaatgtgatcagctttcagattatctgaagcaagttggcaaactcagagccaacaaagtctgcatttgagtaattttcatcgtatttttggcagctgcagagactccgaggcaaggcagagagccctttaatggagcattgagaagcagtttttaaaaataccttttagaaagctatttcagttctcccgtctgtagcaaaattaatgtataaacttagtgccttaatttggttcttctttaaacgaagaaggtgggaagctgtttcctcccgcggctctgctgaatctggaggctgattctgcttcagcaccacggagcccggacaccgccggggatgccctgcacaggccaggcacagctccagaccctggaggctgagaagccactggatcttcacaacaaccctctgaggtgacaccagtgagattgcccccattttagagatggggaaactgaggcccaggctggttaataagaagctacatggagttagccttgtttcagagatgaggaaatgcaaaaggcttgcctgaggttacagagctcaagagatctgagtgttgaggtctgactgttgtgttttcatggccctggcggaaccccccaccccacctgggcatcacagttacttgtggccactttccacaaccacacctcccaatctagccaaaaggatgacatcccaaggaacgtgcagcctcccaagcttccaggatgagattaggggcctgacacttgaccagcctcagcctctgcctcctcttggcttcctggggaccccggcttcagcaacagcaagctgggcaatttagcttcactgtccccatccgtcttgctccctctgtccttgaagatgggtggaaagtcagggaggggccgctgcaataagtgacaaggcttggctgcctgcagatgagggtgggaggaagcagagccgagtggctggtgcaagtggggcatcagtgcccaggagccagcttcaggggaagcaggaggctctctgaggtgacaaagctggggcctgtctgccccacccactgcaatccagcatgctggctgggtgacccaggcctggatagaaatggagagggcagctccatgccaggtgcagctggatcttgggaacaagggatcagctcagaagatatagtttgactcaggcttcttggccccgaatctgcccagcatttctcccacccccatgcctgctcctactcttctgtgtgtcctgtgctggccgcaggtgcccacttccctgtccaaggggccgtgaagcactccccatggccactcacagccctgtgctgtggccttccctccactcagggccatgcacaaggcctgctcccacccaggctgacaggtgcctgctcctcagatgaacgatgggtgccaggcttctcagggtcactcgctccctggactggtttgctctgacttccattttcctctgtggttgaattggccatcacccgctggggacagccaaatccgtcaagccccacggcacttgcttttattggttctcctagctttattgcctttcctggagcagtgaggggcagtgagccactgcacaatcactcaacttgacatggctttgtagatttcatccccccacccccacccatgtctctatctgcaggagagagtgacaagatgacagacatgcagtaactcctagcatgagcagaactgatgcccttgagacaggcggagccccctggcagcccaggagactgaggactggtccagggtaccagtgtctccacctgtaatccccttgtggccccaggccttggacattgttggcatcttcatcctttctattgccccttgctgacgtccaccaacctgctctccccaggcacccagcaaacacgagcccacttacccagtggacacgagcccactgagtaggcaagggtcttggacaaagctgggtgcaagtcttgaccctaccagctactagctgcacatgaccttgggcaaggtgcttgacctctttgagttttcatttcccctgcttccaaatgggagcaatgcctcctagaactggtgcgaggacaagatgagctgacgcctgtgatgttcactcagtgttttgcacagagtgaagccttgataagtagcgggagcactgcgagtttttcttcttattgactggctgattgattgttgactctggccccgaggcctccacaggaaggaaaagagagcttggccctgaacttcgcaacccctgagtattccatagggttgctgcagcagaagatgtgtttcctgggtgggaactgtattagtcagggttctccatgtaacagaactaataggatgtgtatatatatggagagagagagagagaggagcatgattgtggggctccaaattctacagagtaggtcaacgggctggagaccaggaaagaaatgatgttgtaggtcgagtctgaaagccatctgctggtggaattgcttctttcttggggacctcagtcttttttgcataagaccttcaatgattgattgaggcccactgacattatggagggtcatctgcttacccaaagtctagtgatttaaatatattttttaaatttttttaaattttactttaagtgttgggatacatgtgcagaatgtgcaggtttgttacacaggtatacatatgccgtggtggtttgctgcgactatcaacccgtcatctactttttttttttttatactttaagttttagggtacatgtgcacaatgtgcaggtttgttacatatgtatacatgtgccatgttggtgtgctgcacccattaactcttcatttaacattaggtatatctcctaatgctatccctcccccctcccccaaccccacaacaggccccggtgtgtgatgttccccttcctgtgtccatgtgttctcattgttcaattcccacctatgagtgagaacatgtggtgtttggttttttatccttgtgatagtttgctgagaataatggtttccagcttcatccgtgttcctacaaaggacacgaactcatcattttttatggctgcatagtattccatggtgtatatgtgccacattttcttaatccagtctatcatttttggacatttgggttggttccaagtctttcctattgtgaatagtgccacaataaacatatgtgtgcatgtgtctttatagcagtatgttttataatcctttgggtatatacccagtaatgggatggttgggtcaaatggtatttctagttctagatccctgaggaatcgccacactgacttctacaatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcttccttctctgatggccagtgatgatgagcatttttttcatgtgtcttttggctgcataaatgtcttcttttgagaagtgtctgttcatgtcctttgcccactttttgatggggttgtttgtttttttcttgtaaatttgtttcagttcattgtagattctggatattagccctttgtcagatgagtagattgcaaaaattttctcccattctgtaggttgcctgttcactctgatggtagtttctttcgctgtgcagaagctctttagtttaatgagatcccatttgtcaattttggcttttgttgccattgcttttggtgttttagacatgaagtccttgcccatgcctatgtcctgaatggtattgcctaggttttcttctagggcttttatggtttttggtctaacatttaaatctttaatccatcctgaattaatttttgtgtaaggtgtaaggaggggatccagtttcagctttctacatatggctagccagttttcccagcaccatttattaaatagggaatcctttccccatttcttgtttttgtcaggtttgtcaaaggtcagataggtgtagacatgcagcattatttctgagggctctgttctgttccattggtcgacatctctgttttggtaccagtaccatgctgttttggttactgtagccttgtagtatagtttaaagtcaggtagcgtgatgcctccagctatgttcttttggcttaggattgatttggcgatgcgggctcttttcttgttccatatgaacttcaaagtagtgttttccaattctgtgaagaaagtcattggtagcttgatggggatggcattgaatctataaattaccttggggagtatggccattttcatgatattgattcttcctacccatgagcatggaatgttcttccatttgtttgtaccctcttttatttcattgagcagtggtttgtagttctccttgaaaaggtccttcatgtcccttgtaagttggattcctaggtattttattctctttgaagcagttgtgaataggagttcattcatgatttagctctctgtttgtctgttattggtgtataagaatgcttgtgatttttgcacattgattttgtatcctgagactttgctgaagttgcctatcagcttaaggagattttgggctgagacaatggggttttctagatatacaatcatgtcatctgcaaacagggacgatttgacttcctcttttcctaattgaataccctttatttccttctcctgcctgattgccctggccagaacttccaacgctgtgttgaataggagtggtgagagagtgcatccctgtcttgtgccagttctcaaagggaatgcttccagtttttgcccattcagtatgttattggctgtgggtttgtcatagatagctcttatgattttgagatacgtcccatcaatacctaatttattgagagttttcagcatgaagggttgttgaattttgtcaaaggccttttctgcatctattgagataatcatgtggtttttgtcgttggttctgtttatgtgctggattatgtttgttgatttgcgtatgttgaaccagccttgcatcccagggatgaagcccagttgatcatggtggataagcttttgatgtgctgctggattcagtttgccagtattttattgaggatttttgcatcgaggttcatcagggacattggtctaaaattctctttttttgttgtgtctctgccaggctttggtatcaggataacgctggcctcataaaatgagttagggaggattccctctttttctttttctttttttttttttaattgatcattcttgggtgtttctcgcagagggggatttggcagggtcacaggacaatagtggagggaaggtcagcagataagtgaacaaaggtctctggttttcctaggcagaggaccctgcggccttccaaagtgtttgtgtccctgggtacttgagattagggagtggtgatgactcttaacaagcatgctgccttcaagcatctgtttaacaaagcacatcttgcaccacccttaatccattcaaccctgagtggacacagcacatgtttcagagagcacagggttgggggtaaggtcacagatcaacaggatcccaaggcagaagaatttttcttaatacagaacaaaatgaaaagtctcccatgtctacctctttctacacagacatggcaaccattagatttctcagtcttttccccacctttcccccctttctattccacaaaaccaccattgtcatcatggcccgttctcaatgagctgttgagtacacctcccagatggggtggtggctgggcagaggggctcctcacttcccggtaggggcggccgggcagaggtgcccctcacctcccggaaggggcggctggccgggccgggggctgacccccccacctccctcccggacggggcggctggccgggcagggggctgacccccacctccctcccggacggggtggctgctgggcggagacgctcctcacttcccagacggggtggctgccgggcggaggggctcctcacttctcagacggggcggttgccaggcagagggtctcctcacttctcagacggtgcggccgggcagagacgctcctcacatcccagacggggcggcagggcagaggcgctccccacatctcagacgatgggcggcctggcagagacgctcctcacttcctagatgggatggcggccgggcagagacgctcctcactttccagactgggcagccaggcagagaggctcctcacatcccagacgatgggcggccaggcagagatgctcctcacttcccagacagggtggcggccgggcagaggctgcaatctcggcactttgggaggccaaggcaggcagctgggaggtggaggttgtagcgagccgagatcacgccactgcactccagcctgggcaccattgagcactgagtgaacgcgactccgtctgcaatcccggcacctcgggaggccgaggctggcggatccctcgcggttaggagctggagaccagcctggccaacacagcgaaaccccgtctccaccaaaaaaatacgaaaaccagtcaggcatggcggcgcgcgcctgcaatcgcaggcactcggcaggctgaggcaggagaatcaggcagggaggttgcagtgagctgagatggcagcagtacagtccagctttggctcggcatcaggaggagaccgtggaaagagagggagagggagaccgtggggagagggagactgtggggagagggagaccgtggggagagggagagggagagggagagggagaggagggagaggagggagagggagaggagggagagggagaggaggagcctttccaattttctttccttccttccttccttccttccttccttccttccttccttccttccttccttccttccttcctccctccctccctccctcctcccttcccttcccctcccctcgattccctctttttctattgattggagtagtttcagaaggaatggtaccagctcctccttgtacctctggtagaattcggctgtgaatccatctggtcctggactttttttggttggtaagctattaattattgcctcaatttcagagcctgttattggtctattcagagattcaacttcttcctggtttagtcttgggagagtgtatgtgtcgaggaatttatccatttcttctagattttctactttatttgcatagaggtctttacagtattctctgatggtagtttgtatttctgtgggattggtggtgatatcccctttatcattttttattgcgtctatttgattcttctctcttttcttctgtattagtcttgctagcggtctatcaattttgttgatcttttcaaaaaaccagctcctggatttattgattttttgaagggttttttgtgtctctatttccttcagttctgctctgatcttaattatttcttgccttctgctagcttttgaatgtgtttgctcttgcttttctagttcttttaattgtgatgttagggtgtcaattttagatctttcctgctttctcttgtgggcatttagtgctataaatttccctctacacactgctttgaatatgtcccagagattctggtatgttgtgtctttgttctcattggtttcaaagagcatctttatttctgccttctttcattatgtacccagtagtcattcaggagcaggttgttcagtttccatgtagttgagtggttttgagtgagtttctgaatcctgagttctagtttgattgcactgtggtctgagttctagtttgattgcactgtggtctgagagacagcttgttataatttctgttcttttacatttgctgaggagtgctttacttccaactatgtggtcaattttggaataggtgtggtgtggtgctgaaaagaatgtatattctgttgatttggggtggagagttctgtagatgtctattaggtctgtttggtgcagagctgagttcagttcctggatatccttgttaactttctgtctcattgatctttctaatgttgacagtggggtgttaaagtctcccattattattgtgtgggagtctaagtctctttgtagatctctaaggacttgctttatgaatctgggtgctcctgtattgggtgcatattatttaggatagttagctcttcttgttgaattgatccctttaccattatgtaatggtcttctttgtctcttttgatctttgttggtttaaagtctgttttatcagagactaggattgcaacccctgcctttttttgttttccatttgcttggtagatcttcctccatccctttcttttgagcctatgtgtgtctctgcacgtgagatgggtttcctgaatacagcacactgatgggtcttgactctttatccaatttgccagtctgtgtcttttaattggaccatttagcccatttacacttaaggttaatattattatgtgtgaatttgatcctgtcattatgatgttagctggtcattttgcttgttagttgatgcagtttcttcctagcctcgatggtctttacaatttggcatgtttttgcagtggctggtaccagttgttcctttccatgtttagtgcttccttcaggagctcttttagggcaggcctggtggtaacaaaatctctcagcgtttgcttgtctgtaaagtattttatttctccttcacttatgaagcttagtttggctggatatgaaattctgggttgaaaattcttttcttcaagaatgttgaatattggcccccactctcttctggcttgtagagtttctgctgagagatccactgttactctgatgggcttccctttgtgggtaacccgacctttctctctggctgcccttaacattttttccttcatttcaagtttgatgaatctgacaattatgtgtgttggagttgctcttctcaaggagtatctttgtggcgttctctgtatttcctgaatttgaatattggcctgccttgctagattggggaagttctcctggataatatcctgcagtgttttccaacttggttccattctccccatcactttcaggtacacaaatcagacgtagagttggtcttttcacatagtcccatgtttcttggaggcttgtttgtttctttttattcttttttctctaaacttcttttctcgcttcatttcattcatttgatcttccatcactgataccctttcttccagttgatcgaatcagctactgaggcttgtgcattcatcacatagttctgaggccgtggttttcagctccatcaggtcctttaaggctttctctgtattggttattctagctagccattcatctaattttttttcaaggtttttaacttctttgccatgggttcgaacttcctcctttagctcagagtagtttgatcgtctgaagacttcttctctcaactcgtcaaagtcattgtctgtccagctttgttccgttgctggtgaggagctggtttcctttggaggaggagaggtgctctgatttttagagtttccagtttttctgctctgttttttacccatctttgtggttttatctacctttggtctttgatcatggtgacgtacagatggggttttggtgtggatgtcgtttctgtttgttagttttccttctaacagtcaggaccctcagctgcaggtctgttggagtttgctggaggtccactccagaccctgtttgcctggatatcagcagtggaggccacagaacagcggatattggtgaacagcaaatgttgctgcctgatcattcctctggaagttttgtctcagaggagtacccggccggctgtgtgaggtgtcagtctacccctactagggggtgcctcccagttaggctactcgggggtcagggacccacttgaggacgcagtctgtccattctccgatctccagctgcatgatgggggaaccactactctcttcaaagctgtcagacagggacatttaagtctgcagaggttattgctttcttttgtttggctatgccctgcccccagaggtggagtctacagaggcaggcaggcctccttgagctgcagtaggctccactgagttcgagcttcccagccgctttatttacctactcaagcctcggcaatggcaggcgcccctccccaagcctcgctgctgccttgcagtttgatctcagactgctgtgctagcaatgagcgaggctctgtgggcgtaggaccctctgagccatgtgtgggatataatctcctggtgtgccgtttgctaagactgttggaaaagtgcagtattagggtgggagtgacctgattttccaggtgccatctgtcacccctttctttgactaggaaagggaattccctgaccctttgtgcttcccaggtgaggtgatgcctcgccctgcttcagctcatgcttggtgtgctgcgcccactgtcctgcacccactttccgacactccctagtgagatgaacccggtacctcagttggaaatgcagaaatcacctgtcttctgcgtcgctcatgcggggagctgtagactggagctgttcctatttggtcatcttggctccaccccccaatttaaatattaatctcatctaaaaaggaccatcactgtgaccgccagaagggctgggttctgtggcctagtcaagctgacacatcacagagagggacaacaaagtgctctcaggtgacactgtcctcccttggatctgtggctccatccctgccctcctgccctcgggggagcttgtagaaggcttcatctcagagcccactgcccctgagtcatgtgatccaatcaaggcccctgagcagagaataaagaggtcactctggcaagtctgggaggagactgaccagtgtagtcggtggaggcattggtcaagcccccagccctggtcctgaagcaaaatcctccccaggtccagactctcagcaccttcttcccaggcaggggctgacagatgcctctgtgggtgcttaggaaacagccagaggatgccagcggtccaaggagtggctggggcagggcctgagacccagcagctgccggccatgatgcaggctgggaagtggttcatttaagatggcacttgttgggcagcaatgtgtgacactccctctagaggctcagatcaattctcgtgcttttatcttttcttgaggctcagcatgatgaaaagtggcctatatctacagctgataaataaccagaaacttgctgtatctgttttcattttattttcttgaacaattaccgccagcatgccttacattcagaggctgagattttaagtggccaaaagaacttcccaactgagcctgccagggactcgtttgaaatgttctttgctgcatcgaaaagcaccagacatgatctgtgaaagagctgggaggaaaatgttgcatgttcacagcacaagcgtgtcctcctctccaggggatgggaacatggaggatggttcccacctccaacctcaaaccctaggagaggcctgtcccactgatgagagaggacagcgccagcccaggagccatccaaaggatcatcagggtgaggaggggtttggagcccctgggatggctggggaggaaatggggagtgtggagctgcaggatccttagatgctgtctacattcctctagttgagcactcaagtcattgtgtgaccctagtcacatgtctgcctcagcaccaggagagttagctccttgaagccaggaactgcttcttttaatactcagagtggtatcagcatttaacaacaggtgctcaatacatgttaaatagaagggaggacggatgcatggatggttggatgggtggatggatggaggagtaggtgggtagatggaaggatggatggatggatggatggatggatggatggatggttagatgggtggttggatggaatgatgagtggatggatggatgggtaggtggatggatggaagataggtggatgggcagctggatggatgggtgaatgggtgggtagctggatggatggatggatggatgggtgtgtggatggttggatggaatggtaggtgggtggatggatggatgggtcaatggatagatggaagataggtggatgggtagatggatggatgggtgaataggtggactggtggatggatggatggatggatggatgtgtagatggaatgataggtgggtggatggatggatgggtggatggatggatggatggatagatggatagatagtcaatagatgagtaagtggaggggttgatggatggaagatgagtggatgggtagtgcatatatggaggggtgggagaatgagtggatagatgtgtggataggtggattctttggaggatgatagataaatatttggatggataggtgggtgggtaggcagatgggtgaatggataggtgagtaggtgggttgacagatggactgttgagtgaatgaatgtgtgaatggaaaagtggcatgaatctttcctcaaatctttgaaagactgtcacatcttaaagagtggagtcgtatcttctgtggatccagaaaacaaaatcatagtagattctatagagaagcagatttggactcaggctaagaaagaactttctactgaccccagttggcttttgttggagtagactgtgtggaaagggagcaagtcatggtccctggaagtgtcaggaaaaggaagctgtcaggtgtagtagaaggtgtccttgtgctagttgcagggagaccccagaggtctttccatctctggcctccatagttcctcctgagcccctgtcctcaactgggtcaaggagccaatttttctggcccctgcaggagacccatgctctgctagtgcagctgctgacccatggcaggggtgcactctcctggcttcagaccttggctctcctgcccgctcctctgactgagctctcagatgctgcccaggtgacctgaggaagctgatctgcagagaggacaggaagcatgtgacagtcaagcaggcccagacctgaccaaggtcatgcaggtggtagatgggagaggcaaggaggtgctgccaggaagcccctacagagacaaattggacagagccagggcagagcctcccaggcctagttcctggggaatgctcagggccagggaaccctcctctggagcaggcacatgtccttagcactcaccttccctactaagagccagggcctgaaaggagacaaaaaaggcctgagaaagaagctggggcccaggactgcataacaccagtgcctgtttcactgtccccagcccagggaaagggattggggctccatgagaggctgatggcagggaaggagccatgcaggagccccatttggcttgtgtctgtccccttggcatctctttctccttagaaaatctgattgcttgtagcttccacactggccatcagtttgatctgagctcaagggtgcagcagaggctcaccttgttctgcttaaataatgcaggtagtgaagttattgacaatctgtcatctgcttgaaagtggcttcgacagagccagaagcgtgggagggccccaggggcctcagccggccacaggtccagtctctggctgaacaggggctcttcaagaagggccaggcccttggcatggtccaagatgaatggatgggagcttgagccctacctggccttttctagaaggacattctatggggaaattctaagcagaagtgagggcaggagctgtctggctaggaggcctgcgttgtggattggaaaggagtctcctgatgcaggctgggccccccgcaggggtgggggcagtgctgagtcacttcctgccagaggacagggtctgaactcccaggacattctggccccttcccactaccggcctagccctgccgcctgtgccttgcctcctggcctcctagccacagacaggggtttatgatgagccggcttgctcatccttgagcctgggttggatttttttttaatgtttaaaaattccccacagcatggcaggtgcccggctgctgggtcaccccatcggctgttctgtcatcagacatcatgtttacccatcagacgctgttttcctgacactcaacactcaaaataatgatctcgctggagcaccttcatgaatgattcatgaggctctgctcaactttgggtgttaacagcaaatcaaagcccctcagtgagggcagcagagcagcagccagaaggcaagccctggccccagcctccaggcccccagggatgctcagggcctgccacccctctctcaggctccagtccagccctgcaggagtgagccagcctcagccaggccatggcacaaaaggggaggggagcagggtcctggctgtcacccatgtcctggtgaccttgctgaggacattggagctccagcctcaagtcagatcccctggaccccagatctcttccacccacaggtggtgtgaccttgagcaggtcactttgcttctctgagcctctctttcctgtctgcaaagccaggtgggaactgccctcccgcagggcacctgtgaacacgtgtgagtgccaggaactgaggttcctggcatccgggtagagtccaaacatggaagctcggattattatgtactgctcttacttcacctctcctggtcttcattctcttatttgtgaaatgagagggtaaactgtggggtctccaagtctctttacctgaaatacagcacctgccgggtctgtccacactgtgtgtgcactcacaggagggagctgtgcagcctgcaaagggggagctgcttctcagggacgtttctctgccagattctgcaacggagaagcatggagggcacagcccagccaggggttgtgcaaaaacacacacacacacgtgctcacatgtgctcacatggcagtggcagcagccaaacatgacctcataaatacatacacagcctgttcagcacatagagacattaaaggcaaggctcagcgagaagagctgggatatctgggtcctgttctgtccctgtgtccccaaaccggtggctccctgagggaaaggccaagtctgctccatcaccaggacctgcctggctcctgcacattgtgcttggcactgaacttgcacttaataaacatgggtcaaatgaagggaattcctagtgttgagcactaggaatgcaatcccaaacaagaccagccacagtcaatcagccccgtgaccctccccccagcctcagtttctcctctgtggcctagcaggttaaatccctaatgccacaaatgttctagcctggttctgccattcaaaagtgactgggggcagactccgtggcccctcctataggcctgtcagcaacagttgcaggggggtgcccatccataaccctgaccccagggaagggagggagtggagccacaagaccagaagtggcctctgcccctccctagaaacaagatgcagccccagctgggaaggcctatggctttttctttcttccctaaatggcctgggagcccctaaggcaaggatgggtccttgccctgatggtgcagccaggcccagcagcagcacagagtggaggtcaaatagcgcctcagagcaccagatgaacctcaagaaagcagcatgaggggcaaaggccagggcttcccagtcctggtaactacgggaggccaggtcccaggcccccaggcagaggggaagctaagtggccaagacgcaggcccaggcctgagacccctagctctgccctttgcaacctgtgcagtcctggacaaatcaccttgcctctcgaagtgtccattttctcctctgtaaagcaggcagagtgaaagtacccacctccgggactgtggagaggaaggcgcggggccatgcagaagagagctgggccatggtgcgggcctagtccatgctctcggtgcagagttggggataagagaccagggcccacagcctggggggctgctgagtctgtgtttatttatcacgttgatattttgttcattgtggatttttttcacaacagttccaactttttagaatattgcactaaacattatctccgttactgagttttctggcacccccttaaattttgtggccaagacaagtgcctcccttgccttccctgcacagcctaggcctctggccaaagggcttggaccaaagtatctgagtccaggaggaggccaggttagaggagcaggatgctgggaacaggtttgagcgaggaccaggaaggagaggattccctctagcccgagggcctgagcctgacccgggtgggtgtgagagagcaggagccaagtggtgcctgatgttggaacatgccacctgggctgctggggggccaagcttgccaacaagagtctgacaagagctgtgtgcagcaggaggctctctccagccttactatcagacccttactgtacctcccaggctcagccggcctttcccacctgcactcgctgccagggtaaggtgggggcagctgctgcttcaggctgcccctcactcccacctctgcccaggggccagtgctgggggaccgcctggagcttctctgtgccttgccaagccccctgtcttgacctgagaggtgctgacctgacccactgaaatgggagagttccctgaccccgtcaagagacttgcaacggggtatggctcattttcttggcagctgccatgcgcccactgggagggggtgcacagagatgggcaggggcaggagcctgggcaagtgcttttgggctctggccccatggtagcatctagaggtgtgttacaattaatgctgttttggcagttgccatccacggacagctaagtgttaaaccagctcagtggagagtcaggatgacagccttttacaccctgccctcttggtacccagcttcttgtccggtatcccagaagaatcaggtcacacggacttgaaggatggtgaatgtggggatttgattgagtggtggaggtggctctcagcaggatggatggggagctggacaagggatggagtgggaagatgattttcccctggagtttggtcatcctgaagctgatctcctctccaactatccccagccaaactcctctcgacgtttagacactccttctcttttctctttctctgccgtgccactgtgccactcttctgcccctctgctcatctgtctgtggatcctggagcttggggtttatatgagtacaggataggagggcacggtgggctaaaaggcaacatttgggcgcagaaacaggattgcctgttcccatttagggctgcaggtttccaggcttgagggcggggcctttgctggggaactgccctcttctacccagtatttccttgcctcctgtccgtatcaccactccgagctcactgggccggaagggcaggggtcacagtgtgcatggagtgatggctgccaggcacagccattctgacatttcaggagactgtggaccactcagagacagggctctaagcaaggccagcacacagatggctgaggccatcccactggggctcttggggccaaaaccaccctttgcaggttaagagggcatttcaaagaaaaaggtttgggtgagaggaaggcggtgggagtgattctgcagaaacagattctgggcctcaattccctcctcttggagggcctgctccccaggagtccccatcaccctgtgggttggtcctcgccaccagaagggcctgtgttcttcatgaacctttccatgtgcaccagtcttaaccgggagtgtgtttcccaaagacaggtagctcaccttagcagttttatatccgtaccccaggcatcagcaggtgcccaccaaacccatgacccaaggattgcagggaccaggagagaagagcaggaagaaattgtgtctaatccatgggaaccccgggatgggatgtagatgagtgtttggccacacagttggcaagtcgccttggaactggaacatagagcaaagccagagtcctcactgaccccctcccgacacctgcctttcatctgcttacgttttcaagcccagctgtgtgcccagcactgtgctgagtgagatggacagacaagtagggaggagggtcctgagtggtgggcatggactggtgcagagcacacaggagaggcccagcctggcctgggtggtcccccaggccgtaaagccagagctgggttttggacaatccctggagctgagccaggctgcagggaaaagatgcacggaggcgcagaggcagcaaccagccccctccaggacctgcgggagtgtttatggcatggtccttgcccacaaggaggtggtgacaaattggggacaagttaaatagaacaagatttaagtcccattgccaagcagggaatgggagccggggcacaggaaagctcgtgatgaagtgccagatgaatcacacactgcatggctctcagcctgaggagagcgatggcgggggcggggcaggccggacccggaggagtagggggagcaggcgggacctggaggggtgggtgggagcagagcgatgggtattggggcaagctggacccagaggagtcgggggagcaagtaggacctggaggggcagatgggaggagagcgatggtggagaggggcaggccggacctagagtgtcaggtgggaggagagagatggtgggggggcaggtcagacctggaggggtgaggagaggagagcaatgggtggggagggcaggcctgacccagaggggtgggtgggaggagagcactgaggggagcgatgggtggttggggaggtggaacccagaggtaggggtgggaggagagggatggtggtgggggcaggcctgacccagaggggtgagtaggaggagaggagattttggcaggagaaatgaggatgtcagcaaaggcccgaggcctgaaggctcaggctgagtccaggtcaggtttggctgcaatggatgagttggggtcaaaggcggctgagagggggctcctcccagagcctgagctggcctatgtgtccatcccctcccttgttggagctctggcgtggagcttcccattctagcctcagccacctatttatgtccatctcctgctcacacaaaaccagattccagagacaaacagggagacataaaaaggagaagagatgaagattcattgatgccagaactgactctcttctggaaaattgaaatattttgtacgtaatgacaatcaagtcaccgtgcgaccttcccggaataacttcccagatatatgacagtgacaacaaccgccccattggcgctgacacgctgaaggctccccaaagccaccacttaaaaaatgcctcccgcgttattaacattcctcacttgggaatgtttatggctcgtcactgttatcaacagtaacaaatttcgagaacctataaatgacaccacccccagagacagcccgggacaatccaccatcagcctgcctggcccaggctagactgtgaacatcaaatcaggctcatctgatgggcccccagccccgctgctcccacctcccgaggctcctgtcctcctcactcaccttgacccctgaaagccctggctccatctgcatccacttaacctccatcagggcccttgcccatcagatactgctggggggagggtacaggggtctcctgttcagaaccagggctttgagccacagcaggtgttacatttcccaaccgctgcttcttcctgctgcagagccccactccacacacctacaaagagaccctttttctcttcccttccttcattcattcactcattcgttcatgtgtgtattcatccatacgacgtgtttgctgaagtgattggaatgttgcacgaatgccctggccatgcatcagttgcagtctggtgacttccatcttaaagggcaaggtcagtgccaggcagaggggcagccttaggacctgcgatgtcagaacccacagtgctgtggtccccatcctagcagcagcctacaggaggcaaagaacctagccgctggcaagaagggcaatgcaggcctcataccccaccagtccctccctccaactgatgctaaaaactgtccttggagacaaacaggaagtatatatatggcatagtgacaggcagctcgggctttggagcaggctgcttgagtgtggctgcagctgtgacactgattagctcgaatcttctgaacatcagttttcttggccataaaatgggactaaaagcattcccggagctgttaagagggtcaaatgaaatagtgcatgtcaagggtacagcacgcttcttgatgcaaagccaatgctcagcagatgaagactgttgccacttgtacagattctctctttttgctttgggctttaattctcctacaagggtagaagtccaggtgagggggttttgtggccacttcgtttggaggatgtgtgttccatgagagaagagacaaaggtcactttggggccatgggggaggtaccagggaggaggcagcctgcaagacggatggctggcatggccacctcctggctttggccagctctccctggcttggccaccatggagtgaccttaagccagtcactcaccctcccccagcctcagtttctccatttgctgagaaggcctcctcaggcctgccattcacatccagcacctacaatagctctttgtggaatgttttatacaggatttctgtgaaaacctaacaagataatgaatatgagagagctttgaaaatactcagtgttttgtaaatgtaagagattattattcccatttaccacccttttaaaaggatgtttttcctccattcagccaaatttaacttggatgatgaagaacccagcctgggcttccccagctataattttcctgttccttgtgcctctgaatattaaaacacaaaggctcacattgctgagagaaaccaaaacagcagcctattagaggtgccattgcacaaacggaattcaaagtgatatttcaagcagggcgttctgtttatgtaaaccttgagagcacttgatgaatgtcagcagaactttgaaattaaaatcacttctttttttcatacgctgctcactctgttcttgagcccacgtcttgggtagtcgtggaggttaagaaaccactcagggtttaccttatactgttagaaatgctaagagatgaggcagggaggcatcctaaatgcctccgaaccggtcagcccaggactgcaaggcgaaggccaagtctcttaaagcaacagcctccaggagcgctgtccagagtgctgaaaaggaagccgggcctcgggggtgactggggggcatttggaagagggtccttccccagggacacattcctgctgctccctagaatcctgagggggaatggagggggaccctagggaggccaagtcccctgtgtgagctggagggaatggaacactagcaggcagagggagaagcgtgacagggaggagagacggggcccccccaccagagtgacaactgcagtggaaatgaagaggaggggtgagcgcagaagctggaggaactggcaaataaagtaataaaacagagagatataccctatgacagcagggagataaatggagcaagttataccaagggctcatttttgtgcaaatatttggggctctataaaataaggctgtttattataaatctgtctcccaagtaagtcttgccagtgcacaggtgtcacccgcagggaagttttccctctaaggcacagagggttgagctcgtggggtaaagtgtggctgcaactgctctttctgttctataaatagcccttcccgcgggggaaatgagactgctgggagccaagagaaggagccaggttcggccacgggatgcctggtggccttgaccttcacttccagccaagcggctgctgtggctgtgcagtgtcccagaatcaagatgactgacacacatggtcgtggctgaggagtctctcagtcctgtctttaaatatcaggagggctctgctgccacattctctctccagctcagcgggggaagagatgacagagcacaaaagtgtagcagcagagaaccagctgagaccggaggaggacttcagggttcatccactccttcgaaaactttgaaagtatagacaaccctctgcctgaaatggctcgaggcaattcttcctggaaccaagggaaggattggaagacttcaggagcttggggaaattcccaggagaatttgagtcctctaccctcaggctctagggccagcatatcagcaaagcaaataaggcctcaaagctgatgaggtcctcaatctcagagcagcccctttccctgctaagcagacacttagacacccaggaaaggacacagcaggggtgccagatgtctcaatggtagggtcacctgaaggactttggtcatgcacacccacccccccacccccatgcatacacataaggtctaaggtactatttccagaggaccaggattcctgttcctcagaggaatttgctcttgggtccccgatcttcttgattgtgaaatagtccagtgaatggagaatcggggtccccaacttccaagagcccatttcctcagctctaaggtggggctgatcacaataaggttcttaggagaattcaacacaggaagctactcaaagcctgcagcccaaggcctggcacagatcgacattagttcttagcatgctctggacaagaagtcacccctgtaccatgcacacagtgggagctcctgaattacccagatggacttgagtctgcttctaagatgtggtgctcccacagcagcctgggcaggttccttgggggccatcatcataccttcatcccatgttgtcattttggctggccttgatcacatcacactggcacatcatctgtcttcttcacctcgaccctgaggacactgactctctcttcttccatctccatatctctagtgcctgtaactcaagaaggtgttagctgagtggtcagtggagagatggcatctcagcctatatcacctcccaagccagaccagattccaccctgtgccaagcctcagcagctccccacccaggagaaccactttctaggatcgggaggccctcttttcccaattctatgcccactcctctttatcctgctttgtgtgcggctccaggctctcaactctgcacctttggaaaagacgtcagctttctccctggcttggggcctctgccccaaagactgactctgtactgtttatcgtctccctcgttttcaaggctttggctggaaatttggctccttgggccggttccgatgatattttacagtgccttcttaatttactgtctttttatgactatagtaaaaggccacacatcagggaaggctatcaaacaggaagaaacatcccctctccttgtcagctcaagttgagcattgtaatttacatgaaaaccttgtggcttagggtgtttacctcccatggaaccagtttcttctcccattatgagaatgagataattaaaaacttccctgttcctttgatattgaattaggttaactcagcccaattgcaaatgccagtttgaaggctgttatgtcatttggatttcaatgtagagccatccttttttttttaatccagaaatgctttattcttgtctcttatcctgatcccaaattagacatagggaagggaaataagggatttattcacatttgaccaaaaaatttgcatctcaaacagaaattttaaggaggccagggccagggaggcagctgaggctgtgtggcttccccctagtcaacaggcttcacagttcacccaatgtgagagagggaaagcatgaagaggaaagtatgagacccagtccataggaggaaaaccacagtccaacttctctccacctgccatctaccatcaccacggagccatgccatggcaagctattcctgcccctagggagacaaaccccaactcaaattggcctaagcaatgcagaatgtattctatcacctacgcggaaagccagagagagtgcgaactgcagggtcagcctattcaggggttcagccatgtcaccagccaactctgccatcttgagtgctggcttcgtgtgcctcctgggagccaggtgactgcagtccaggttcacatgacacatagcaggtgtcacaaggaagaagagtgggatgttctgcagctcctaccagtgaaaaaccctctcctggaaaccttcacacttctcttacctcatgagccagaattgggtcacatacccattcctaaatattcccttatgaggaagatgggagaataattggccaatgagattcactcgccactgccccctgccaaacacacacaatgacaaaattgaggagaaattgatttttttttttttttgagatggagtctcactctgtcaccaaggctggagtgcagtggcatgatctcagctcactgcaacctccgcctcctgggttcaagcgattctcgtgccccagcctcctgagtagctgggattataggcaagtgcaaccacacccaactaatttttgtatttttagtagagacggagtttcaccatgatggccaggctggtcttgaactcctgggctcaagtgatccgcctgcctcgggagaaatgaattttgatggggaataaatgctgtgcagacaatgtatgtgatgctgtcattaaatgttgcacacattcaaagcaatgtatatgtacacaagcaaaagtaacaagaaaatgggccctcccagaatagaccagaactagacccaggcctttgaagttccctctaaggacaggctcactcttctccatccttgctggagtcttgaaagttgaacatcgtggtaccaggagagtgagtggaacgtggggccactgtggagcccagtgattctcaaacaggggtgattttactccccaaggacatttggcaatgtctgaagacaattttttgtcatcacccttcgagtaatttagtcgtggaggccagatgtgctgctgagcatcctctattgcacggcacagccccacaacaaagagttatacagccccaagtgtctacagttgtgaggctgagaaacctcatggaagcctggctttcatccaggatactcccatgatgctttgccccctgggaaagggagagaggaggtggcttaccaatgagatgtgactggaagctggagaacacagaactggtcttcacccctccttcccttctctcacagaactttcctttacctctggcaaaacaaagaaaaagagagagagagaatatattctatgctgccttgttctgcacgagtatcttactgggaggctgtcagcatttggagagcagggcccagttccaccatgtctgtatccgcccagcactcacagagcaggtacctcataaatgtgggttagaaggagggaggagagatggagttggaggagaggtctgggactgagtagagaagctatgatttagaggcaggcaagtcccctgaggcaaattttggccggggctgagatcagctggttcttagctggggaacaaagaccattcaagagtgggtcagccagattcaaaggtttagctcgagaaattgaacctgacagttcagaccaagccagaaggtcctttgacaagagaagcagggaggaggtgttggaggaggcagccctgaggacaggtgcaggatgcatggggccagagcaggtggaagcaggagagagaaagagagtgcgagggaaaggccgtagggtcaggggagtaatccatcaatgttccgtccaatgctgggaagagcagggcccaacagtggagaaaaggccaggaccttgagaggcattgcaccctgattaggggctggtgaactggagggagcaggcaggggtccagccaggaaaagaggtcctctcataggggcaactagagggaggctgccacagaagaggggccactggcccaagagagccaagggctctgggaggaccccccatggtgggtgctggagagcccctgagcccttttatttcacagtgacaggccacagccagaatacgttgtcaccgtcacctggctatgtcagcagaattttcaacaggggctgtggtctgggatgccaggaatttccccttggctcctgagacatttgctaagccaggcgccaactggagacagtgacgggagagtctgagcatcgtgcctcggtgctgacctctgatattcaaattcctggaagccctggtgcaccttgtcctggcagtgcagctcggtagaggtactcccctcaaagttaataagaaactaagaaattaatttcctgtcaggtgcctctgcccagcagtggcagcccaacactctgtgtcattgggagtgtacttaaatcgcaaggaaagttataacaagggggctggtgaggtgccaggtgcagtgctcgcccttctggaagtttcctggaagagggatggagacgtctgtgcaatcccgagcaggtcgggggtgccagcaacacagcctggccctgggaccattgcttccaagaaggtcactttggtttttacttgaccatggtttgttgcaaaattcctggcaccagctcagctcggccacgtctcggctccctggcgcctctagagagaacgaatatgctaaagatagtgaggcgtcttctctgggtgacctcgtgtgaccttgcaatcccgtcaagtctttggttctgcagaaacaactgtcagatcgggagttagtcacctccaaagacagaaaccaaaaaccaaaacagtgaccttgttctttctgttcatgaccctggaggtatggggggaggaggaggaagcggagattggttttgctcgttaactcattatcagtgactgagcggctactcatggctgggaacttgttgggtgccctccattacacttcccttaatcctctcaatggcttttgatatcctcaggtagatgggaggatccccattttacctgggagggatacaaggccaagaggggttaagtaacttgcccaagatcacacagcgtttgaagtggccaaggtgaaatttgatctaacttccacttggatgtgtgattccactccacatccaagttctttccatcatctggctgcaggcaagataacagattggtgtattctttctatcttatttgaattccaaagttagtatccgctattgaaaacagctgacttcattataacccatcattgactcctttctttaacaaataaccagcaaaacagagcgttctttcggagtaagccttccaccacctgaactttgacaactttctccctaatgggtttctccctgtgagtatttgatcttggccaccagcatgagcctatcctggtgatctcaaaatgctgaggtttttcttctgttaagagattgaatcttctgttccatgtggaggcttattcaacattaaagcgttcctgaaccatttcatttattcaacaaatattttccaagcccagctctgggccagatgccaggctcaaggcttagcaagccagacagatgtggagccgccatcatggaactcggccctcacaggccattgtccttggctttccagactgaacctctgtgctttcttgtttcacggctgttttcctgaatgctccctgtgagcccgagtctgtcctgaggtcttcgtccctattccctgtgcctgaatcctttcctctcccagagctccccacagctggcttctttttatcatctcagatacagctgaaggttccatcctcagaggccttctcaagctcgctggctaaattctccacccacccccattttttatgctcataccacttcatgccatccagaaccaccttattctttattccaatgtttatagctcgtctcttccatgctctttgagggcagagtcttagacttggtcacagtagaccccaaatgtaggccagtccctggtatcttgtggttcttgagagctaatctgttgaatgaatgaatgaatgaatgaatgagggaattaatgaacaccctgcaaagcaagtgccacagttacccctactctatagaagaggcagctgttcctctaaaaggctgagaatcccacctcagagctacctgcaggagagtgggtgagctgggaccccagtcatttcaggttaactgaagggaaagcctgacttcccatcagctccacacactgagtcctttctcctagaaatgaaggaaacacaaagaagtcactaagaaggcacctcgccctcaagcatctgaaaccctcagttggaaatttgactgcaacctctgcctcctgggttcaagggattctcctgcctcagccccccaagtagctgggactacaggcatgcgccaccacacccagctaattctgtattttcaggagagatgggatttcaccatgttggccaggctggtctcaaactcctgacctcaggtgttccgcccgcctcggcctcccgaggtgctgggattacagaagctctttttcaacattgccttttagatcccctttcccatcagcttcctccaaaggagctgctggcttgatttacctgcagccaccgcaattaattgctgtcccctggtagctaacatctcttaacagctccatagcaacagtggtttccaaatgccagaaagtgttttttccaaggggactctatcctcgacgcaaaatagaacattttgagtgaaatttaaacacagtttttgaacggtgctgttctgatttcttcacacttcacaaatgctttctttgcaaacatgggtgtcccagttaccctgggctggtgccaaggccctcagcccagcttctgttttctcagcttcaaggcagccgtggtaagacctaaaaacaaacagggagcgagtgctgtgggtctccccgctaaggggttgccttgcgcctgtgcagagatgaggaccacagtttgtctcccacaccagctgtgatcaattggtgatgacaacgcagaaccctgcctatgcgatttctgggaccccatctgagcttagtgggaaagagtgccatccgccatggttccagtgcagaattccaagggccaagatggggagtagggatttgtgtatgagtggttggttggaacaaatcatcctggtataccactgctcccacaggtggaaacagagaaactgggttaaaatgaagactccagtaaattcgcatgcagaagtacccagaaaggcccttgccatgtccttcactctgccttggtgaaggtggaagagatgaagggagagggtgatgggtgggtggtgggtgtgctggccaccgactggcacagcccccagcacaggggctgtctctagtgaccgatccaggatgagtgtccccattcagatgcagtcaacccaccactgattcaaccaacacttgctgactgcctatcagggaatacatttccttctgatgcacactctgctctcaggaagtctggggtccagagagggaatggaggtgccagccagcctgaagatcagtggaaagagtgaggctggctgatgctgcaggagagacacagaggactgtcaggggagtcccaaagggaatgaaattattttggttggaaggataaagggaggctggaaggacagtgtgacgttggatctgggtcttgacaagtaggtggaatgtggagagattccaggccttgggaacagcgtgggcagggccagtggcagagcaggctgaatggtctggttgactgagccaagaggggtgagaagggtgcatgggaggtggatccagccgatcatggaggccattgggatcaggagtggggttgcattcacaggaaatggggagccaggaaaggttagcagtgggtgacgtcatcagagctgggacttgggaagatggctctgagagttggatgggagtgcctggctcaaaggcagaccagtcaggaggctgatgccaaggagcatggggaaggcagtgaggggagactggggcggtggcctcaagggccaagaggaaagcaggatgcctgcccgtctctcccctccttcagctctgctggcattagcagcgcctcagacttggtggccatggagtcacagtggcaggactgctctgtggcctgattctgcccccatcgggctgacagggtcttggcctctaagcaggatgcttagagttgcccctgccctgaggaagctggatgaagccaggccgttctgtcgcatcatctgaagaggagtgagtggggttgccagctccctgctagcacagatgcccaccccaccgttgtcttcagcatctgccaggagagggacagtttgaggcagtgtcggggttcacgagcttgctctcctctgccattcgcaatgggctggcatagggcagcctcactgcttggctccagccagcgacttcaggatgtggcgatgaagatggggtctggatgggcgttggtattcaggatgtcgagccccactggtctgggggaccagttggcgcttcctgcaaaggcatgtgctctgggaagggcctggcctgctgcagcagctctgcagaggggccggccccagacttgcctatgtcattagtatagcaggtcccgttattacccgaggaggcttacaggttatcagcgagctccaggagccactggagaaaggaagaagataaagaaggatttaaaaagaaaataacaaaaagaaaaactgtattttctaatccaaaccttgccctgcagtggctttgttaacccccagtcactccttcaagacataaactgttgagagccacaattacttcagtgattacacgttatcttgtcctaccaaggtattaaagaggaactggggaacacattaaaaaaacatacagcccaatttaatcatgattccctctaaaacaattgctggaatctcaccattacagatgccagagcataaaaatcctgtagatgcttgatggaccgggcacaattcatcctctgctgcctccacggccagcccatttgtcagtcaagggagagctttggggtttaggtctttaacaggattgagtgcaggggctccccaggtgctcctccagagcagaggaagggtggccccatcccaacctcccagatttccctgcttggatcacctgccctgccatcactaccaccaggaagacactaaacagaaagcccaccaaacatctcgggaccctactcatagtcaaggttgtgaagaagtttgctggccgggaagcagccttgttctgaatgccacttgtggtgaacagcaaccagctctgcttttctgcaaattctctctgcaaagcgagggaggtgtaatcatttgcttcagaaggttctgaacatcaggaagaggcaaagctgagagacagcagagggtgggggtcgggtgcagctccctgtcctcactctctacctgtctgctgcgtgacgttcaactcagagtctctcttgcttcagttttcccaattggagatggaagggggttgataagttggcctggacaatccctaagtttcctcccaccttcactactctctgttccaagaggagtaaacagaagggtttaggagacccctgacttgcaggaccctggaggatctttcatgcacaaattaaaatacataaagcatccaggaagaggacagtgcttactagagaaggggctggaggcactggagctcctcaagggcttgcaggtcacttgatgcctgtatcatctggatgaggactagaagtgatcccattggcccaagggactcctacctatccaatgtggcaggatgtggatggggtgtctgtctctttaattcatggagagttatgggatatttttcgggaaaatggagctttgttttcttccagagtttggaagataaccaagaattgtctcagagatcctgtttttatgtttggacaagaatggctggtgtttagctcatcgtctgttggagatcatgatgcttcctcgatgtttgaaaagaatttaactttacctagatgggctcctatctcaaagaatcacgcttcccaaataagcaatatctgaattaatttgatgttgctccacatggaagttccatacgatcctagggaaactttgtccttagcaatagtgtgagatgacataacactggttagagaggtcagtcagaataatacctggcccttctgaaggtttcccatgcctcgggcactgttcaaatgctgtatcttgtttagtcttcacaactacctcagggagcaggcactactgttctctccattgtatggatgagaaaactaaggcacagagatgtgattgcccaaagctcacagctaggaggtagcagaacccagactcgaacctaaggcagttgtctctggagcacacactctctaccactctgcttcctcagcatcagatagacctgggcttaatgggcagggctttgatggactacttaattccttacgttttagattctttatgtgtaaagcagatggggccataaccagttctaccttgtgaggttgtagtgaggattaaacaagctaagtcccgggaagtagttagcactcagcacctggagcatacaggtctgaagaaatgctagttctcagcaatcatagcggtgggggttattgacaccagagggtcatctgaattgtgtggtggaaagagtgaccggcttagccgaaagaagatgtgatcattttttaggaactaaggctcatgggcgatgcaacaaaaaactcgacttgaactgactttgggggaggaagagatttgggggctggagttgctgaaaagtcttgagatgtgctggcctgtgttccatcagttgcatcgaggctttgtgtcttctcccctcagccctgctcctcgcaccagctcccttctccttctccatgtgctggcaagagatggcttccaggagcactagatttcattctcccaggttcgagttcagcaggaaagagcacccctgcctccaagtgactccaaccaaagcctagtgattagcactgattggctctggtggagccatgggtctctctctgagccagtcgatgtggcccaaagaatgcggcttggccagcctgagtgacaagctccacccctggactgagttggagaggtggctggattgctaaagaaaacttggaaactcttatcaaaagagctagtgcaccagagttgtgtccagctcagcctcccatgagccacgtggccgtgagcagatcatgtagcacctctcagtccagcagggatggtggcacatgcccaacttccttcagagctatggaggggagcagatgggcaggaaaggctacagagcacatcagtcactctagagatgcctcaatgactgtttgctgccattgtcatctgatgggcttgattcactgcctaatggggcacagttctgagcaggcacaccagctctgggagcagaagtggggcgcacgtgcttggagaggatggaagagacaggggagggcagcaggcctggcttccagccatccaggaggacatggccagtctaggctgcaggcaagacctctttgaggctggtgaggaggccatgtgcctatggatttagctcctgggagggacaggaggccagaggtatggtgactgcagccctctgagacctgattgcccagcatctgtgctgttccaccctctgtctctgctgggccagggctgcatgccctgaggaggacctttgccctacaggagttccctgtgcccctgcgaaaggcccatggcttcttgtcccaggggtggtcggagcaactcttgcagcattgctaataaatcaaaaattagttcaaggtgagagcaggagacaaacaggacaggacaccaaccaacaatctcatccaagctcaggctctgccaactgcaggacgccagcagcctgcatccctgacaggtccctggcaagagagagaaggatggttggacgctgaacagtccagctgacactcgcagccccagattccaccctggtgggggcaccggccatcatggtgtctcctagattttgtggtcccaaagagagatggcccccagcatcccgatctcttgcacaactccttatggatcagccatccgggaactaatgtcacccattttagaaaaagctctttatatttttcagcccatgtcgccttgcaataatgagtctcatacgttgactgcccgctgtgtagtttgattgtgctaaaattacctccctgagctccagagtgggggaacccgtattcttagctttcatggatctagagttagaagcaactttcacctcttctcccctttctgaagactcgaatcacatttcctctccactgttatctttctggaccggaaagcccttatcttcattttcctggagctgcctgcccctcctcagttggtgctccctcacccctgcactccctagttcagacccagctctgcagcaaggacgcctcggccattctgtctccagttcccaggtcctgccctcctctccaggctgggccctttctggtccctgcaacaactgtggaccagtggcttctgtggatcctgggaggtcctctctcggggggcctggcagtggcagctcgagctgccagcctccgttgccaatttgctttactcatcctgagcctctcgccctgcacgtcactgccctgggatacatctgtagctcccataccctctgacactggctctttttcgttactcattaaaatttagtgtcatctgcaaacgtggagattttatcggacatgtcttcccccgggtcatttataatgattttaaataaggccagcccgggcccccacgcatacgtgctgttgggcagccaggtcttgctgcgcaatgaaaagtcctcccctcccgggcagcgcccctccaggatggcttgacccccctctcagcctttgggtgggactgtttcagaggcctctggaaagtgcaggcagacgggaccctctgtcccctcttgaggtacatgcatctttatctgctcagcgagagtggagaactcccttcatccagcattctctgggtgtctaggatgtgcccaggattgtgtcaggcatgatctcccaccataaatgtgtttttcctacactacctttgggctaaaggaggcagggcaagccagcccctgagccggcatggttcccggaaccccgcaccaggtggaaattgtttaactatattcccatgactggaaaattctggtaattgtgtaacagcagcagcactcagcaattacccagggtttttcatcttcagaccactttacccacattaactaattaagtctcccagcctccctccaaagcagggaagggctgccggcctgactcctgctggcgcacaggcttgcgtaatgagggcagccatgggaaggtgctgcagggcccccaagggcagcctacctctgccctcgcctgtaggccctctgaagcccttgccagccatcgctcagaatcctccagccctgctgagcactgacaaggaagtggggaggtgttctgtgtgcctgccacactcggccgcagtgggagatccctgggcccagcacagattgcaggaccaagcccccagaagagcacagttgactactgaccctgcctattactggggcaccagggcccctctttcagttcctactccctcccttctgtttttgcttatcctttaatagctgccaactttggggacctagatctgtaccccagttaccgggtgctcagctccagggtccctgaaggctgttccccactcccctgcacaccccacagagggtgttctaactactgtgggcccttgatgtggagacagggacatctgcagcctcggtcctgccctgaggagcttacagaccagccaggagccttccagccacatccttggtcctcccagctccccacacctcacatgacccaaccgggctccctggacctacttttgctctggcatagacatgaactgggctgctgccacccggggcactgaggctgagtgcacagccctcccatgaaacatccagtgagccccacagagccctggggcagtggtctggaggtgtgagatcatgacttcaagcagggctggcacccagagactcagccctcaaaggcactctcctttctgtaaacagggatagcaataccacttgcacctgtgggttgtagaacttgaatgtggagcccgagacacagctgacactcagaaagcaaactgtgaaaacagaaatgcccactgggaggtatgtgctgtgggtccaggcatgctcccacccctgagtggccgtggaatgccacagtactatgcattggagccatcagaggcagggaagagagacccaaggagacagcagcctgcaggggccggcagatcctgggagacctgagcagcaggcgcccgcgtgccctggcccttctcagggagcatccttcttgtgcttccgtccatcctccaggcctctctgatcctccccctgcctcctggctaccctcagtgggtgacagtggggatagaacccaagcctgccaaggccttcatgatcagcctcctttctagtggaaccatcgtcccacctcacactgctacccagagcagagaggacaggggcccagctacctggggcagccagaaggtgggtgagaggattttgctcagtcctgcagcctagtgacaccacagccctgtgccacccagtgtcgcccagtgtcgcccagtgccgcccagtgccgccctctatcccgtccctaataaaccctgcccttctccctcccagccttgcacacccgtttcacaggctcctaccctcgttgttcattaagcatccaggtgcagggaaggctgtgcctctgatgatgaggcttatgggacattcggaatatgtataaatggtgctaatatgacaaatgcaaagatcgaaggagcttgtgacgcaggcaatgctgcttcctcgcccgtctccctcctatccggctggcggcaggcaggcccgccccccgcgcccccagcggcaagtggggaggtgtgtggcactattacatgctattatgactttctgggtaatgtatacattttcactatcacacggcctctctccttcatttttcatgagaactggcacgagattaatgactgagccccagaagaaacggaacgccatgccactctgatttattgaccacttagcgttgatgaagctgcaaacaagagtcaaacagatgttgcagctgcatttttctttatcaaaaccaacagctttttgcatttttaaccacttcttgcatcaccaccctgcttactccacagaaaggggtcctggctccaggcctcctcctcctcagcggagatggaggagccgaggccagggcggtgggaccctgctgcctgacacccattggcccaggatccacccctggaagcggccaggaaaaggatgtgagatccccaaggctcttgctgtgggtgacttgagtcccctccgtgggtctctggggaagagctcactgctgcatcctcaaccaactccaagggctgattgcgcacgcccaggcgtgggctcagcatgcgggaggtgcagagctcagctcccctctgcagcctggagcacctcccccacctccgcctcatgcccatttactagccagtgtaagtgaccttacacatgagcgctgctgggggccaggcccgtcctgagccctctgcctgcctcaccccctcctggcaaggttcaggctagcactaaagggcctgcttaacacagagcaggcattctctgcagaatgttcttagcctctcctgtgcttttggaggaaaggccctcagcttgtcccccgtcctctctttgtccctgcagtttgggtgaaaggtgccatctagaaaaggttctcaaagagattgactctacctcaggctcccgggagatgcccttccaccaccttcagcctgagagtcctgtgcctggcagggccctgggagtctggaactggggaggtcagcagctccaaatgcatttccaggaggcacagctgggttaagggacaagctgaacttccctcagagaggaagagctgcagaggggcagagagctcgtggacccccccagatgccacccctcctgggccccttctgggggagtggaccccctcctcttccagcccatgcctgggatggacaccgactccttccccgcaccctagtctctgtctgtccctctagaagacatgcctgggggttctccaggattggtcctgagacactgagtctccggagaggagacagccacccctgcaccagctcccccagccaaggccaggtgccccctagcaggcttgttggcccgtgtgctggagcagcttggcggcaccccgctatgcccccggttttcagtaagtaggatggagcccctgccatgtggctgccccgcagacagagtcccagccatccggagctcacattgtggccaggaaaacaggccaaacccgagtagtaattgagcggaaactgagagattagtgctgcaaagacagcgaggcgggaaccaggcaaggtgggcactgttgtcaacggggttgctgaatgaggtttccacaagaaagtgacctgggaccaatgtggcatggagcgtggcagccagagaccacagcccagggagagaagcggcagatctggggaatggggtggcgggagccaggtgcatgaggcaggcagcggccagcaagaagcacaggtggcccggcctggaaccgtggcaggagtgtgggcctgatctcagtgccaaggagccgtccggaacagcccaaccacgcctgctgctgtttgaagggtgggttggggaagggaggagcagacgtgaggacacccgggaggagggcacactcccacgtgcgcaggagagcaggtggaggatcagacttggtcattgcaggcagggggtatatgggaggattaggcttcctggggtgggagaaatggcagaactgggtgatcgactggccgttgagggagagggagggaaaatgagaggatgactcctgggttccagacctgggcagctgtgggaagcctggaggggccaagggtgctgagcaggaggtcgggaggcgaggtcggccatgggaagtcatggggattttgaggccttcgaggggtgccgtcaacaggcaggtaggcaagagaggagaggtaggctggagagggaaatctgggtgtcctgggaatctggtgggtgtgaggtcaggacactggatgaggccactaaggagggagagagggaaagagggagaaagagagcgagagagagggaggccagagccccaggctggacgctggtggaggaagggcctctgtacacagcaagaggagagctgggacaggctggggctgccggaggaggaagggggctctaagcagcagaagtgcccgctggaggcttaactctgctcaccctctcaggaagcacgtcagggcttttttctgtctgggtttggttttggtggtggttggtggtggtagagcggggcctctgtctctcctgacgacattccagctgttccgaggcctgaccctgctccctgcagcagccccagtgagaaagaggcgcagcttccatgcttatgggtgaggagcctgaggcaccaagagggaggagggatcccctcgtccacggctcttccagaaggctgtggaacttctctgagacttttacttatccttggcttcctctaccaccaccacagtcacagaccatgccacggggctctctctccccagcctttggcactgaccaggcctccaggaaagcaagggctcatctccaaaggtcacgatcactttggggggtgacccctagcatctctcatgaaaactccatagcccagggaggggcttctgcacaagctcttcttccctccctgaacccacagggcctgacagggtggtgaaccccacggaaacatcagggcagcctgggcaagacaaaggcagcttcactccacaactgtccagaatcaaggatccgggccgggcgtggtggctcacgcctgtaatcccagcactttggaaggccgaggcaggcagatcacgagatcgggacaccgagactatcctggctaacacggtgaaaccccgtctctactaaaaaatacaaaacaattagcggggcactgtggcgggcgcctgtactcccagctactccagaggctgaggcaggagaatggcgtgaacccgggaggcggaggttgcagtgagccgagatcgcgccactgcactccagcctgggggacagagcaagactccgtctcaaaaaaaaaaaaaaaaaaatacagggccctggcggggtctgtcccctgccgtgactctcagatccaggcccaacccgggcattcctgcaggccgccctgctgagctggtccacctgagcccatctcgccaccagcaaagcagctcagcaaggactctgacaccgttatgagcactccatgaaactgatacattaggactccaagctaatatatttttctgccaaaaacacccaataaaatgtacaactaatgaataaaattgcaacattgccaagaagcgatgtgtgccccaaatttccaaaatacctccatcagcccatgtctgaaaaccagccccacgccaggaaatcgttactactcaactctgggcattccaggtgcaagagctccaggccctgggatggaaaccgggaagctgcctgctcctgcatctcctgagcctccacttggtctcctggaactgccaggggctgggacactctgctaattgtatcaaaacaagggagaaaggcaaggcccagcatggaggctcccgggaagggaccccccacccccggtgttgggcaggtgccctgagttgaaaggggtagatctggatgctacaatccctacatttgtagttactgaagtgggatccactgaccactggatctgtgagcccttgaactgaagtgttgatatgccttggggtatgttggaggatggggtgggtatccactgcctgcgtcaggctctcaaagagatctcatacccagaaaagatgaagaaccagccttgcattgtatcttaccttcctagcaacaacctgtgtttagaaaggcttcccggccgggtgcagtggctcacgcctgtaatcccagcactttaggaggccaaggtgggtggatcacctgaggtcaggagttcaagaccagcctggccaacgtggtgaaaccccatctctactaaaaattagccgggcatggtggcagatgcctgtaatcccagctgctcgggaggctgaggcaggagaattgcttgaactcaggaggcagaggttgcagtgagccgagatcatgccattgcactccagcctgggcaacaagagtgaaactccatctcaaaaaaaaaaaaaggaaggcttccctgccctttgtggacccagaaaactgaagccagatgtcaggagaacacaggtctagggagggcacaagcaggaggtcagaattcagcctaatttgattctacaaacctgaaataagcaccggtgattgttggactgtcgtagctgcagggcattgtccctgaggttgaggaaataaagttgatgttcagacaattaaaacacaaagccaaatgccaccctactatggtagaggcagagagggaatcagggaaggcttcctggaagaggaggggatcctggcatctgacctcaaagaataggtggaggctggttatgcagatggaggctgaggcctgcaggcagagcttcctgagatagcagcttttggggtgctctcatgcaggaactccacggtttgggttcatggtgagagagggcctttgccccacaagaccctgtctgcctgcccgccaccttggcctcccacgggtcccaggctggcccaggctgtgcccagcacgactgtggggcaggatgcggcagtcctttcctctcccaggcgtctggcatctccgctccctcctgcagggccgggcttctgctccagggccaggatcagaggcagccctgggcggcctgctggcccctgcagtcctttgatctttactcatcttgctcagcagctggcattgctgcctggccgtgcccaggcacaggcaggagccctcagcccagacgcggtccctgggaggccactatgttggtctgtaggaagaacacggggcaaggacacagtgaatcaccccgtctctccgccgttaccccctccatgcaaagggcatagcagatctacccgacccacctcttgggcatactgcaagaatgaagtgaaatggagatgagacagtacttaggccaagcaaaaagagaggccagcagatgtcctggcaggacccgaacctggagtcagagccccagcttccagctcaggctgtgccctgctggcacatagctttgggcaatcacaacttcttagtgctacaggcacctctctatagacagagggcaccctgccctgccctaccctgcccagcccgcctccttggctagcaggggcaccgaataagataatggctggaaagtgctttgaaaagaataaagtgctgcgcttatgtcagggattatcgtgattattaaggagcatgattaccgcaatccagaaaagccgccattaaggagaaggctcctgttcgtgttgattgagtttcctggttaactgagcgttggcaggaaaaaatctgtttaattatgccagtctcctttcttacattggtcatggtgtggtcttgagtctttatttattcatggattgattgattcatatattcatgtatgactctttccctgacaacattcaaaaaagcagttgcagacccagctctctcctgcctggggtcctgcctgtcccaggactcatggttgagtctcagtctatcagctggggaaagcagaggggaaagcagctttcctctatcaggaggaaaagcacaggatgaggcctcccacgtggctttttccattgttccctgcagcgtctgatatcctgccatgtttccttaggagaatgcaagaaaaaaatggttcaggccaggcgcagtggctcacaccggtaatcccagcagtttgggaggccgaggaaggcagatcacctgaggtcgggagttcgagaccagcctgaccaatatggtgaaaccccgtctctactaaaaatacaaaaattagccgggctgtggtggcgtgcacgtgtaatcccagctactcaggaggctgaggcgggagaattgcttgaacctgggaggtggaggttgcagtgagccgatattaggccactgcactccagcctaggtgacacagcaagaccctgtctaaaggaaaaaaaaaaggttcaagaaataccctctgattgagatgggagggtttagctaggcttttctggcttatccagatgcatctagaaagtgacaggattgctttttctttaacaaacttgtcagtattgtcgtggccagataagcagcgctgccttctggggggaccatgagaaagccaccgaaggccccatgctcatcccagggacactgctgccttacacaggcccctgggcatgtcctatctgagctcggggggcagaaagcgacagaggacattcttaataagatgtgatgagaaggcgctgactgttaaatggaactgatttgagacaaactgggcctttttatttttgagacagagtctcgctctgttgcccaggctggagtgcaggggtgcgatctcggctcactgcaagctctgcctcccagattcacgccattctcctgcctcagcctcccaagtcgctgggactacaggcgcccgccaccatgcccggctaatttttttgtatttttagtagagatggggtttcaccgtgttagccaggatggtctcgatcttctgacctcgtgatccgcctgcctcagcctcccaaagtcctgggattacaggcataagccaccacgcccggcccaaactggtccttttaggtcttcagactgagagatctttcccagaatacctgtgggcagctggtgcccagaagtttgggaaactccgccccagaaaccaacaagaaagagtggacgagctggatggggtgacagaagagctcttccagggaggagtttccagagattctgggcaccaactgccccctgggtattgcttagatggaaagtgccagctgggtgcggtggctcacgcctgtcatcgcagcagtttgggaggctgaggtgggcggattgcttgaacccaggagttcaagaccagcctggccaatatagtgagaccccatctctacaaaaaatacaaaaattagccaggcatggtggtgtgtgcctgtagtcccagcctcaggaggctgaagtgggaggatcacttgagctcaggatgcagaggttgcagtgaactgagatcacaccactgcactccaacctggacgatggagtgagactctgtctaaagaaaaaaaaaaaaagtgcttcattgcagggctgtttgtcaggggagaagaccacggctgaaggcagaggggctccagccctcagcaggaggagccttaagccctgggagctccttttccccttggggagaagcgggtgaccatgcctgtgttgggggcatcccgcaagctgtgagggggcaacgcgtgttgggcgtgaaggagggagagggcagtggctgtggtgcgaggtcagggatgttgggctggagggaatttgacctcatgcccgtggttcccagttacacacatatcagcttatgtgtaggtcagagtttctcaaccaggggtgatcttgccccctaggggacactgggcaatgtctgaagacttctccaggggtcacagccggagggggaggggcctaatgacatctagtgggtagaggccagcgagtctgctaatatcccacatgcgccggacagcccccaccacagaaccatctggctgcaaccgtcagcagtgtgaggtcaagagagccgggtgtctggggcctcagtctctgcctgcacctgcggggttgggggcggccctgaccctggtgggctccatgccaccctcatgctgccagtctctgctctccccacagaaccccgacatcgtcctggtgcactacctgaacgtgccggccatcgaggactgcggcaagccttgcggccccatcctctgctccatcaacaccgacaagaaggagtgggcgaaatggacgaaagaagagctcatcgggcagctgaaacccatgtgtgagtggccttggccggcctggcgcccccacgctgggaaccaggctggcatcaaccaggcggggccaggaaggtcctctgtggccttggggatgcgggtccggagccccatcttgctggaatgacagtggcaccgtgagcttagcttttgccccaccttcacttggccccttgtaagctccctatacaacagccagggcacaaaatgccaggcccacgtgacagatgaaaagagtgaggtttggagacacagagcatgtagaggaagaagcaggccaagagtgggccaggaccgggtctccggggccacagacaggagtggaggccggctggggagggaaagtatggaacaggggaggggtggcgggagcggaccctgcctcctgccttgcccatccacgtgggatctgggcttagccaccacctcctggactcagggcctgcctcggctcccaggctgggtggcaaatagatgatggtaattgagctggatttcattttgtcagcaaagtggtgctttctgaagcatctgtcaggtgcaaatcacagaatgcaaaacaccgagtgaggcagggaagctggggctgctccgtactttgttgccgtggccacagctcccggcagccgctggcggctctcagtggcttctcctgccccctgttcagcggggctcgggaaaaacaaacatgggtctggggctttcctgacccaagaagagcatgggggctgtttagtggtggacacgtagcccacggggttcagggacattgatggccagggctcagggcaaggacctgccatcagcagggcctgagggggtgggtcagtggctcactcagaagcagaactgtccctggagctgggctggagggaggaagcagctgttggtcaccatatacagcggggggactgaaatattctttctgcggctgggaggaaaggtgaaggtcctgtgcctgggagggcccaggctgaggctacgggcacctgcggtgatgctaatcctgagagtcccctgggtgctcggatttagggatctgctcccagcctcaaggttggggatgagggtcaggagggacagaggggtctgtgtggcaagggaggccccccagtgggtgacagccctgcccgccaagggcaggaccacaagactgagcttcctcacgtgtcgtcctttgagccaagtaccccgtggggaggtttggaccaggcttgcctcagtgcttctgcctggaacctcgaggcaggcagcccagggacctcctgagctcagaccacacccagtggcaaccttcttaactgcagccctgaccacatccctctctgcttaaaaccactcaatgcccattcaatgcacgctcaatgcccaagctcctgagcacagcctgcagcccccccacccgcagcccccggcctctgcaggactctgcgccctttccacctgctgtagtccccactccccagagcctgctgcctctccacctgcccctctccctggctctgcctgctcaccccacctttccctcagctctcagcctctccacaggccctcccaccacccagctgggccttcacacccctgtgccctggcctcctcgagcccccacgggggagatgtcagcttcccgcgcttcatcaggaggggcctcgtgagcctcttcaaaatgctgccgagcaccgggaagcatggggaaatggcacagctgcccttgggaagccctccggctctctgcacagtgctgggtgtgcacaaggccctggaaatagccctggaatggtgggggggaagggacctgcccagggtcctgagcagaggacagaagctgcagtgtcctggctctgggagccggggctgctgagtggcactttcccaagggcaggccagaggctaggagtctggggcaccggtgctgcgggccctgctgtcaggcccgcctgcctgccttcgtactcagtacatagggggcacctcactatgcagggctggcaccggacactgggtcctgcctagaccccgccccagggggcctactgatactttctctgccgcagagcctcagctgggccagcgctatgactgctgaccaggaatgctggtgccccctggccagggcggtagaaagagtcagggctggcaagtcaggaggcaggtgctcatcctggcttcatggctgcccctctacacagccccagaccaatgccccaccctctctgcaccccagtaccccttctataaaggggtagcaagaatctagcagcctctgccctaagaccagcacttccagccatctcagggggcccggctcagctcctccacccctgcacaccatgtccaaggggctgaggctgccagcctgtcccatttcttgggaggtggagtcactccagagggctcagcttggtcctgcagaagctgccatggctgagtgcactccaggcctgcaggaagtagcctggaacctcctttctggggcttagtcagtgctttcaaaattagggtcctaagtactcttgccttgaaagggtgaccagggtccaggtgcttctgaagctcctcccacccctcagtgtttacatttagaggggagttcctgctcaaaacaagtcttcagtcaggaggaggagttgccttcctggcctttctgagccttctgtctgcttcttcttaggtcactagaaggaattcctcttgtcagattccactggaaaatgagggcccctttgctggacagaggccccatccatatggccggggagcagccccaatcccctgggccccagcaaaagttccaagagattgtgtgagccagagattagccaaggaggttctcccaagggaaaagatgcctttcaaggtggctcctacagtcagaggctgctagcctgggccttcccaaattcttctcgacacacacagacagcccttctccttcagccatatgctccccatttttcctggagctgcccatccatcagacaggaatgccacctccaggctgggtgggaggaattaggctttatgaactccagggggtggaaaccagtccggagccagcctccaatgctgaactggagggaactgtgaatgcctgctcaaaaatctgcagtgcatcagaaaattatgtaaaactacaacaaactccccataaatctaataacactcagctctctggtgtcttgggctgggggaagcagagccgcacacaattccttggctcgggcgtgcgtgtgcacggctctgacagaaacacagcccgagaaacagccctggaaatgcggctgcaggagaaggcgcagatgacgatcaggcttggaacacacagagggcaccagctaagtgtgtgtgtccggggacagcagaggtgtgctgagagccaagaagacctcagatttgattccagaatcaggcgggtcacccaacactggagccaaacacattagcttcatcccattttcacataaatcgcgtgccttcgaagacttcacagtttgatttcctgatgtttccaaatttccctgcccgccagcggagttgtcagcggtttaatcacaatgtcgtgctccccagggctgaagggagatgggtctgcagccttcacctcacctgctgtgagatgggggctccgtgaccttatgccctgggaatctcaccaggctgattcagagaatcccatcctggtccttgcagctgtgccctttggtcagaagggggcttcccttccacctgcaatctgaggaatgcttccttcagatgaaaaaaaacacacacagaaataaatgaagatagctgataggaattcccaggacattcccagagatctttcctgtcttttggaatcccttctgtaatcatgagactatgggtcctgctgctatgaggaagaccaaaataacagtggcttcaatgaaagggaagctcctttggctttcatgtcacagttcagggttgatgtggcagccccagggtcagggatcggccaccctggctccctccgggtggctgctccccattcctagggctttgccttcttttacatggtccaaaatggctactccagctcctgccattgcaactgcattccaaccagtggaaagaggagaaaataaggtggagggtgagttccttccctttaagcccacaacttgcatacatcatttcatctctggtgtcgttggacagaattttgtcatatggttactcctagttgcaagagagtctgggaagtgtcgttttttgctttgtagttccatcctaacgtactttggggaaagaggttctgcatgtgaatcattcagggctgagtagagctgtgcttagcctggggtgcccctgtgggcttcagctttctggcttatagtgcacagaattgcccatctcagtccaaggcctggcaatgactgtctgaggcgccgtctgaggcctggagtttacagtacgcaagtgatctaaagcttagtatgtctcatcctggaaattccagggtctgttccaatgcagctggtctgagagagcaccagatttgcacccagtaaacccccatagtgtgagtgaggagctgaagggggagtcctctcctcccagattagccactgagagatgactttgagtggagtcgactgctctgccaggcaggctctgtgcttctgtcctgccaagctggcaggaaacttgctcagtgatcttgggctgctcagagccacagtggttctaaactgccatgccccaaaccttgcacccttggctccactggaacctacagaaagccagatggaaccgtttcctcggagaagatcctctccctctgagcacccgtggctttcttccctgcccatttcctggcagcccaggaggggatggcacgccaggcatttcccagcaagctgttggtgaggttgttccatccggagtgagtggcgagggcatgacttctaagctgtgttcacagcccttcccgtgtggtgatcttgtcccagctctcccacctggaggctcctcttggagtgccctggctggccagatggccctgcagccatgagcaagtcctaggccttcctgcaggcttcgaaggcccggaaatcagcaggcagctcccccagccgcctcggggtttagctccaccctgcctgccagccccagagctccgctggcatcaggccagagtactcaggcctctggggcaggtgtcctctgcagcactgggcgggcggcaggagggctggctgtggaatcagcagagccccagggcctacgcccacaccacacaagtgctctgtgcacctccatgcttctgcacgggcacacgacgtatccacaggcacgagtgtgtggggattcagcacctccacccccacacttcctccaaaagcaacctcacctccatggcaggtggtggaggccatagtaaatgtgaggccacaaaggccatgttgaaagtggaggtggaggccatcctgaatgtggggtggaggccatagtgagtgcaggtgaaggccctggtgagtttggtgggggccctggtgaattgggtggaggccatggtgagttgggtggaggccctggtaagtgtgagcggaggccccgttgaggtggatggaggccctggtgactgcaggtggaggccatggtgactgtgagggtggaggccatggtgattgtgaaggtggaggctatggtgagttgggtggaggccctgccctggtgagttggatggaggccatagtgagtgtggttggaggccacggtgagttgggtggaggccctggtgagttgggtggaggccacggtgagttgggtggaggccctggtaagttggatggaggccatagtgagtgtggttggaggccctggtgagttgggtggaggccctggtgagtgtgactggaggccctgttgaggcggatggaggccctggtgactgagggtggaggccatggtgactgtgagggtgagggccctggtgagtggttggaggccatggtaactgtgaaggtggaggctgtggtgagttgggtggaggccctggtgagttgggtggaggctctggtgggttgggaggaggtcctggtgagtgtgagcagaggccctggtgaggtagaggccctggtgactgagggtggaggccatggtgactgtgagggtgaaagtcatggtgagttgggtagaggccatggtgactgtgagggtggaggccatggtgagtggggtggaggccacagtgagttggaatggaggccctagtgagtgtgaatggaggccctgttgagttgggtggaggccctggcaagtgtgggcttgcttgtgctgtcatggcccccacagtccatctcccctaacacactggtcctcacctgcagcctgttggttttccaggggccagggtgtcagtcctgccagccttcagcatctgtaaggcagtgctgccgagacaccacaccgtttccagtaccgggcctcggatggggtggctgcaaacgggcccctcattgctgagcagtggctgcagtggcagagaaatctgctcagagcggctgcttagccagcacctgctctccagggacccagctcaggctgggagaggtcgcagagcccaggatccccagacccccagcctccctccctctgttccggaggccctcgctgttgccagtacccaagcctggggttgtatgttcagtgcgccttttgttttctcataatttttcagacaaagaccaaagatccagaaggggggggggctgtgtttatttgttttgttttttgcttagattgtaatcctggtgattatagaatatcaagaaggaaaatcaacaaagccttccttcctggggctcgcggagccgttcctggtcgaccagcgccacctggtggccagtggcagcggccccgctcggagatgggagccccagggaagcctgactccccggtccaggccacctggagcttgcaggcgggggcctgtcccacccgcgcctctggacctggtgtctgagatgtgctaggaggctgtttggggacctgctctgtaattctggagtggtggggcttggggtggggctggaactagcagcaggagaccctagggagaggtgcctgtgcccaccttttttcctctccagctcagtcgatcctgatccagtatcacctggctggctggggacggcgggctgggagctccgagcctgactaggaacaggtatccctaaggctcagccagagcccatcgaggaaggacagcagccagcctaaaagtccggacgtagtggcttacgcctgtaatcccagcactctgggtggccgaggcaggagggttacttgagcccaggagttcaagatcagcctgggcaacatggcgagaccctgtctctacaaaaaatagaaaaattagccagatgtggtggtgcacaccagtagccccagctacttgggaggctgaggtggaaggatcacttgaacctagggagttcagggctgcagtgagctgagatggcgccactgcactccagcctgggtgacagagcaagaccttgtctaaagaaaagaagagagagaagagaagagggctggacatggtggctgacacctttaatcccagcacttcgggaggctgaggcaggtagatcacctgaggtcaggagtttgagaccagcctgaccatgtggtgaaacctgtttctactaaaaatacaaaaattatctgggcatggtggcaggtgcctgtaatcacaactacttggtaggctgaggcaggagaatcacttgaacccagtaggtggaggttgcagtgagccaagatcgtgccattgtgctccagcctgggcaacagagtgagactccacctcaaaaaaaaaaaaaagagagagagaagggaagagagctgcaaaaacttttcccccatggagctacaggtgtgggcacagtaaggagtggggggatcagccccgggtgggagagagagggggtgttgttagagggactctttctggccagcagtgttcacttagaggcgtgttccagggtcactacctctgagcagagacttctgggataggagcaaatggctgaatgtcaggagtgagctcgggccccccaggccacccagttctggggctcagagggagccgagccggctgcagtcttaccctggaatccaccaaggtcccagaaagcctgagcagagacaatggttccccctcagaaccacctgggaggggctgaaaggcaggcccttccccagacattctgactccctgggtctggagtgggctccagacactgagttttttatgaagctaggttcttgtgctggggtccccaggaccatactttttaaggaaccccggcctatagcagcctctggcgagaggccagccaagagcaggaccagcacctctttgggccacaggcctcctttctcacatccaggtgcgaggagggcaggcgttggaggccacacggagcttagtgtagccacactcccagaggaagccagtccccagcatgcactaagtactgggtgtaccatttctggatgttccaggactgtgtgaggactttccgtagactctgggttaagaaatacgactctagaagtttccttgttttgcagctgaggtgttggtgccggcacatggtggagccttgccagacacttgttgacttgcacttgtgagaaaccctggagttgcataagaggaagcacatctgtgtccccacggcagcccagacagcagctcggtccctgagagcagaggcccggctccctgcctgcatctgcggggcctgggagtcatgggggaggcagcgatagcgctgggggttcctggagaggatttcctctgccttttacccttccctttgggaaggagctgctgccatgaggagcaggcagggcaggttcctggaatctccaggtgggtcccagccctcttcctggctcctgccagaatgcctgcagcccccttccaacctggcatggaggacagcagagggtgggcacggagaggctgacttgagtgtggggcttccttcctactttgctccaggatccaggtttgttttgcaaatgttggtttctcactccagctagttttatggagccgatccggcccccaaggaggactggaagagaaatactgcttttgatttcctgtctctcctggcgtcttgctgcccagggccgcttcaaggccgcatagctgcttccgtgacaggagatcccccttttgtggagtgcgcccctgtgctggtgttggggatacaggaccccaccgacgtcctgggccctgactgctatgcagagctgatgctgagccctgctaggtgccagggagtggttctgtcaaagttagaattcattgccaacattcaaatctccagattttcagcctctctttaaaaatggaaggctccaggccaggtagttgggagctcagaggcggctgctctgtggaccgagcctggcttcctgcggcgctacctccccacacaccaggaggcacctgagtccaggaggccctagagcagtcttaccaggagcaagatggaagcatccagaatcccacttggtcccccacccctctttccaagtggcctggaggggcagataaccctgaggctctgacgctgccaggcggccggcactcctagcgcactcacacttcacccacggtgcaaagaattcccagcctggtaacaatgccgcttcgcacatcaggagaagattccgagagcctcaggatggctctaaagtgccactttgtatgtcactgagcaccttggagatttcctgtgaggccagttacaggggtaaaggacatgccaccccacacgctctgtatttcctgatgatggagtcactggccgggctggaatggcgcctctccctacccctcattgacaatgtctgtcccacttgcaagaagaaagaatacgggaaggtcaagctctcaacaccctggcagtctgctggaccctccacccccgccttttccagaggacgtgtgatgttgggacgaagcccatgccccctggcagagggaggactgtgatgccccaacagcgagcaccagaaatgacaggctcactggggacacggcagataggtccccgcatgtgcacacggtgggcgcacactccatcccgtcccccctcagcctctgcgctcctcgaaatgagatttctgaaaattttgtcctcaggaccaataggcgaatgagagttgagtggtgagatcgggaaattgaatagtatgtgggtgtctggatatgagaagttaaatctaatgaaaatttcatccagttgaaccaagaaatcagaaacagggcctttattcctgtcaacaagaatacagtgaaaattaaaccaacccggctgccatttcccattgaccttgtcgccatggagacagccttctagtgtcaacaacaccgaggactccgaaggggcctcattcactccaggagaggcacgtggccgctccctctcccgtccgcctccggcacgtggttcataaggagagcagccacacgtccagggttgctggagagcaacccagcctataccagcacctggacaaatgaccacagcaccctttgttggctcccaaggtgacctggcttgactagttaaatggccaccctctttctgggtctttcttgggtggcagggtacctaggtgggtggactggacgagcccagatggaggaggaggacagggccccccacagccctccagaaaaggacactgcccctcgtccttgccacctgctcatcacagcacccagaaatctcttctcatgcaaaggaaggccaagcgtcgattccagcaggtgccgcctgtacagttaccatggtgaccaaagctccaggtggccttgccctgtcatccttccaagagttactgccccacagagcagaggggacaggtagctggttctcacccgttccaggagccaccaggggctgaggcagacttctggagttctctctgtctcctcgtccaattcctttccaaagtcttccaggcaggactgcggagcagagagcttcccctcttgtgaggctttccaccctggcctgggcagatctcctgtggatgccatcacatcagaatccaggggtggggccacctacctggatagggcccagtggcatacagtcaggtgaactggcaagaggcaaccactttccagatgaagaaactaagatccagaggaaacaaagatcttgttctaagatcacacagtgcatgagggaaacagctgcggccacatgggggccccgaccccaggccagcacggtgctgccacccggtctcccactgtttctaaattctcgcctcttcttcccacatagccagcacagggcatcgcacttggaggttttccctgccctttgggaaagccccaccactgcatgggacagccatgtcaggaatgaaagacagccaagacgaagctgcccctcagccccctgccatccctcagggggtcccctcccacccccaccataccccaaatgaggaggccctgtcgtggagccaagcattgcccccacacatcctgtaccgtctggaatgaacccttcttagcttctttgggtttttatagaaattccccccaaatgcacctctaaccaggcacaaagcctgctgccgtgacaagaccagcacatgcctcagggaagccccagctcccaggcttggatgcagcgttgctgagatgtcctccttgcagcagcctcccaggttttcttcccccttcctctcctgcttgctctgattttccaagagcaagtccccatcaggccctgcctcccagttcctcccgtgggaggctcaaggacgagtttcttctgccctggtctgggtggcttggccagatgagtgacagctgacctgaccccgaagtgaggaaatcccaagtggggagccagggactcgggagcttctgcccactaaggccccagccagcaaggcctggcccctctgagacagcccagcatctgcgaagtcagggagggcaggagacgaagctgggcatcagcttgggatgacagcatgtggtccagcaccaggaccctgagtttcctgcacagtcaccagcccctggtgaaggggccgagggaaaccagacttccctccaggaagtgaagtgagtcttgctgctcacggccagcaccctctacctccagatggggtcgcttttctcctctgcccaccaccgagctgctgtccagtcttcctcacctcctcctaggagctggtcctggcagagctgaaagccaggcaggtcgcccagtggaaagagcttgaatctgcagcccctcctcaccccctacgcacctgctgtgtgaccttgggcaagttacataacttctctgagtctcggttttggcattaataaaatgggataatatattctgcctcaagggatcactgggaggttaaagatgtcatctctagacctgagcttctcaaacttgagtgtgcctcgaaggcctattaggacgtggatgctgggccccaaaccccagcgtttctaattctgcaggttggggcggggcctgagaatgtgcgtttctaacaagtgtcaggtgattctagtgctgcgggggccacactttgagaaccactgctccacaggagagtgtctggccccgtgccctgcccacagcagaggctcagtggagtacatagtattgttattatttttttccccttctttttttgagacagggcctcactctgtcacccaggctggagtgcagtggcccgatcacagctcactgtagcctcgacctccctgggctcaggtgatcctcctgcctccgcctcccatgtagctgggattacaggtgcccaccaccacaccagactaatgtttttattttttgtagagactgggtctcgccattttgccaaggctggtctcaaactcctgggctcaagtgatccaccctccccagcctcccaaagtgctggcatgagccaccacacctggccttgttctttttttctttttggagtcaacatatgaagatgctcacatactgcctggcatggaggatatgtccaataactatcattgtttttgttgttattactgagacatgagctctgcttatagctcactgagggaaatgatgaaccaattaaaaaaaaaagtgctagggagggcatgattgagaaattggccattcactcattcactctaccagcctttattaagcatctactatgtgccaggcattgttctgaggatgggagatgagcagtgaacagcttggcaaggcctgccctcaggatccaaactccagctcctagggacaggcatgagcagccaggaaggctattgtgatttctatacccatagttctcaaactggagcatgcatttgaattcccacgagggccccttaggacacaggtgctgggccccatcctgagtctgtgattcggtgggtttggggagggcctgagaatgagccagaggcgggggcttgagctgggctgtgctggaaagaagggtggcatttaaagtggtagaagggctaggcgtggtggctcacacctgtaatccctgcacttcaggaggccgaggtgggtgtatcacttgaggtcaggagttcaagaccagcctgaccaccatgctgaaaccctgtctctactaaaaatacaaaacttagccaggcgtggtggcgcacacctgtagtccagctactcaggaggctgaggcatgagaattgcttgaacccaagggtcggaggttgcagtgagctcagattgcaccactgcactccagcctgggtgacagagtgagaccctgtctcaaaaaataaataaataaatatattaaaaataaagtggtagaggagagaggcattctggaaagcccctgatgtcagaaccccttgaactgtacacacacacacccctatacatacacacacctatacacacatacactcctatacacacaaacacacccatctatacacacaccggcacacacctatacacacacacctatacatacacacagctatacacacacactcctatacacacaaacacacccatctatacacacacaagcacacacctatacacacacacctatacacacactccatgcacacaaacacccctatacacacaaacacacccacctatacacacacccacacacctatacacacacatatacaaacacacccacctaaacacacacctatacccacacacctatacacacacccacacacaccacacacacccctatacacacgaacacacccacctgtacacatacccacctatacacacacatctatacacacaaatacatctatacacccacaaacacacccatctatacacacacaagcacacacctatacacacacaaacacacccacctatacacacacacctatacacacacccacacacacctatacacacacccctatatacacaaacacacccacctatacacacacctatacaaacacacccacctatacacacacacccacctatacacacacacctatacacacacctatacacacacctctatacacacaaacccacctatacacacacctatacacacccacacacacctatacacaaacacacacccctatacacacaaacacacccatctatacacacacacacctatacacacacacctatacacacagacccacctatacacaccgttatacacacacacacctatacacacacaccgttatacacacctatacacacaaacccacctatacacacacccttaaacaaacacacccacctatacacacacacgtatgcacacaaatacacccacctatacacacacacctatccacatacacaacctatacacacatacctatacacaaacacacccacctatacaaacacacacctatacaacacacatacacacacctatgtacacacccacacacatacacactgatatgcacacctatacacacaaacacacccacctacacacacaaacacccctatacacacacctatacacacccacacacctatacacacacctatacacacactacacacccacacacctatgcacacacactgatacacacctatacacacacacctatacacacatctatatacacatacaccgatacacccacacctatacacacacctatatgtacaaacacctatacacgcgcacctgtacacacacacgtgtgcagtgcatagagcagggttggtgtggacctttagccacagagcctgaggatgggggaggcctgagcccccatgcggggtgtgttatttagcctgctgtggtttgaatgttttcctccgaaactcatgttgaaattgaattcccagtgcaactgtgtctggaggtggggccccatgggagggattaaactgctttacttagggtttctgggaatggattctttttcttcgcccttccaccatgcaatgacctagcaagaaggccctcaccaggcactggcagcttgatattggacttcccagcctccaaaactataagccaatacacttgtgttctttatgaatttcccagtctgtggtattctgttgtagcagcacaaaaaagacgaagactaaaacactgccctcacagtgtgccacagactggcggcttaaacaacagaaattgatcgtctcacagtctgcaggctggaagtccaagattaaggggacattggggttggtttctggtagggcctctcttcctgggttgcagacagccaccttctcactgcttcctcatataaccatctatctaggcataggcactcctggtgtctcctcctctacttataaggacaccagtcctgctgggatagggtcccacccatgtgacctcacttaaccgtaattacctccttaaaagtctgtttccaaatacagtcacattggtggttagggcttcaacctatggatttggtgggggacacaattcagttcatgacagaggaaaataggacggccctaccgtggctcaggcttagcctgtgtagctgaagctctccgccgcttcccaagggcatgggatggagcagctgcaacccaagaggctctcggctggcagcctgccccatgtggggtgaagcccccacgccttcccccagccctctcttctagatctcaattactcttttcccagcggttggccgcctcttgggtaaattgttcatcagaagatgctctccaaagcatgggccacacgctgttgtcattgatttcattttgattattcatattagtggaagcgctgctgccttgccaggggccataattagggtaaacatcttgtacgagggctaggtcagcattggagtgggccctgggttcctgcgacggccactcccagcctcggctctgcaagccgatcctcacacaggccgcgctgcaggcagccctgtccgcgagaatgcagtccccggcctgtgtttcacggggcagccgcagggcttctcgggtagctgtaggaggacacctttcgaggagccagcatcctgcttcccagtggccagtgtgaccatcctgcctgcccctgtcttgtggagccccatgctggggtctggcttatcccaccccatgccagccctttcttctctctggtacttcccctgacccagccttcctagggatacaggtctctctccaccacctgagcagaccagggaccaccaccaaggctccaactatggggagctgcagagagggtccctctgtctgggattcagctcaggccattctgcctgagaacggggagtcaggtaccgcccggtgaggtacagtgagcaggaggggacagatgtgacccagagccaccaggacattacctttctgggaattcctctttctgtgcctcctcccttacaagacatgtcatgaccttacatgtcatgggaggtcacgtgatcaagtgtacttttaacgcggtttcccttttgctgctttaaaaaggggaaggggccgagggggcggccggcatgcgtggctattaaccttcctttcataaagcgctttttccctatagaaatctcccttcccactgattcattccgtgttgggaagcagagcatgacatgttaaaagccgtcttgatactatttgatattcagtgctaacaactcaccacctcagaggaggggcttttctccacccacccacccccaacaccagagcaaggagggagacaatctgcatattggatgtgccaagacagtaggtaatttgcattaagcatctagaaactctctgcttgcaatctgtcacccttcactgggtcttcattttataaccttcacaacataaggaggagaacaagaggcagagagaatgcggctgccgcacccccatcaggactggaggagaaacctggcctgatcggcggttgtcagagcagaggggaccctgatctgaaatgccaggagactctgccagccaggggattcaaaagcctcactgtgccaagacccaagaccctcaagtggggtgtagcctgaaggccgaagccagaggtggggctgccctgaaaacagctcatctccacagacagccaagttcaaattcagcagggatcttcccagagaacatgtggcctggcttggcaaggggcacctgctccgagttcccacagggagaggctcccgtgatgagctctgcagggctttctgctcttggacttgcagttccctgctgagtttaagcttaggacagagctgcgtgttctcccatcctaacagcatgtgagacagagctgcgtgttctcccatcctaacggcacgtgaggagcctctgcagagctctaaaaaaaatacctggcaccaccccagaccaatgacatcagaatctcctatctagggcctgggtacagccagagtaggggacccacagctggaacagaccactgcctgtgcagcggtacagaggagagtctcaaatcctgccctgtggcctctggaatgtgatttgggctgtcacctcccctcctgagcctctgttttcttatctgtaaaatgagtctggaaatgtctgtaagccaaggagtgccctgggcatagggacaggccagagagcctgtgacccctcatcttgcctccaccaggtcctttctgcagtaatctgtcttctgtattgaatttcttggtagaggtttatttaagaaaagggtcccatagctatgatgaggtttaaaaagcccctgacccgggccttccctccagctgtcagggacaaggtgcttagggggatgctggagaattcctccagggagcccaagatgaaagcactgtccacctgaagaaaagtgggctgtcaatgctgccacctgcctgcctgcgcctatcacatgttcgccgatcacaagttctgaacatggcggcttggcaaacaggtgccactcagccccacccatcccccttagtgacccaccagaatcccaggccccctgagaataagtgaagatgcaggaggcagagggtgctgcagacctcagaggagcctcttcagagtgaagcagaggggaaggaaagggagcggacacccgggtcaggcgacagcacacacagagaaggaaagcagcaccctgaaggtattcctgccagatcccaagcctcacacatgggtgatttcctttgaaaaactatcagaggctgggcgtggtggctcacgcctgtaatcccagcactttgggaggccaaaggggggtggatcacaaggtcaggagttcaagaccagcctggccaatatggtgaaaccccatctctactaaaaatacaaaaattagccaggcccggtggcaggcgcctgtaatcccagctattcaggaggctgaggcagaagaatcgcttgaactcaggaggcagaggttgcagtgaaccgagatcgtgccactgcactccagcctgggcaacagagcgagactctgtctcaaaaaaaagaagaagaaaagaaaaaccatcagagttataattaaagggagagctctacacccaggaacagaggcttgagatgaatggccaccacagagatctacccgcagtgttccggggctgagccatctgtggatttcacagcaagaagcttcctgccacaagcccagtccccatagcatcggccaggccccaggcagggccagcactgcctgctgggtgtcacagtcattactgtcatcaccatcatcactagtgatgttatgacaacagctaccctttttttgggtatgcacaaagtgccaggcacgtagatcgtgttttctcctggccagttctccaggcaggaactactatatgcccactttacaagtgaggaaactgaggctcagagaggctaagtgacttgcccaaatccacacagcaagatcaaaacctagactcagaccaggtacacacctataatatcagcactttgggaggccatgagttccaaaccagcctgggtaacatagtgagatccttgtctctacaaataattttgttttgttttgttttgagacagagttttgctctcattccccaggctggagtgcaatggtgcaatctcggctcactgcaacctctgcctcccagacgattcttttgcctcagccccccaggtagctgggattacaggcatgtgccaccacgcccagctaattttgtatttttggtagagacgggtttcaccatgttggtcaggctggtctcaaactcctgacctcaggtgatccgcccactttggccttccaaagtattaggattataggtgtgagccactgcgcctggcctctacaaataatttttttttaaatatccaagtgtagtgacacatgcctatagtcccagctactcaggaggctgaggcgggaggatcacttgaacccacgaggccgagtctacagtgagtcgtgtttataccacagcactccagcctgagcaacagagtgacacctgtttcaaaaaaaataaataagtaaaacttggactcaaatccatgtctgaaccgagccagctcctacctgccatgtcgacgctctccttgtccccctaccttctagagcccttcacagaactggggccagtgctgcgagggttagcggctgtccccctggagctggtgggagaggagcttcagccaaaggaggaaggacattgctcttgtatcgataaagccactgacctctccgtatctcgaccctgtgcccggctcctccgcgcctggatccccagcaccagctccagccccaaagctgcgaatccactgcctctgagcctggccccactagagacagctggattgctccatgtgccggactcaggacttagcgaccccttggccgggtctgctccagctgagaaaactgctctgctggaaaagtcggtttagacttccagcccccatcctgccaggcaggtggggaaaccccaatcccaactccaggaactgcaaaagtgcagggaggaaggttgagcccagctcccggggtggctgttcagatggctgccatcagtcagcactgggcactgagctacctgatgtccaggccacgtgggcccttcagtcccgtccccatctcccctggcctctcctgcatctgcactccctttggggcaaagaagtctggtgagggcaggaagccagagtcttaccccccagggtggggccacctccccacacactcctgggagaggcattggtcctcccggctcggtgcttgttggtccaccacctctatcctgagtctccacaagaagctcacaggctgggaagtccctcagcctcctgtccactctccttctgtccttgttccctttctcttccattccagcacccctggaagagccgcctcgtgcactctgactttagggaaacaaaagcagaactctatgcggtccactccctgggctgcaccatagtgagggggagctaaagagctcagaacccccgatgggagcagggggtctggcgggggcagcctggcctcccttcccctcctcctcccctactcatcaattcgccccaggagccagctccccagcagtgagagggctgccctcagggagggcctgggtcctaccccttggccccacccaggtcccctctgcacccacgggctctgacagcccccctgcctctctcttcacagtccatggcatcaagtggacctgcagcaatgggaacagcagctcaggcttctcggtggaacagctggtgcagcagatcctcgacagccaccagaccaagccccagccgcggacccacaactgcctctgcaccggcagcctgggtgagccggggctcccggggcaggcgggcgccacggggacagaggggccctaccaggcagccgtcatggctgtcctctgtgggagtagccatgacatctagtgagggaggagggggacagtcagggactgggcgacaccaccgcacccagcacagacacaaggcaggccttccgcctcgtcctgccctgcaactggctggcagtccgctctgggcaggagggagcagtgtccagagggacagcttcctccgtggggcaagaactgggggcagcagagttggggaagcgaggagctctggggctcggggcctctctgttcaggcccacactcttgggcatcctctgccagagggcactggggtcttgagggagacgtgccctgcgtcagtgacaccacgcaggcgcaacctctttctttaacctctgtctcctccaagaacatgaagcgtcccgcgctctccttcctaatgtgtctgtttttctgataatggtatttgctctttgaaatgtgtgttctccactccccaggctgacttaattagatagtcccattagagggtcgtgtcacttctctacgcagtcttggtgcattgaggagtcttggtggtgaggccataacaggatcagggagaatttgccctttcatcaaaagtaaagtgacccttatcagatgaaatgaaaatggtgaaaatatccaatgggagggagagaaaagccgtcctggctgccggggctggaggagctgccagggaggctttgccaagctcagaaacgttcggctcctgaggcttgtacgtctgaaatgaggagcaagggctctgtccctacttaggacctagaaggatttttgtaccccagagagctgagggtaggcctgggcttaggtacctttccgcctctggagcagggtcgagaaccctctttggtcctggggcctgagagctggtcccgagactgcatttccatcacctccccattgacctctggttgccaggccccaggggtggctcctcactggggcatggcctgagcagctgtgggaagttggggaggggaggtggggcaggatacgaacgtagccactctcaccaggctgatcccctcttgccagcaaaagcccttccagatgagtggtatctgtctctgatggcggaggggactttcctgggtgttgacattctctccaccttctccttcccaacttcccatatgcttcctatttgaaaagagcatcaaggccaaagcccctctgatctttggaggagggtcaaaggggcgtgggacggcccccgggcttggggtacgtgtccaagggctgagagtctgtggcctgcctggggtaccgggcctggactttgccagggaccccagccgctgtggggcaggtccaccacggtcctagctctgactctcttttgtgtgtgcatgtgtgtgtgcacatgtgtgcctgcgtgtgcgtgcgcgtgttgtgttccgatctccgcaggagctggcggcagcgtgcatcacaagtgtaacagcgccaaacaccgcatcatctcgcccaaggtggagccacggacaggggggtacgggagccactcggaggtgcagcacaatgacgtgtcggagggcaagcacgagcacagccacagcaagggctccagccgtgagaagaggaacggcaaggtggccaagcccgtgctcctgcaccagagcagcaccgaggtctcctccaccaaccaggtggaagtccccgacaccacccagagctcccctgtgtccatcagcagcgggctcaacagcgacccggacatggtggacagcccggtggtcacaggtgtgtccggtatggcggtggcctctgtgatggggagcttgtcccagagcgccacggtgttcatgtcagaggtcaccaatgaggccgtgtacaccatgtcccccaccgctggccccaaccaccacctcctctcacctgacgcctctcagggcctcgtcctggccgtgagctctgatggccacaagttcgcctttcccaccacgggcagctcggagagcctgtccatgctgcccaccaacgtgtccgaagagctggtcctctccaccaccctcgacggtggccggaagattccagaaaccaccatgaactttgaccccgactgtttccttaataacccaaagcagggccagacgtacgggggtggaggcctgaaagccgagatggtcagctccaacatccggcactcgccacccggggagcggagcttcagctttaccaccgtcctcaccaaggagatcaagaccgaggacacctccttcgagcagcagatggccaaagaagcgtactcctcctccgcggcggctgtggcagccagctccctcaccctgaccgccggctccagcctcctgccgtcgggcggcggcctgagtcccagcaccaccctggagcagatggacttcagcgccatcgactccaacaaggactacacgtccagcttcagccagacgggccacagcccccacatccaccagaccccctccccgagcttcttcctgcaggacgccagcaaacccctccccgtcgagcagaacacccacagcagcctgagtgactctgggggcaccttcgtgatgcccacggtgaaaacggaggcctcgtcccaaaccagctcctgcagcggtcacgtggagacgcggatcgagtccacttcctccctccacctcatgcagttccaggccaacttccaggccatgacggcagaaggggaggtcaccatggagacctcgcaggcggcggaagggagcgaggtcctgctcaagtctggggagctgcaggcttgcagctctgagcactacctgcagccggagaccaacggggtaatccgaagcgccggcggcgtccccatcctcccgggcaacgtggtgcagggactctaccccgtggcccagcccagcctcggcaacgcctccaacatggagctcagcctggaccactttgacatctccttcagcaaccagttctccgacctgatcaacgacttcatctccgtggaggggggcagcagcaccatctatgggcaccagctggtgtcgggggacagcacggcgctctcacagtcagaggacggggcgcgggcccccttcacccaggcagagatgtgcctcccctgctgtagcccccagcagggtagcctgcagctgagcagctcggagggcggggccagcaccatggcctacatgcacgtcgccgaggtggtctcggccgcctcggcccagggcaccctaggcatgctgcagcagagcggacgggtgttcatggtgaccgactactccccagagtggtcttacccagaggtaagctgccgccgctgccaccacctgtcacctcccctcccacccacctcgccagcccctgcgccaccctgcagctaagggatgcctgtggctgcccttcagaggaagctctggaccacaaagatgatgctttcccctccttgtgtccccacggcgcttgaacacctccgtctttcacgcagtggttctcaaacttcactggggcaagtagctttaaagtcagggggtctttggccgggtgccatggctcaaacctgtaatcccagaactttgggaggccgaggcaggaggatcatctgagccaaggagttccaaaccaacctgggcaacgtagtgagaactggtttcaacaaaatattaaaaaaataagccaggtgtggtggggcctgcctatggtcccagctattctggaggctgagtccggaggagcacttgagcccaagaggttgaggctgcagtgagctgtggttgtaccactgcactccagtccggatgacagagtgaaaccctgtctcaaaaaaaaagagagaaagtcagggtatccttggaagcaaaatgctcccccagctccagccagagtcgtctgccgtttctcaatttatgtgttgagtccatctatgttttgctttgctttttttttgaaaaggggtcccagggttgcttaaaaaaattcaaaagtcaccattggccgggctcagtggctcatgcccataatcccagcactttgggaggccaaggtgggtggatcacctgaggtcaggagttcgagactagcctggccaacatggtgaaaccccgtctctactaaaaatacaaaaaattaactgggcgtagtggcacgtgcctgtaatcccagctactcgggaggctgaggcaggagaatcgcttgaacccgggaggtggaggttgcagtgagtcgagatcacgccactgcactccagcctgggcgacaagaatgaaactgtcttaaaaaaaaaaaaaagaaagaaaaagtcaccatcatagatcgtctacatccactgccttcaccctacttctctaagccaaacaaaaccaaaaaccaaaaatctctctcaaaactgaacagggcacagcttctgaagagtcatcctgaagatccttcttaagtaaacctggccttctgcaaaattccacacaggtcataggacgcaggattccaacgtgcaccctcccccagcccccaggccgcctcagctcccggggatctgactttgagaaccactactccaaagaccaaagcatcttgcctgagggacacaagcagtagaggaatctctgctttttctgtagagcagaatagcacaggaaggggacagagtggcccaggctttccctaaataacctagtgcagacaagcacgtgcatcctgacctctacccagcccatctgggtgctcagggaccagcacatgcaccacgggccctgattggacactgcctgggaggtggctgcccacggcccactcggctggagaacaccaaagaagggggctcatacttcctcacccttcttccccgctggcaaagctaagaaaatctgtgtacagacacccccagctctcccatccccgataggaagagcccggaaggatcagactgggcttcctcttggtataggttggtgtgaccgtgtttctgacccccctgctgttgttgttttgttttgttttgttttgttttgtttttgagaaggaatttcactctttttgcccaggctggagtgcaatggcgccatctcggctcactgaaacctccgcctcccaggttcaagcgattctcctgcctcagcctgccgagtagctggggttacagacacaccctgctgcatccagctaatttttgtatttttagtagagacggggtttcaccatgtttcccaggctggtcttgacctcctggcctccagtgatccgcccacctcagcctcccaaagtgctgggatttcgggcatgagccaccacacccggccctgacctcctaatcttatcagtgactctgagctcaatggcaccttcggagtgcccaccacaccccccaccccaccccatgaaggccagttgggcatcttccccgtgccccctgaccctgggcttaagaaagcgatgcaaagggacagggaggaggccaggatcagggtgcggggggacggtcagagctgtcttctggtcctggctccttgagacctgactctctggggctcagtttccttacgtgtaaatggctgagagggggtggcctcgaggcactcccagtcctaggacctgggagatttggtcctcgggacacttagaggcgccctggagcccttaatgtcttgcagaagccaggaggtgggaggagggtcccctcttttcccgaggtcctggcctgtcagacaggccctgggctgggtgcagacccacaccccagcctcctgggtgtcctggcgagtgggacattagcaggcctgactccttctgtcctttctgggcctgcagttcagcagctcgccacacgagggcggcccaggaacaggaacgcaatggcagcctggcagcctggcagcccagcagagggagcggccagccttgcttttccagaagccctcaatgcttccagttacccacaaccaaaagctgctgaaattcagcttgatttggaaaatgcgcataagccacccagctaggccctttggggccccacctggccacacagtgaggcctcagaggttgtgaagggccccttcctccttgctgtcctctcctacccaggccactgtctccacaccacagcaggggtgcccccatcctgggttctacaggagagagcaccttctctcttgacacttctctccctttgtctggccctcgtcctgtcccctccctgccagcctgtctgtgcactgactgcatcaggagtccaatctggccaggttctgccaagctcagggagggctctacaggcaggctcgtcggcctgggccctacttcccagtctgcaaaatggggtttggctaaacggttactcagcacccccacccagctctaaacctcaatgcatctacctagcaggaatgcgatggccggggccatcctgctgtctcttctctgagtggccctccctcccacaggctgctcccatttctcctatctctgtccaccccttcacctccagctgcagctggtcaccaacacacacacacacacacacacacacacacacacacacacacacccaccacacaccccagaggcgtccccctatgccccagcatctgccctggctgcatcagacatgggccctttatctcaggactcagagacctcagatggcatttcgtgccccctccccacccccaaaaccctcctgcgtcatctcccaccactgacactcctgctgcagcagcagaagagcctgcaattacagcctcaggcacgcgcgtcaccaccagttcagcgcagccaggcgggctgttgccatgggaaccatcccttgaatggatggatgctgagctgtcctgcggcggtttccatggagaaggtcctgatgttctccagtaatttctgcagttctttgttcccggcagcagccccagcctcatgctagcagctgttgattgcggttattattttttccctttttctcacatggtaactgtctgtggccttttgaagtcactgctcttccacttcccaggatcctgggggatggtgccctgagctggccttctggtgcttccagacatcccaaagtcaggctccacctgtccgccggcactcttctcagccaggcacccactccccccaatgccccgccacttccacggagctgcaaatatccctgggcatcagaacaagggatgctgtggtcagaagggcccctagcaaggagatgccacccagagaggctgggccacttgcctgaggacacacagctactgaggcgcaggagcaggcctcctgcttttgtttctcggtcctgagctctctctgctgccgtagcagtaaagtgacctcccaggccagagccaggctcatgcaagagcaggggtggaatatgctttccagcctgggagagccccttccgtggaagaagtctcttttcctggctgggcaatgggaggagctacttccacctcatccctggaaacactcactcctgctgcagatgccctgggccaggcctgggttccaggaacattgtggggcgcctagggcaggctccttgtagaggccggggcttcctccagggcaggggtgggccagggcccaggagaggccaagcaagaatgagtgactgaccagtagggagcatctggttggcacggagttggggggtagggaatcacttctctggcctggagcagtggggaaggtgggctcacagcagctcctcacccccacctcccaggctccagcctgcctggcggccttctccagcctggacactaggtggtgctctccgccctgacctagcagctctccgccccactgcagggaaaggtgtttactggtttgggggtggggtggatggcgcctctggggtgggtccacccaaggttagccaggagagtccgggaggccggcacccctaccttcctcatccccagggagagcctccctctactcagtgaccagcccctctcctcggctaagccgtaagtaggggacctccaaggtgccgtccacctcgcacctccctctctcatcactaagcaggacaatggccatgaagcaggactgcccgggccccggacatgaggccaccctcctcctccactttctgcagcagccccaggctggtcggaacggggagtcagggagtaccccagcccttccgatgctctcctgcccctgggcgccctgggaggttcctgagggtggggtcctcccccctggagctgaggaaggtcattcgaggctgctcccagccaggctgcatggtcactgcttgcttgtgggaccccaggctagctgtgtaggcagtgacacagactcaaggacctttgatagcacagggttgggggagggggcagatgctcagccccgttccactcccagccccaagctctgagccccaaactcagctcccagggcagtctctgagcgtctccttcacttagctcctttagctcctctgtttcttcatcgggctcttcagcccgtcctgctccagcccctcaccttgccatccccacagcctggggatcctgggtctctcctcaactccctacaagaacttctggtccctgggctgacacggagatgctcaggcctgttttcaaaacttggagttccctcagtctgtccacaagtgaatgacggagcaagtcccctccctgccctcggcttccttccaggccatttctcaggggcatcgtaggctgaaagggtttgcaaaactctgcactccctcctgcctggatctgcgagttacacaaaagggagaaggtcaggggttggagctgccggtcctggggcttcctgaggggctggggaaggagcgccttgggctctcctcttgctgtagtcctggagctgtggttctcagaagtcggggctcactgcaatccctggagtgagggcctgggaatctgcatggggcgaggggtacagacccccatctgagcagtgaagcctcaggggggcttccccatgctgcctcccacagtggctcacactccaactctgttcccctctctgttctctgcagggaggagtgaaggtcctcatcacaggcccgtggcaagaagccagcaataactacagctgcctgtttgaccagatctcagtgcctgcatccctgattcagcctggggtgctgcgctgctactgcccaggtgagaaagccgccccccaggcccccaaggtgagtgtgatggcctgaggagcactggactcggagttggccttggggtgaccttgagcaggtcatgtccttactctaggcctcagtttcctcggctgtgaagaagcggatccccgatagtctattagaacgtcacctcctttggctcagggacctaatataggacagggacacaggcacgcttgactgggattttgaagcgaatgtgatgagagcacgatttagggcaggaataagccaggcccaggcgatgtatccaggactggccacagtgggaagcggccaccaccctcagcccaaagggtgactagagctggtaagagctggggccagagaccacctctgcagcaaggcggcctctctgcacctgcccgtgcctcccatggcccaagccaaccagaagccaggagagcccaggcaatgcagcccacacacaggctccatcctcccgagggccctgggcagggggcagaaggctggagaaagcctggcaggggcggagggagatggggtggtgatgggaggtcaatctaacaataatcagcacaaatgcctttgagaatgtaaaacagagccatctaccctgtgcccagaaaaggtgcatataatttgcttccaatttcaggggctcaaaaatcccccaagaaacccttgggacagcctctgtgctgtccctgtgcctctgaagcccttccccaggctccagcattatctgcttagcacggtgtccctgtctggtcaacttgtcattgatctctggccatcactgcttccccactcgcctgtcccatggggtcagggactatcttcttgatcaccatagtatccccggggctggcagagtgccggacatgtcacagagggggatggagattgtgacggaatgaatgagtctccaggcatctgaagcctgtttctagagctcatgtcttctgctcctgggctgttgctggcaggactcccttggctgccccatctcatcaccaccagccctcaggatggcctgtccagtgagccctgaccataaacaggaggggggtaaggatgcaggggtgcggaacggcagggagacccacccctgtcctctaacgtcagggagcctagaaaggagagaagatgctcagtgtagaagactgggggtgaggaggaaaggtacggggtgggagtacagagctggccagtgctaggcaggccccagggtgtttctaggttccacccaaggtggtccagcctgagccttggctgccccagctgtctgccaccaccaccccacccttgaaccatgcccccaggctgggccagctgagtcccaccacccatttctccttttctccttctctctcaggctcttctttttgttggtttttttgttttgagatggagtctcactcttttgccaggctggagtgcagtgatgcaatctcggctcactgcaacctctgtttcctgggttcaagtgattctcttgcctcagcctccctggtacctgggactataggcttgtgccaccacacccagctaatttttgtacttttagtagagatggagtttcaccatgttggccaggctggtctcgaactcctgacgcaagtgatccgcccaccttggcctcccaaagtgctgggattacaggggtgagccactgtgccccatctctctcaggctcttcttgcagccaccagagcagaaaacccctgctccacagctggctgcacactccgcctctgcttgaacccagcaccatcttccccaaaaagttcccaggagccagtgcagcagcccaaggtgcccaccccaccccctgctggcccagccctcccctcccagcccccacctgcctggctccagaaggcccacctagctgccctgctcggcctggagcacagccagccggggtggcagccaggccgggtctgcctatcacagctcagggctgtgtgcagctgatgggaccccggcccggcgggagtggcggggagggcactgtggaattaaacagtgcacccatcatctgctgccagaatgcgacttgcctggcctataaatagatgccacttcctgtacctggttctcgcctggctaaggaccagggcagggctgcttaggtctgctctcagttatctgacccctctacagaaaaagaaaggctgggctttgtgtggccccggggctggagtcagccacactcgggtccatcccagatcagccagaaaccatccctgttgctggagctcagtgcctgacctctctgggcctcagtttctacagctctgaaaactgcctgccagcagggcgagagcagtgagtgagaggaggtgtgtgaagcacctggcccagtgctccattcctgaagggttcccattaaggaggccttcgctcttcctttcccaagggggagttcggagagggtaccagggcagtttgggtctcaacaggcagttctcctggtcctggggcatttctgggtccccagagatggcaggtagagtctctgcccaggccactcaccctcctagctgttcaggctcattatatgagccataatgtgtctcggaccaagggaccaggagccacaaggctcaaggcacactgagagctgggactcccctgctagagccagcactctgtcttcagctaactccacaaagggggcctcctttggacatctctgctttgaggcccaaattggaacacattgctctgtaaaacagcactggatgtattaattcattcattcatttcttcatttgccaaataacttttgagtagcccctgcttgctctgcacagagtaggggcctggaatggagcaaacaataagacccagcttctcaccgggcccctgatcgtaaggggctctcggtccagggaggagtgcagtgcgcaaatgaatcactgctccggagatgacgctggctgcttggggacctcatctttgggtctccccagaggaatctgaggctgagctcgaaggatgaacacttggaagtcagaatcaaactggcctcaccaaaaagagaggctcagaggcttatgagcacaagccaggaacgacacgggaggagggggcactggcaacacagttggccaatgcccacccgtctcccaacacacctgcccaagcaaaacagatgagcagggtcctgccctggcagctcccacaccgtcacaggtggcaggagacacgcaggcactgagtgtgtcttctgcaagactccagggtgcttcaggggcaggagggagcccaccaagttagggcagtgagctgagggcagtgagcagcagtgagtgagaggaggtgctggggaaaagaggcgactcaggcttgggagaagataggggaatccaccaagaagactctactggccagagagccctactctggattcctaagaggtcaccagaacacaaaagatgaaattcaaaatgaaagccaggcacagtggctcatgcctgtaatcctagcatgttgggaggccgaggcgggcggatcacttgaagtcaggagttcgagaccagcctgaccgacatggtgaaaccccgtctctactaaaaatacaaaaattagctgggcgtggtggcaggcacctgtaagctagtagggaggctgaggcaggagaatcacctgaacctggcaggtggaggttgcagtgagccaagatcacgccactgcactccagcctggaagacagagtaagactctgtctcaaaaaaacaaaaagcaaacaaacaaacaaaaacaacaaatgaggtgtagaattgggtttcaaaacaattcattcaacaaatagttactgagccgccataacatcctgggcactgaccttggcactaggcatgaagattaagacagagccagtcccagctctcatgagctaatgttctactgcagggagacagaaaacaaacaaggagaaaaagaaataaccaagataactggtgaaaactgtatcccagcagtagaatatggtaataaggtcacctgggaagaaggaggttccttctggaacatggatgagcagaggcctctcgcagactgggacctggatgatgggatggagccagtcatgggaagtgggagaagcatccaggccaggtagagggtaggggaagtgcaaaggccctggggcagaaagaggtttggcaacgtggagaatctaaagcctgagaaaggcactggctgcaggatagtgagtggggtacggggagctgaatacagtaagactggagatgatagcaggaactaaaataaatcgtgtccatctttctgcatcataggaaggagtttggtttgatgttacttgcaatgggaggctgttagctttaagcagggagtggcttgatctaaatgatgtctttaaagatgattctgggtgtgtgggaaagatgattctaggttgtagggaggaagaacagaagcagggagaccataggaagaaggcagagggctgatctttccagatgtaaggagaagggctcccttgggcaccacactccccctggtttcctgtaggggtgctgggctgtggcccccggtgctggattatgggcctcccgacaccctcccagcaggagcgggtctcaggtgcgctgatgttgccttcgacaggaggctaatgaaggggtctaggcaacaaatgatggcggcatggactacagcatctgcagtggagatggagagcaatggatggacccaggacttgctgatggactgcatgagcggggaagggaagagcgagtccaggaagcttcctgggtgatggaactgcaggagcagggctgctgggctgggaccccggagaccacagtaggtcccctctgctccgtctctctgggaaggaagaaatgccttggagtctgccaccattccagcgttgctgcaggttgtgcacttgccagaagatggtggaagagcagcagcagttgaagaggccatcccccccgaccccaagctgggacacattgtcccagagaagccgtgagttctccaaggctggcccaaggaggctgctaagaggagcagccctgagcgggctccgatgggtgtaggtgctggccacctgccttcctgttggcaagccaggccaatctccagggcaggcatgcgaccacaagcttggagacccgcccagggatgccaacagagccatagcaggttctggacttggccggggctccctgcccaggcacctcggaggtcctatgtgacctccactgtggagtcctttggttcaggttgtggcctggagctgaggttcccagccagggtggaaaacacagaggaaaaacccatgggtccccttggacagtgactcccgaaggccttccctggggacaatggcaagatggctgctgccttaacacatccacccaggatggacagcggccaccggtcaatgagctggttttcccatcgggactgggatctgcatcagagtcctcggaggaaagatggagctctgcttgtcctagggagcggctggcttggacggcttcctcgactctataagcttctgaaaaccaagggcccacacagtaatgtgatccccacgcatgtcctccctggaagtctgtactggggaggccctgggtatcagtatctggtattccggaaaagcagggcagaaggcacagaacccagacatctgccagggatgaggcctggcggggcagtgtgcacacccaccattgcccacgggccacctctgtgggccacaggccagcccccaagatgccaacatgagccatggagaggcaacctcaacccaagagctgaagctggtctccaccgcaggctggcttcgtcttactcacagtgagaacatacctcgtttattccacaaatagagttatttgttgagccctgtgttggggccacagcagttaacgagacctgccagggccctgtcttccagagcttactgtcgggccactggagggaggtgcaaccttcacatcagcatccccagctcaacacccactggggctgagctggggccagggtaacagaggcacatctgaagctccttcatcggggaagcagaagaactaaaaatacaagggatggctggctgttcatcgagtcaggacaagcttgtaggaataggtgaaacaaaataagcgcaaataaatccaaagcaaattttgtacccgagccccacccaggaaggatgggacaagaggggaagtcagccagccatgaggcagggatgggggccattcactcattcacttgttcagccagtctgtactgagcacccagctcctgccctcactcggaggacaaagcaaaggggcagttacgtacctgggagtgatcacaggacagctggctgagtctgggcgaaccaagaaggttcctagaagcagcattgtgtttgggcctcgaatgagcaggcataggctaccattaaggagagctggacattaaccaatgaagggtagtggggaggggacattccaggccctgtgtggttcaccaggctgtaggtacccacccatcccttgacctggtctttttctctcgctttcagcccatgacactggtcttgtgaccctacaagttgccttcaacaaccagatcatctccaactcggtggtgtttgagtacaaagcccgggctctgcccacgctcccttcctcccagcacgactggctgtcgttggacggtaagaacagtgcttgggtcgtcttgccaggcaccaagggagagggatgcttggggactcttgcacaaggtgtgaaagaagagtaagcacccagaaaggggcaggaagtggtgccaatgtgagcaaaggaaggccgactgggtctccaccgccaggctgagtgcctatgctgtcagccatttgtgtctggacactggctggccccaccctcaatctcagtctctccctgggacagactgaaaagtatgtgagtgtgggcctgtggctggcacgcctgctgggctgtctgagtggccaagcaagcccagggcagctaagaggctctggcgaaggaccccaggcagcaaggtccaagcacccgctgtgcccctccaggcctgtttccgcgggctcctggaagcaaaaagggttcccagaggccatcgccaagccccaagcctctcgagaaagaggacggggaggcagctcaggcctgggcttctttcgaatttgggggcttgcttctgccttttggggctaaccagccaaatcttctcctggaagccctcaaataccctcaactccagcttcttggctgattttaattccacctctggcctgtacggcgtctgtggcaagcccaggatcacgactgtggcagagggtagagtgtcagggaccccagtgggcttcaagggagcaggcaggacctggtggtcaaggagaggcagggactccaagagctgccagccttggccatgggggtcggtgagtgttggtggttccccttggggtaccaggggctctgcagagaagagctgccaaaggcaggctggggacgccagagccagaggctgccatttcccacctgggcacacgtcaggaggcccagagctagccaaggcctggggggctgagcccagtacactggggatgcggtaggagggatgcctgtccataacctcagtatcaggtgagcccacagaggtgacactccatggggtaccttgctggagaccttgctagcccaggatgttgaggtctgggctaagctgagcctgagccccttgcaggggtgggttctccaagcaacaccccctcacgcaccccgcacccacagctggccttctgggtctcacctctcagactgccccttgctgttggctgctggaggatttctgggcttgggtacatagttcatttcctgaaccacccagtgtgtaaacctcagccttatcccagtccctgccccagccgagagagagggtgccgacagctgccctggctggtgaaccctcaggagacaattccctggggtggctttgggtcttcaaaccctagcatgggctgccctggggcaccgagctgcccttggcagcatctctggctgaggccggagccaggcagagctgtgatgaccacccacaggatgtaacaaagaagggcagggtgaccaggggctcccgtttaggaaatctggttttagttttgcagaacaaatggggaatggagtcaggaactctccagagctctggctctccctgagtgacttggccggcctcactagaatgaacccaaggatgctgggaccactgtaggaccctgcctggcagatggagccttttcagagagcaaagtcacagtcaggcagtgccccagagctcaggacacatctgcaggccccctggaaacccagagagccagctgtaccccagaagctacggcacgggaggatgctgccatagaaaccggggggaaggggagccacccaactgcttcatgacagacacaccccgggacctcggccaccccaggcccctcgagatgggcctgccgccaagctgggcacctgctccctagctgcccccccccccagaactttgagctctgaactctgtgggcctccaagttgaaataagcacccctgcacctgcaggatacacaggagggtgacaggaattggggcggcgatgacatcaaggcctgggcgtccagcagcatcgcctctgttaccaccagccagggcacagctaggggaacagtagctccgcagcttggacccccagctcagagcgccctgctgaaccagaggggaccagcctggggtccacctcggcccaggggccctgcagagagcagatcagggccctgaaggacgctttcctttggtctgggccagttgtcctttcaaggaatgagtgggaggcagggacagaggaactgccagaccccacctggctggggagaagcgggtcttccctggctattctttttccccctaaatgaatacaaggcactcacccacccaagggcccagccttcccagcctttcaccagcttgataaatactaagggaggggaggggaagcagcgccgcagtcgcagcgcaaagggggccgcgggaacagctagtcgggagcgcgggggtcccgggcctctggccagccacggggcctggccatgaactttgcgtccgggccaatgctgcagtggccgggcggtggtgagccttccgttccccgcctgtccctcccggcccctcccctcggtctccgcagcttctcggctcagcccctcccgtccccgcgggcgctgggccgattctccctccgcgctggccaggccgtggagacgggttcgccgcggagaggggaggagggctggggaaggggtgggcgccaggggactgcagcgcggagcaaactggggcacggctgccggcggcgcgcgtgcacacactctctcccacgcgcgcgccctcccgccgacgcgcagccgcaatgcggggcccttcgcggaactgctggcggcgccgcgccccgcggggtctggggccccagcagggactgcgaggaccgcgggactaggaaggcctgagcccggccacccgcctccgagtgcgccgcaccgtgcggcggggaccacaggccttcggtgggcggcgagccctggctccctcgttcggtggcctctgctgcatgtgggatgcgccctttgtcccctctgccatgcgcgggggaaaatgtttgagggcggggaagagactgtctgccctcatttgatctaaaacatgaatttgtttgcttggctaaaggccgggggggggcgtgggtccggggcgcagagaacacgcgcgcgcgcgcgcgcgccagcagcagcagcagcagcagctgctgcggcgaagtctttgtccccgcggcgcagcctttgtccccgcggcgtagcttttgtttgcgcagccccgccctgcggagggcgatcgtccccacgttggggccggggggcagggacccgacgtccccaaaatctcagctggggcgcagccatcctgggagagaccgggcgtggagatgggggaaggtgggaggaggaatcgcagccttctggatcccggagctgcagcgcctcccccagacctaggggtcttcccctcccttcccctgcgccccactgtgagctccagggtcaaaggccctgtctgctggacccccatcacttagcccagggttggcacgtggtgggctgcagtacatatttgtgatatgaatgcaggcacacgtgaatgagtgcaggagggactgtcaaaaagctgaatccaactagtggtaaggaaggtttcacagaggaaacgacccccttggtgagacctgaagcctgagcagggttagcccgggaagagggggcatcaagggtggcaggagagggaatgagcggctgcctttaacccagggtcttcgggaactgccgttttcaccatttctcctccacccacaaaggtgcggattcagaacaaatttcctctgtcctgacctgaccccaggccatttgcacaggaccccagggaggtctgagcaggccagctcttcatacaaagatgcaagggggacctcttccaggctagaggtaggcaggcaatggggtttaccctggagacccactggggaggatctctgggaaatgtcacttatacctgtgataggtcctatggatacaacagccagggccgtgctgaacttcaagaggatgctgtctgtgtagatttggcctcgcctgtgcctgtgtttacaaagagaataaacccaggcagttcaacactgcagccctggagctgaggggatggggcgggccctcttctggccaaggacactgggacacctttaagtgacctgggtccctagaagagaaggtgagcggaatttttgtgtgcctctttcttgtcttacagcatctgattctcccccaaggccaagttgagaagatttagggtaccctgtccccacccccacctgccggcccttcttggaaccccactaagccgcttagacttagactctattttcagtgcttctcaggcaactgagcctccttgcctgggtgagaggattggagtgagacctgcgtgcagctcccctgggcttggctggtctcctgggcaggcccccttctggcctcaggggtgaggggggaccctgtcatctcaggcagagcggggagcatggactaaaagctcaaacttcattatccagttgcctgcttcctgggcaagcctcagtgtaaggtgggtgagcccagacagcttgcccctgcagctggccagagacagacggggttatcctgtgacttctggggcagcctggccctggggtaggtgtctgggaagactgagagcctcgctcctgtctaagcaagtggagagaaggaaaggcctcttggtttggccttctgatccgtccacgctctctgtgctaacagatggaagatgtgtctctggggcagcccctagctctgcccccacttcggagctgccaccttaggtgtgagagggcctgtccctggcatgtggctgtggtcctgctggcctttccttgtgggctgattctagtaccagcctccacccaccagagctgggagatcacacactgtcccagagtccaggggtacattccagggacagtgggaaaggccattctagctgggacactggtccctgggaggcctctgggtgcttcttcctccaatggcaacactccagggctttctgctgagtgggcctgggccggccgctcctaggctggctccctccctcagatccacccagcccacctccgagcaaccctcagctggcccatgaacacatcgcatgacatgggatgctgtaagagaacatacacagagttggctgggtgcggtggctcacgcctgtgatcccagcactttgggaggccgaggcaggcggatcacaaggtcaggagatcgagcccatcctggttaacacggtgaaaccccgcctctactaaaaatacaaaaacaaaattagccgggcgtggtggtgagcgcctgttgtcccagctactcgggaggctgaggcaggagaatggcttgaacccgggaggcggagcttgcagcaagctgagattgtgccactgcactccagcctccagcctgggtgacagagcgagactctgtctcaaaaaaaaaaaaaaaaaagaacatacaatgtacactgagaacacattccaaaggcatcacttgtcccagataatggaagacagaggagcaaaaattatttccttgctaaataatgtaaaatgcctttgctttactaaaaccaatacagtttgtattgtggagcagaatacaaaattcacaagaatttttcagattagacagtatgggtgaatggtcttgacttcaaagagctactttgaattacacccatagtgaaagactggaagcccccacctaccctctcccacctccgggagctctttaggggagctggagaagcactgacccaggggtcacccaaaggaagaaaggacgcccaccccaccgagagctttctggcatccacctggagtggggactggggccagcacaagctggttagcgcatgggcccctgggtacttctgtgcatagcagtaacaggtgacagaagcagctggcgtgagccggtcttgcactcgggacctgaggctgagtggcaggagtcacgtcctctccgagcccagccagtgccatgctccaaagcacagggccctcctcgtaacccgtctctcgctgtctgtggggcctccgtcattatacattgcggtgggtgtctgtcagcttgggtgcatgtgctccccaggcctgctttcctcagcaccgcagtgggtgggagtcgcatcagcatccagtttggggagcatcttagccattggggctcctaaggagccagctgtgctcctcagccaggaccaagaggtctggtcctcagatcctcctgggacagtgacttcctgccatttgcagctggagccacaccaagcagacctgtgtggagctcctctgtgtagcaaggagtgggtcaccttggagctgggtcccatccggcctccttggagcagtggcaaatggtgccctgcggagaaatggcctttaggaggaagcttgcctctcagcaaaggccgaggggcagcctttgccaccctgtcctggccgttggggcaggaagcaaagttgactctgtggaggacgccccaggactcgggcagatgcaggctcctctcccaggattggcttccctgccacctgcgggccagatggctccttccagagtgtgcatgactatggcagctcagaccctccaggggtcaagatcagccagctgttcctgtgactgccagacaaatgcccaccaactggctggcttcacacagagatgtgctctcacggctgtggagactggaagccagagttcaaggtcccagagagccgtgcccccaccaaaggcgctagggagggaccctctctggccacttgcagctctggtggctgctgatcatcgttatggatccatggcttgtggcaacagaaccccagtctctgcctgcactgtcctccctctgcgtgtgtctgtgtccctactttcttttaaggacaccagtcattggattaaggccaaccccatccggtgtgaacccgtcttaatgaattactaattacatttgtaatttactaattacaaagactccatttccaaatcaagtcccattctgaggttccctgtagacatgagcatttgaggaacactgttcaatgcagggctccatatcttgtaggcttagtccccagggcatggtcctgggcatgatcccagccgtcaggcctcactgaaggcaaaactgacccccagaaaataccagaagcctcctgagggtttgttgtgcacggggttctgccctaggtgttgtgagaagcgcagtgaagaagccgcgcaggttaggctccggggactccgcggtgtcggggagttcacaggcaccgtcccgcggtcacaggtggcatgttttgaggagttcgcaggcaccgtcccgtggtcacaggtggcgtgttttgaggagttcgcaggcaccgtcctgcggtcacaggtggtgtgttttgaggagttcgcaggcaccgtcctgaggtcacaggtggtgtgttttaaggagcatcacaggaagtacagttccgttcagtgtttattgagcatttactatatacacagcaatacgtatttagggaaggatgcagatatgggaaagatcagttcctggcttggaggagccactcacaggatgccctcctgttggaatgctcagggacggccatggggcagcaggatagggcggcctcccacagccacctgccatgaacacactgaccagcttggctcctgccgagaccacagcacatccctgtggaccccacggcctgattgtcttcattccacttgaggactcccagcccctgtgtccccattgatggccccttccccaggcgaagccctctggctctgggcagtgcgattctgcccctccctcccactcccctgcttgctcctcagtctccaagcttctccttccaaaattctctgtcatgtccccatggccggctctctcctgactactctcttctccctgcccacgctccctgagggcttcttcccagccagggctcgctctcccacctactagggtgcagggatggctgcccctctgtttgtcttcttggatccaggccatccatctaacggcctacagggcagcttgacccacgtttctcttgggcaagccagtaggtcccagacaggacaaatggccgttctttctgttttccccaacctacctctctgataacattcctgacccctgtggataatcccacccaaaaacccaggagtcaccccttgctcactccctccccgacatcccaatactagcctagcatgtttctttcctttatttctctcacattctctacttctcgccatcctctctgccaccaccttaattcagcccaaactaatcaattgtgcacgtcctaaccagtcttcccacctccttccacctgggctgcctggtcttccatcacctggtcaacatggactcggcatctgctgggtgccaggcactgttctgggctctggggaatccttattctcctgtagtttctattctagcgggggagaaagacaacaaacaagatgcaaaggaaactgtcagatgttgatacctgctgggcagggaacttcccctggatggtctgggagagggtaccagggcggctgctttataggccaggagaggtcagaggaggcctgtatgagaaggtgatattcaagctggggtatgagtgacaggcaggggccagccacagtaagaccgtggggggaatattccaggacagggaatcaggagcaaagcccccagggagagggcaagcctggcgcgttgggggagctgcggtcagaatagaggaaggggaggtggagggggttgcggggatgggagagggccagggggttcagcagaggccacatgggatgcatcaccaagagtagggggctgggcttttattctgaggtcagtggggagccacgggaggggcgttgccacacacaggtgtatgtttgcaagaacaccgcagctgccacgtggagaatgaattgtgtctccaccggcacagagactactccagggctcttgcgtccgttcgggcaagaggcgattgtggctctgacaaggccggaacaatgactcctgagggacagggtgggtttggggttgtttggaggtgaagtgaagggctctgctgatgatttgaatatgaagaacgagagaggacaatgagtaataatgcctagatttggggcttcaaccaccggaggaacagcaaaccatttcctgagatggagaagtctgaagaagcagcaaacccaaggggataggggaatctagtgttcagttttggtcacgttacagctgacaacctcattagagatgcggggttcacattgcggtctgaaagtctggaggccaatgagagatccagaatggagatgacgtttaggagtcctccgcgtgcagatggcgtttagcgccctaggtctgagcacgaagactccgtgaaacagcacagatgaagcagaggagaggctgcaggatcaagcacaggctaccctggtatgaggacaccaagcagaggaggagctggccaaggagggagggggacagccagtgcaacggagggaaaccagcaggatgtgacccatggaggctaagaaacgaaggtgtttcaaaaaaaaggacgtggtcaggcaggtcagatgccaagcagggagctgggtaagagccctccaagcagggggaggtgggtaggaaggtcctgaggcaagagggagctccacggatttgcagaattcagagaagtggctggaaaatccaggtgacacggcaccatacctgtctctgagctcagagtcacagccttccacagtgtggggtcagatgagaaagggcaggagcctcctggactcttgcctggcccaggagatcgcgtgcctcccactgccccatccactgctcgttcagcagaaggcaaggccccgtcccctgcttttcccatcttgcacctctggtgttggtcttgccaaccttttgataggtccgtgggccccaggagggcagcttctgtgtccctgggctcgtggagatgtcccacatctgttctgagtcccagagacagattccttcttcatggctccccgctggggagcaggggctccaggtgagccccaaagcaggaacaaactgtgattcacccccaaacactgtgttggtatcagacctggtggagacagctccagggccctgaccactggttgttgctgggtgcaagaatcgtgcagattcaccggaagcctgcctggcaggcctgctcaggcaattacgccccagctcctaaatcgattacgtcggactctcattattcctttttttttttttttttggcagagtcttgctctgtcgttcaggctagagtatagtggctccatttcagcttactgcagcctctgcctcctgggttcaggtgattctcctgcctcagcctcccaagtagttgggattacaggtgtgcaccaccacacccagctaatttttgtatttttagtacagagtttcaccatgttggccaggctggtctcgaactcctgaccttaagtgatccacctgcctcggcctcccaaagtgctgggattacaggcgtgagccaccatgcccagccggactcccattattctaccacagcatttggatgtgggtcagctgttccactaaaagcacagccttgaagaaaggcctcttggcaaagctgggaccacagagagaccggtcagggaatctggctggtccaggccagcaatgggctgacatccttagcctttactgggattgggctcccagaatccatctccctggaaaccaagggaggtgccagtctgtgtgtgcagctgccgggagaagtggtcctgagacccagaacacccaccatggagaagagaagacacaagtgctggttgggggctagggcagcctctgaggggatgtgaattcctagtggtcctgagcaaggtgagaggacacccttcccatccagtccaatgctcagcctctaactggggccaaggacaaagccctgtcctttcagaagctcctaaaaatacacatatctctgacccttctgagcagcccagcaaccttgtcccccacatctgtgacaccaggacattcaaaatagtctttgataggctgaagactggctccctccccagcagtaatctgctgaaactttgcacctgttgtgaaatcagagtcctttgttaggggaaaaacagtgagaggcaggtatgtgtcatatggaccatacttcatgaataacaggagactttttaaaaaatcaggccgggtgcagtggctcatgcctgtaatcccaacactttgggaggccaaggtgggtggatcacataaggtcaggagttcaagaccagcctggccaaaatggtgaaaccccctctctaccaaaaatacaaaaagtagccaggtgtggtggcacaggtggcacctgtggtcccagctactcgggaggctgaggcaggagaatcgcttgaacccaggaggcagaggttgcaatgagccaagaccacaccattgcactccaacctggatgacaaaagtgaaactccttctcaaaaaaaaaaaaaaatcagtggcaagccaggcgcggtggctcacacctgtaatcccagcacttttggaagctgaggcaggaggattgcttgaggtcaggagttcaagacctgcctgggcaacatgatgaaaccctgtcttgacaaaaaatacaaaaattagccaggtgtggtggcacaggtggcacctgtggtcccagctactcgggaggctgaggcaggaggatcgcttgagccctggaggttgaggctgcagtgagctgagattgtgccattgcactctagcctgagtgacagagcgagaccatctcaaaaaaaaaagaaaaatcagtggcagagggaaaacagttgatacaccaaaaacaaacggaggttgttcaggagttggaacttgtcccatagtccaatctcctcattcttctggaaggaacccaggccccaggaagagcagctgctggccccaagccatcgctgaatcgggatggaagtcacctcctgactccttctgcatgctctcctccctctgtctgcctccccttctccatcccacagccaaattcacccatgccccagaagctaggacacaaaggcagataagaaatgagccggctagtgggcacagtggctcgtgcctgtaatcccagcactttgggaggccgagttgggcgtatcacctgaggtcaggagttcaagaccagcttgaccaacatggtgaaaccccgtctctactagaaatacaaaaaattagccaggcgtggtggcaggcgcctgtaatcccagctactcgggaggctgagtgagacaggagaatcacttgaacccgggaagcagaggttgcggtgagtcaagattgcgccactgcactccagcctaggcaacaagagcgaaactccatctcaaaataagaagaaagagccagctgggagccctgggcggcttctgtgtggtgggttgtggtttctttggcgaggtcaagttttgcctctggtgtccccgcggagtgagctgacactctcccggcattcacactggcaggagagagggagcagtgacctggctctagccctctgctccctggccctcatgcagaaggaccagttctggcatcagcagatcgggaggtacccagtggaggcctcagagtgtctcctgtcataccaaatcctgagatgtgctggcatgtgggcaaggaactctaccccagccccacaccccatttggtggtcttgagaagagctggtgacatcctgcatcacttcagtggcaccaagctgcatcgattggtcttgagacacatggcagacttctgagccaccaggattgtttctttcagcaaaacaccttctggcacagagttgccaccaggagggacagcagctgacatctgcacatgcaccacctgccaggacctggccatgaagtactgatgtgtacccatgtgtagtgactcactgagactttccggcaacccgtgaggcccctgttccacagatggggatgctcagacaacagtgagtgggtggcgcagagagtcacacacagcagtgcgaccccatcatccgctcttgacctctatgccatgtgaggcttctggagcctcttcctgttgcacctgcactactttggagctgcctcccagggctagagcctgtccttgcttcccggttattcacgacaaccgtcagtggagtacccgttaggtgccaggcactgcgtcacgtgatgagtatcagaagaaatggatcagatgaggacctgcagtcaacgagcttcccgtccaggggaggaaacatccgaactgaccacctgtcttcgcacaaacaagcatttggggaccttatgatggaggatggtgacttctcgaggaggtctgggagggatttcttgaagaaatgacccccaaaccaagagctgaacgatgagcacaagttaactccctgaagagagaaggcaaacattccaggccgcaggaatggcacgcgcagaaactctgtggtgggagggagccatgaagccagtgaggcagaggggcaggcagtgaatcaggccacaggggctggagggaccctcagagccagggctgtgtgtgccaggctttatccccaaggagaggaaagccactgagggctcgagaggcagggacgtgaccaagttggcttctgaagaagcgcacatggcagccacatggagaacagattgaaggaggctcagagagggtgaggggagaccaggaaatcatcctggctagagatgatggtaacttggcagttctgggggcacagggacagtgtgagagccaccgaggagatggcatcaggaggtcttgtgggtggattcactatggaggctccatgtcattcaccttggaggaggaccagtcaggagttgagctgagtttaaggggcttttgggacatctgtgtgaaaagtcaatggcaggtgggtgtagccccagagctgagagagcaaatagacaagagagcgagagagagagagaaagagaagtctgaaatgtctgcgtggaggtggcactgaataaagcacatctgtgggtgtggaggaaattgataagcatgacaatattgctgagtcccaaggccaagaacttctgtcttaattatcattgtgccccagtgtaggggtccagggacacagtagggtctcgatgaaggtttcttcaagggagggaaggaagggagggaggaagggaaggaaggagggagggagggagggaaggagggaggtacagatggcctagtggtatcttcagggccattgtcctcagggctgactgcagctttaggatccagccacccggatatcctctctgacatcagaaccaggctgggtagggtgtccaggactaaccaggcagcgtcacctccctttgggtctccctgtcactgaacaagctccaggcaaatgacccaagaccaaagtgcagaagcttgaccctctgctacctctttattgaacctgccctgaggctgccttcagagcttttaaagggccacctggtgagaaatcctcccttcagctcactgaagctggaagagaaaggaaaaagcacttttcttcctggagctgctcagccctctctctaggcctcagagagggagggggtttctcaggccggtccttggcaagtcactacatggtaggttgtggtgcatggaccctggaggagagcctcatctgaccctctgtaatgcccctgacccagtcccacattagcctggtgaaggaaagaaagaacgaaagaaagaatgaatgaatgaatgagtgagtaggtgagtcggggccatgaaaacctccctatgcacaggaatcctgctgcttcaaaacacactggtgtgacagtgacagtaatgatcaccagccaggccccaggcctggtgcttcacatcatggccctgttgaagcctcccagcacccagcctcaggttgtcattcacaggcacctcacccccaaactgggtcataaactatatggaagaaacagcgttgataggtggcagcccgtccacccacctgtcattcagcagtacctgctagaaccaaggctttacccatcaaccaggcatccccccaccccccaggaactcacagcccagggcagggggcacacggaacaacacaattaatgtgaggagtgcttgagtgtccgggaggtgtgagaagccaggggaacccctctgtgcctccatctggagggaacacacttgacagtggctaattctctatcaaaactgtaatgtgtgctcataggagtgcccttcatatatagaaagaatgtgcaagtgttaatgtatcagtctgttttcacaccgctgataaagacatagccaagactgagcaatttacaaaagaaaggggtttaattggacttacagttccacgtggctggggaagtttcacaatcatggtggaaggcaaggaggagcaagtcacatcttacatggatggtagcaggcaaagggagaaagagctcttacagggcaactcctgtttttaaaaccatcagatctcgtgagatgtattcactatcgtgagaacaacacaggaaagacttgcctccatgattcaattatcttcgactgggtccctcccacaacacatggaaattcaagatgagatttgggtggggacacagccaaccatatcagttagccacctgtcaagttaaagggagcaccatccacataagaccacctttattgctgcaccaactgcaaggggtaccctagaccaccctcaggtttgatcattcactggaaggacgcagaactcatcaaaagctctcatactcacagttgcacattattacatcaaaaggatacagattaaaatcagccaagggaggaagggcatagggcatagtccaggaaggtaccagacatggagcttccactgtcctcttccccatggaatcatgaaaagcatgactttcctggcattgatgtgtgacagtacccatggagtactgccaaccagggcagctcaccatagccccagtgttcagagtttttattgcggctccatcacacaggtgactgccctccctctccagctcctccagagtcagctgataccacgtgacccaaagaccccaccctaagtcacattgttggtctttctggcacagccaacccctaccctaaacctatccagtgtggccagcatctaccctaaatcatatggttagaccattctgtgacacaaggatcccaggcaaacaaactccaatcaggcatgatattccaagggcttagagttcacctcccagaaggtgaggacaaaagccagacctctctttgggcaacgttaaattctttcctacacaaaatgccatcttcccactcctctgcacccacttgcttgcacctgcttcccctactcctcaccccagagaccagattcttttcagtatctttatcgagggaggaaagggttgttgtgtgtctgaggtgtttgttgttgttaaagcatggctcctacacagatcttatgtagtattcagcagttctctggggacaaagagcacattttactatgagaaatagtttgggtgaatactttgtcgtctgcagaaaatattgtgcagagctccagttttcctagatggagatgtgaaattaactaaattacagatcagtccacctaaaatatgaaattaaatgacaaattccaggagcctttgactgctaaggtcattattctaacatatgattccaatcacctttttaaattgctcacctgtgccatggtccacgatgccctggaaacaacactgcctcctgtctctgtcctgcagacggcacccctggctcaagcaatgctctcctctcggtcaagtgtcctcccaatggctccatttgctgtgcggggttgtaaacggctccattttaagccaccagctccctccctccggccctctctgctgtctccctctcctgtgctgggggctgggaggctgaaggaagccctagcaccactgtcccctcctcgatggctactcttctccaacaagacctctcttcctctcctcaacactgatgggaatggatcggaccttgcaattagtgcccagctgggtgcagacagggatctctgagccagggcggggacctggggagagagcattcctgctcaataattcacccttaagggaaaggaaagctacgaatgcagcattcagccattttccaagacattaacaattcagtgtaattcctgaggcataaaaaatgcatcattgctctaattttataagctccatgatgtttattatgacatcagaaggtctggtctgggtcacccaggagagctaaagccaggagaaaccggtagatagctctgtacagggcctgcacagaggtgctttggagccagcccagaaatgctgcagacacagcccccacgaggtgggacctgatgccctggaagcccccagcactctggaacttggaaatgactgacgcattcatcatgagtctttacacccctcccctggaaagcagcaggcaagagcgagctctgagcagagagaagagggcgcggcagggagcctgaagctccaaggcccccaattgcactcaaagacatcattcctccccggcgttctcattttttcattcccagtaacagagtgagtgggtgctcatttttatatttggtgaaacgccctggcattattccaagtcacttgaaagtgagattagaccaggaggatcactgggtggggctgcgtttcttgttcccactctggagacagagcacgatccatggtatttcactttggacataggtgcttcttaggccctggggggcagcagagccaagcaggggacagcctccacttcattggttccagagccagtgaggtgctggcctgcatgggactgtggctgcaccatgaggggccacagtgacaaagtgacccagggtgccaaagagagatcagcagggggtgggggcatgcgagtgtgtgtcatgtgtgcgcttttccctggccacttttttctttttctaagtaatgtcatttagcaccaaaggtatctgcaaatgctccctgaactaaatatgtcagctctgcctcccctggtgcaggagacggctgtcatttaaaatgcacttgcacagaattgggccttcctttgtgattgctctgtctcctgttggtaacagcacagctcctctcttcatgaccttggtacttattattcttagggagtagctagttgcttccctaaaaggacaactttccagctctcattttcacgggtacctgacagtggctcagtggctgtgaggatggtgatgtcaaaatggctttctcataaatgtcacagtcttttgactccactgttgcctatgagagagcacacttgtttctctttaattagatctctaagtttttgttttgttgttgctgttttgttttgttttttgatacggagtctcacactgtcacccaggccagagtacagtggcgcaatctcggctcattgcaacctccacctcccaggttcaagcaattctcctgcctcagcctccgagtagctgggactacaggcaccaccaccacacctggctacttttttgtatttttagtagagacagggtttcactatattggccaggctggtctcgaacacctgacctcgtgatcctccctcctcagcctcccaaagtgctgggattacaggcgtgagccacagtgcccagccagttttttttttttttaaaataaatgttatctgctttataagaaagccacaccatgacagcttgatttagtgcattttttgagagtacttttctgattaaaatgcccatttaccactgtgactctactgggctgtagggtacacggcatcctctttgaaggctcagtggggtctttctgcctcatggaaaagttgactgtagccccacaggacctctgatgctgtctcagacctgaagactggggtctcctgagcacctcttcaggagcttgagaagggttggaccctgcacagggagccgtagagaaggccgtggcagcccatacactctgcacgggaggatctgtgagcccttagccaggtgaagaagtgcatggacatgtgggaattcttgcttagaagaaacagcctgtattgctttgctggtgcaggctgggctgggtgggacctgtgagttaaaccagtgcatgctaagaggtctgggcctaggtcgtctcactccagctactcctgaatggctacagaataagattccgttggagcacctctcttgtacctgtgtgggattactcaatctgcctagggcatcctggccaactccctcacacagctgctgtgcaggcaggaaaggcaagctcattcgaacagcatagggaggaaagtggcaggaaggcatctgccaccctgaaagatctggagcacatcctgaggacaggaggacccgaagtgatggtgatttccgggttctatcccctgagccctcactgggcacccaccaggccctgggctatctatttaagtttattatccaacttcatcccggccgtattccagatctttccatccccattctattgacgaggagcctgaatcttagaggagtcaagtgacttgtcctgtgtcacaccgctggggattcgaactcagggccatctgacattgcagcccagtgggcactttttcaccatgccttcccaccacctgaattgatttgggacaatccgctttttagtatcctgctccccttcacagcagagatgtctctgcatttcgcccactttaatggggagaatagctgtgtattttaacatccaacatgtgtgtaatagtgggggcctggtagaagttgctggcggaatggatgggcctgtgtcagccagcagggagaatgagttgaaggtggtttcactccgcttccttggattcttttctgcattatgtccattaggagaaacctgccagtttttgggctgatggctaatgcatctcttcctccctccatattacagctggcaccttcccaggatgacgccaatcatggcatatcctggtagcaaacactgtttctccccactatcctccacatcactgtcaggaccattatctctggccgtataacaagccaacccaaagctgaatggctcaaaatgatgagaatgggtactttctcttgatgccgtgggttggccaagctcacacatgcaactgcactcatgggactgatgattttaagcccagagtccctgcagctgaagcataggggcacctgctctgtcaggtcatgctggccacgcactgtgaccccccccccccccaccaacatggccttagacctgtcccttcagcagcaacaacggatttggattaaacaggatttttaaagaattatgttgagactctagtccagggtgtccaatcttttgtcttccctgggccacagcagaagaagaagaattgtcttgggtcacacataaagtacactaacactaatgatagctgattaggttaaaaaaatcacacacaaaaaaatttcataatgttttaagaaggtttacgaatttgtgttgggccacattcaaagctgtcctggctggcatgcagcccactgactgcgggctggacaaccttgcagtgtagtctaaactgattttacagaggaggaaactgaggcacaggaagggaaaggagcttgccatacaggtagttctggggggcaagggggggtgcggaactggaaccagagcccaggctgctgaccccaggccaggaccccgttccccacctcagtgcctccttcttcctggatggctcaggggccctgacaggtgcagctcagctggagatgtttgaggctctctgcaaagctccccctttcccctgagtcagccaaccattgtgatctgcaaggaaaatcccaagttctgaatgctgttctcgccaggatccccagctgtcagggacatcatcatggccagcagggactttacagactcacccctggctttttcacgaccttcagaagcactgtcaaactgcctgtcttctgacatcttctgccctgggcatcaccatcgtgtgactcagggcctcccctgtgccagtctcatctcctcactgagtagtcatgggacagggcctgtctattcagattcccctcctgccactgcaccccacattggcccagaccgactcactgggaggatcggccatcagactctcctgacctgggcctagctttttccgtcggtcagtcttcttttctcaagttaaatccattgatttctattctatacttcttcattctctttctattctcctttgtctatgtgtgtgtgttacagcattattgagacataattaacataccatacaatttacctatttgaagtacaaagtttctgagtgttttcacagggttgtgcagtcatcaccacaaactaattttagaacattttcatcccccaagaaacatcctgctgcccatgaaccagggtcactccccattcctcctcagctcccccccaccaccctccctaggcaattattgatctatttcctgtcaccataaactttcctaatctggacattttctataaatgatgtaatacaatgtatggacttgtggctggcttcttgcacttagcatgatgtttttaaggttcacccatgttgcagcatgtatcagtacttcattatttttattgctaagtaaatgtccatatgtatggacatctcctttcattctcttggatatatacctaggaatggaatggctgggtcacatcataactttataattaaccttttgaagaactgccagactgttttcctaagtagctgtgccattttacatttccaccaccagtgtacaaaagttcaaatttctccacatccttgccaacgcttgttattgtctttctttgtgattatagtcacttagtgggtgtgaagtggtatctcattgtggttttgatttgcatttcctcagtgactttgatttcctcaaatcaaatgttgagcattattgattattgcccttattattgatcttctttggagaaatgtctattcagatactttgcccattttaaaaactgggttctttgctttttatttttgagctgtaagagttctctttatatttgagatacaagtcccttatgaaatatgagatttgcaaatattttctcccttttagtgaaatgtctttttacttcttgatgttgccctttgaagcaaagaggttttcaattttgataatgttcaatttatttattttttcctttggttgcttgtgcttttgatatatttaagaaactatcgccaaatccaaggtcatgaaggtttactgccgtattttttttccaagagttttgtagctttacctcttatatgtaggtctttgatccactttgagttacattttatatatggtgtgaggcaggggttcaacttcattctttttcatgtggatagcccattgtcctagccccatttgttgaagacgattctttccccattgaattgccttgtcagctttacctgtggctttttaaaatattttctatttcttcaagccttaaagatatactgaatatgcatcttgctcttatttttaaattgtcacttagtttgagcagaatcttatgattttttcttttactggaagttgatatatacagaaacatctgatttcttatcagacaggagaggttagattatactgcagtaacaaccaattcaatctcaggactggatttctcattcatgctacaagtccaactacaattgctagggagggccctactcatcatggtcacacaggggccccggctggcagaggctaccttttcctataaacaagcttgcacaattgccagggccgggggaaagaatgtgttgggcaggtcactggctcttaaagcttctatctgtaataatacacatcagatttattcatgtttcattggctcaagaaagtcacatggtcacatctaacttcaaagggtacaggccagtgcaaagcacccccagggatagcaaccagagatatttggtatataatattaatgactaccatttccctggagtgtattgaaatgtaacaggtgtaatgaaatcagttgatgtggactttctgttgtgcatctcgaactttaatcactgtggtaaaattcctttgtagagatcaaggctgcatcgagccaagatcatggcattactctccagcctgggcaacagagtgagatcctgtctcaaaaaacaaaaaaatcctttgtagaaatttccagactgttctgttaaacaaatgatatctacttaatggtaagagtttttaggtgcttggaatagggcagaatgaacacaggctctgaagtgaaacccagatccactgctttccagctgtgtggctttgagcaagttatctgactttttgaagctttcgtcttaccctctatggaatatcctgcttgcaggagacttagcagcagcgtgagtgcctggcacaacagcaggcagataacaggcatccaacagactgaaattcccttcttcctcctctgcaacaggatccaccccctgggttcatcctgagaccctcagcagggttagggctgatatatcaactccctgtatctgctttttttctccccctttttgagacagggtcttgctctgttgcccaggctggaatgcagtggtgtgatcatggcttactgcagcctcaacctcctgggttcaagcaatcctctcgcctcagcctcccaaatagctaggactacagacacacaccaccacaccccgctaattttttttaaaaaaaattgtagagaggagatctcaccatgttgcccaggctggtctcgaactcctgggttccagtgatcctcctgcctcagcctcctaaaagtactgggattacaggtgtgagccaccgtgcccggctgtatctgctttaaaggacaaaaattgcacttaaccttggtactgccaatggactcataactgagtattctttttctctattttacaaaacaacccaggtatgctcaaagccccataaaaacccagtgtaacaatatgcttgaatcatgcgcgtgccttattctctcatcttctaacttggaagaaagaacatgaataccacaaggaaccacctgtggagattcagttttagggcgctggcagcactcggggcttgcctcaggagcacccagctcatcccaccctagctctgcctgactttccaagaaagggacccaaggaagcctcctgctcctgtggtgcagtgagtggcaggcactccaggagaagaacgagcccagccgagaaacaataccaggacattccccatgcagaaacgtcaccccaggctcctgaccccaacccactcagcagggctcagccagtgcctcctgggctgctgcagccatgaccccacctgtcccacctgctcggcagaggtggggctgctgcaggaagggtgaggggtcatgggtacccctgaggcccctccttcagacagctgggatgccagggctgaaacttgtgtctgccaaaacaaacaaacaaacaaacaacaacaacaggaaaaagaacttccccacctgagagagaaaagactgaagattccttctctttaactgggcttcaggtgcctgaactggatccaaatcaccacgagttccccggcactttagagtacagaggcaggcgctgtctctcctgtcagcctccacccctgctggtctcttgctcacaatccattcagagcaattcaacaaccatcagctgagcacttacagcgtgccccgccagcactgtgcaagctgctgggatgtcaggctttgttcttgttctcaaggagatgagggctgtcctgctcttagtgaaaaacaactaacttctagaaacactttttattaatgtatgatggacatatggaaaagtgcacatattctaagtatgcaactcaatgatttttcacaaactaaaaccagtgcccaggtcgagattaaaacagcaccagaaacccagaagccaccccaaccccagcctccagccactcctcctcgcccccaagtaccccgttttggcaaagctggcaacggtagctaactttgattgaatgtacatcagtgccaggcactggtacatgcaccttccacctattgattcctttaactcccgcaccatagatatgaaggcacagacagtggagcacacagctagcaacgagcccactctgaacccaggggggttggtttcccgagcctatgtgtccctgatgactaccctttcattgccgccctggaaaacaaacagaactcactcactgtgtactgcaacaccaacacataacaaagctggaggtttggttctgctgagagcgtcaggaaaagccactgagggtggccagatttgagctggaccttgatgaatgcataggagtctccctagcagataaaggggaggagttgcatagcaaaggtggtggggggagcgtgcaaggggtcctgcgtggtgacccggggggcgggcgaggggtagacaggtgcagtgggaatactgacctagagcaggattggaatatgtactggggctttgccagggcaggcttcggaacaggagaggaacttgctcaggtttacagtgggtggcagcccccaagggaagccatggacgatctaccggcatgggcaggacccagcttggtcagggtgtccttcacgcggcctctaaccagcgattcctcattgggtgtacaggcttaagggctctgcaaatgttggggttgtttctgtgtgcgtttgggtagggtcagaaaagagactccgcccccaatttcgagacacctttttacccaggtggcagagacatggccgattttacagataattgactgtatctatatatctatatctattagtatataacaaaaacaaaataggcggtctcatcacaggtcttggggtcaggcactttctctgtgcgaggccgtgggactgcaaacagcacagggaaaaaagaaagcgggatccgctcgggacgcctgagcctcgattaagaggtgcggctcgggatttgtggccggggcgagagaccctcacgcagaagtccccaagtgcgcagggctggagctggaactttggaacgcggaggttagacccaaagggtgggcggagcctgcactccagctaagggggcccagcgccgcaccccctccccaaagccggagccgccgccaccgtccccgcccaccgtcctccgccccgccctggccctccccgggtcctcgggccccggccccctccctccagcctggcccccacgcctccccgctcgttgcgcagcgccggctcctcccgccggctgcattgcagacgccgccgccgcagggcgcgccggggccgcgcagggagcccgagcccgggaacgcgggccctcggcgcggagcttcgggcggccccgacggcgcggggagccaggcagggcgggcgcggggcggccccgcgggaaggggaacgggaggcccgcgcggggctccgggggccgtcggcccgggcagcgggcgcagccgtcgggctccgagccgtcccggcctcgagggaaccgtcgccgccccattcgcgggccgcgctgagccgggcgggcggagcggcggggaccgcgtcgcgagggaccgggggcccggctctcgcgcggggacgcccgggccgcgctccgcccgcaacctccggccgggcccccgccgtccagcgcggctcgggcgcagttccggcgcagtccccgcgccgagcggctccgcgccccgcaccagcctctgcccggctccgggtgacgtcgcatcctccgattggaccacgcggcctggggggcggggtctggtccggtgagctcaccgccgcgccccgccattggtccgggcggcgcactcgggcagtggcggggagaccgcggtacccggagccccgcgagtcgttccagctgcggcgagtggagctgagcgggcgcggggccgggctgggccgggccgggcggggccgggcggggcgcgggagccagtgagcggcggctcggcgcaagcctgacgagcaggagccgagctcagcaggtccgggtaggtgcgcggcggcgcggggctaggcggagggcgcgtgcggtcgagggcggcggccggcgggggcgcgcgcggggcgggggcggggccggggcgtggggacacgcgtgctcgcgggccgggggcgtggtgcgcggccacgcgtgtttctggcgcgagtgtgcggggccaggccgggagggcgtgcgcggaccgggcgtgtttacgcgcggcagggaggggccacgagggtgcgcgcgtttctggcgcgagtgggaagtgtggggatccggcgggcccggtgtgaggggcgtgtttctggggcgagagtggggagtgagtgtgaggagcaagggtgaggggctgcagggaggggtgcgtttggccgaggagtgggtgggagacacgcgtgtccatgccgcgagggtgtgtcgacgcccgagcctgcgtggggcccggggccgtgtgtctggagtggccgagggcgtgaggggcgcgcgtgtttgtgcgaggggcgtgtgcggcgggtgtgagccacgcgtgtctgggtgcgcgcgcgggccggatgagcttctggagtggtgcgaggacgcgcgcgtgtgtctgtgtcggagcgagggcggggacgagcgtgtcgggcgcgcgcgggcggggctggggcggcgtcggggcgcgcgggggcccggcccggccggcggcgagtgtgttggggcgctcggcttctcctcaacacgggtttttgggacccagtgccgcctccttcccgcggcggggcccgcggagctcccggtttccctgggcagacaggtgcgaggcgaggtgcgggcacagccctgcgctcctcagcgggtgcgggatcgggcgacgggggactgtctctaactacagaccaggggagcggagggacgctcgattcacccgcgtgcacagggcagtcctgaaagtggatggaaggctcggaggaacttctgagagctttgcttccctgcagactggcgaccagagagcactttccacgcgcagatgggccaggatagatgctcggggtggcccttttgcattttcggagctctggtgattgggtttctaggtattgcgcctctttagaggtggcgctgatggcgttctggtgtttgagactttttcgatctctgtagattactgcagacatcaaaagcatttctctacaaatcaggtatcagaatagatttctgaaatgatgatattcttgcagactgtcttcttaatcagttgcctcaccagggaaggacgacaattttaaagtccattttctattttgcccacttttacttgataggatttctgctggcagcctgaagtatctaatcccggaagcggactcagtaaacgtgagaggtgccctcagataactacagaaatgcctcctgtgtttggttgcttgaatgaatgcattatattttttccaccagtgaggccaacccctgactttttaaaattgtgctcccaagttttatcgataaaatgtctggctattacatacaaggagtctttttctcttactaccttgaggaactgaagtgttccgtttccctgcagaatctgtgtcttatcgagaaactattgctgggaaccggatcaagagaaatgcattatgcagaagcacttttcctgctgtgtgtttagaaaaaaaatagttattattccaagaccagaattagacactagcaaataaatttgtttctctttttctttgtattagatttagagagtaataatgtttaatgtccaagaaaatagcatttacttacagcgtatgcatttcctaaataaatttaacctagtagtgaaaagaagcagagaactgctgtgtattcctgagagaccttgatgaggtcgtcctgattaattataatctgaacaactcaaatggaaatacagtatttcatgtactcgttaataacagtcttgtttgtattatttaaggatttggctttggtgataccctggcggatgcattatttcaggctattcttttttttttttttttttgagacggagtctcgctctgttgcccaggctggagtgcagtggcatgatcccggctcaccacaacctgcacctcccgggttcaagtgattctcctgcctcagtctcccgagtagctgggactacaggtgcgcgccaccatgcccagctcatttttgtattttggtggagatggggtttcactatgttggccaggctggtcttgaactcctgaccttgtgatctgcctgcctcagcctcccaaagtgatgggattacaggcgtgagccaccgtgcctggcccaggcttttctttagtcttctatttaggactgaactgggcctttactaagagctgtcactgctgcagtgtattcatgtggggctgttctagaatccagtacgtgaataacaagtggaactgagtattatttacttaatatgagaaagatagcaaagttaaagcattggttgatatgaaagtttcccgagtgaaaggtgtgaggctctttttgaaacaggtttcactctgtctcccaggctggagtgcagtggcatgatcatggttcagtgcagcctccacctcccgggctcaggtgatcctcccacctcagtctcctgggtagctgggactacaggtacacaccaccatgcccggctaatttgttgtattttttgtagagatgaggtttctccatgttgcccaggctgggctcaaactcctgagctcaagtgatccacccgcctttgcctcccaaagtgctgagatcacaggcgtgatggtgggagaagtccagatgtgatgtattgaattacattaaaaaccacaagttagtattactcacatttaacatttcagaagtgcttattagcctgctgggtgataccaatgggtagtgtcacatcatgtcatggggatgttggcgttcatagtcatggagaccttcagttagagtcttctcctcttcttgagtgaattgccctgaagtcaaatgaccatcttttctttgctattctcttatgtgactacatttggcttaacatgacaggcagacaaggagatgccgtcgccatcaggagatagttactcttcaccccacaggcagtacagcaagtgactcattaaaaccatgatatgataccttgtgaatagtaagtttaaaaatacggccaggtgtggtggctgacacttgtaattctagcactttgggaggctgaggcaggtggattgcttgagcctaggagttcaagaccagcctgggcaacatggagaaaccccgtctctacaaaaaatacaaaaattagccaggtgtggcgttgcatgcctacagtcccagctactcaggaggctgaggtgggaggatcgcctgagcctggtaggtggaggttgcagtgagctgtgattgtgccattgcactccatcctgagcaacagagtgagaccccatctcaacaaaacaaaacaaagaatagccaggcgtggtggctttcacctctaatctctgcactttgggaggccaaggcagaaggattgcttgagcccaggagttcaaggctgcagtgagccatgatcatgccactgctatgcagcctgggcaacagcaagaccctgattcaaaaaaaagaaaaagacagtggagggggagaatgccagtatgatcttgtgtaatgctttatttcagtaaagttcctttgatagactaactggaattttagtttataaagtatcgtgatccctgtaatttgcttaattttatattgtcttataaacattgaaaatagagcatagctttagacatgatgtggagagactggtcagctcatctttgaagcacctactatacatcagttgcttagcaaattaaaactaataattaaatattactttgaggaaggtaaagtatacggagtttaatgagggtaaatgtttctaggagttaaagtgctgatcataaagctacataatgtttttgtaatgtggaaggtgatgataagtcatgtaaataaatttctccattatattaaactaatatttatcaactactaaaaattaatcattctctccattttttcagctttcgtgtttcacctgactttcaccaccccatacatcatgtttcactctccagctggccacaccccatcctcagccacacagcatgagccctctgtcacacgcagccaggctggtgtgctggtgtgctggtgtgcctaccgtcacccatactccatgttaaattctgtctcttttttcctttgagcctcactcaagtcttattaatgaagctttttttctcccctcccagattagattaacagctgtttatggggtgcagaggggccccacctaagctgtatcttctactatgcctagcataatgccatctgggacttgaagtttcatgaatactgttagttggcaaagaagttatccagcgtgatgctactcattagatagggtgaggagactgtaatgaaatgtgtttcttcaagcccaagacaaacgtgatcctactccgtgcctttggttcagtcttgtttgttggtcatttaggcacaaactccaaatgatttcccatgcaggtcagttcaaggaggagtgagagggtcgaaaatcaatctatgtggatgtgaatctaaagccaactggtggatgtgagttttcacttaggtggtcttgaggtggccctaaaaatcctggacactgtaccagtgtaaaataggcctgacacctgaatcattttcccagactgagaatattggccagaagcccactgtctagggatgtgtgtaggtaacagctgttctctttcatataatacagcaggatgggcactgggtgtttcagctctaccattcactcagtgagaaaccttatgtaaattaccttgtatctccggctctcttacctgttttccaaacccattagtggttcagaaaagcatggtcaccatcatcagattttaaaatcagagtgcattgcacatagtaagcgtaagtattgatttgggaagctttttggtttccatatgggagtgtgtgtgctggcttctatttctttctgtggaccacagtttaaaaaagttgaaagccactagactggatatttcctaattctctttcaattcagctattctgctgtgattcttttctgtggtatgtgtctgttatgacgccacatttagcagtcgcataaggcctgaaagagttaagatacctccatatgtatgaattcaacagatagtctccagccaggccagagctcagtatacctttccttgtcttactgaatgttttggcagtcaacattgaatcagtgttttgaataagcaagacagtttattgctactgtcatttatcacatgttttgtagataaattctaatgctgcaagtgacaaaactccacctcagactggcttacataaaaaagggaacttggccgtgtgttggctcacacctgtaatcccagcatgttggggggtcgaggcaggaggatctcttgaagccaggagtctgagactagcctaggcaacatagcaagacctcatctttaaaaaaaatttaaaacaaatagctggacacagtggcacacacctatagtcccagctactcaggaggctgaagcaggaggattgcttgagcccaggagtttgaggctgcgggtgagccacgattacaccactgcactccagcctgggtgacagaacgagaccctgtctcaaaaaaaaaaaaaaaaaaaaaagaatttattgactcttaggaagtccagaattagtgttatcttcagctagaactagctctagatgtacaatgatgtcattaggcctcccccattgcccccaccccactctcctcctctatgttaattttattctcaagcagggaagggtccccaatatggcagcagcaagatggcccactctgagctacaggcttatcgtctgccaaattaccagatgtctccaggaagacagctcttatttccctgtagttccaggaaatgtctcatctcttattggcccatcttgagtcacgtgtctaatctcttgaataaggggacatggtcctctcattcataaggcctggctcatacacccctggagccaagaattgggctctgcgccacctaaaccgggtgcagttccttagttcaggctgctctaacaaagtaccatggacaggtgtcctgtaaacaacacagatttatttctcagttctggaggctgaaagtccaagatcagtgccagcatgatgagggtcacttctgagttgcagactgccaacttcttgctgtatccttacaaggtggaaagagggcaagttgctctctggggtcccttttataagggcacccatatataatcccattcatgaaggctgtactctcaagacctaatcaccttccagaggtcccacttcctaataccatcacgttgggagttgggatttcaacataggaattctaggaagacataacattcagtccattgcactccccaaggaagaagtaaggtgccctgatcagggatgaaggaagggacgctaggggggccaactgtgaaggaaccaataggttttggtcttcacacttgattgtcatagtcctaaagaaaacaccatcctgaagctacagaaactcactctagggctttcttccttgcttttattctcatggtcccattttaaatgagaaagaggaaccagagcccatcaccttttagtgaatctttaaatggatattgactaacaatttctaggaccatttccagaaagtatggttcaattccttagtattatacactgtggtttggattaatcaccaaagaatttatttaaatatcctcttttctagtgaaagaagcgatgtcactctagccagaaccaatgcccctggcgcgcgtgtgtaagatgttttatctaatgatgtaaaaaataggaagtacttagcctaaaactgatgattctgaaagcttttaagtcagttgagtaatatttcccagaaaaacagtgcaataaatggcaggtaggttcccaggctagccagagaacaaaaaccttttgggacccactatagatactctgcatttgcaggagagaaataattaaaataatgtgtgtgcacatatatatgcatattataaaacattgaactacataatctataaaatctatcaatatataacatacaagtatgtattgcaaaacaagtgaaagagtgaacctcgcatttatatattaagtgatgctgcttaaataaggaaatatataaaataactttggtaaatggaaacagttttggtgaagattcttaattcacagggtagaactcaaaatggttctctgaaaatacagtctagttctctaatgttttagagtaaagttgcatagaataagtaatataaatttattgataacctaactccaacattattcattataattactattttttttttttgagacagggtctgactctgatgcccaggccgaagtgtagtggtgcaatctcggctcactgcaactcccactgcccaggctcaagtgatcctcccacctgagcctcccaagtaacagggaccacaggtgtgcatcactgtgcctggctagtttttggattttttgtagagacagggtttcatatgttgcccaggctggtcttgaactcctgagctcaagcagtccacctgcctcgcctccccaagtgctaggattacatgccagagccaccacatccagctcaatcttacttttattcccaaatggaacaaagagagtgaaagaaatctttctgaggtggctcagataattaaaacaaggatagggaaatagtccattttcatgctgctatgaggaaatactccagactgggtaatttgtagagaaaaagaggtttaatggactcagttccacatagctggggtggcctcacaatcatggcagaaagcgaaggaggagcaaaggcacgtcttaacatggcagcaggcgagaggacgtgtgcaggggaattgccctttataaaaccatcagatctcatgagtcttattcactatcacgagaacagcaggagaaaaatccaccctcatgattcagttacctccgactgggtcctgtccacgacacatggggattatgggagctaccattcaagatgagatttgggtggaaacacagccaaaccatatcaggagaggttggattaaagaagtgattctgtctgtcaaaggttgtctgaagtggaattgactgaccacacagagtgagtgagggagtctcctgagatgggagagaggcaatgatagtggggagacattgggtcaaaccatttcccacactgatctctggttggcatgcaccattcatccacgtaattttattggagtctgtgctaggatggagtagcacctgagcctgatgagagaaagaggaggaagagtatggaccaagactttcctaactcggagactgtctatatcaaaaaggtatccttagggctagtttccttcccaaactcttctgtgggaaaattagtttcaggaaatgcctgtaagaactgccccccagcccccaccccacaaaaagtttcacataagtttaagaaacacacctactattggcgattatcagtttatagcatctgttagcatattagggttcagaaaagtcttcccttaatgaggtgtaaatgtgtttgtgtttcacctagtatttccaaaacatctttgatacaacattttgtgtttgctgatcaatagctcgtgggaaatgttctgcagaatgcaacctaggaaatgcttcagcagatagaccatcctcacaaaatagttctgaggccgtggcatggttctttgagccccctgaaattgaatacaagatcttatatgtacgtatgtttctaggagaggactcacagcctttataattgtcaaagagcccctgaacagaaagcgcaagaattgttgttaagggctcttttctaacaagggaagtttcagtttctcttaaatttctcttatctgtatatttcatatcagcataggggatattgcccggtgagcaccgcagccactcgggggtccacactgaagaggccaagttatgaacaggggctgggcagtcacttgattattgtgtttatggttgaacagatttaaaaattggcagctactctctttccaccacgaattgtggaaagatattatctatgcaagacactgacttttagccaaactccaggtacattcaattctgaaaacagaagaaactaatgtgttatttcattgcagtaaagagacttcttgaaaagtgaaggcccactgacctgcagaagagaatgttgagagtgatttagtaatatgcaacttaaaaccaatgaactatagaaagcttttccttcaagaaatttagaacatccaactcatctacattcagatttagaaatcagcatgtattcctctgaatggtctacctttaagccaattcatcagagcatccgagagctgtgaagttggaccacattggacctttgctgaatcgcttcgatgaaatggtgctttggtgttccttaataccaaacagtaataaacagtcacttgaaacctagtagtgcttttgtcgcaaggatgttgaaatctattaaatcacagcatccttttttttttggagacagagtcttgccttgtcacccaggctctggctttgggcgcgatctcagctcactgcaagcctctgtctcctgggttcaggtgattctcttgcctcagcctcccgagtagctgggactccaggtgcgtgtcaccacacctggctaatttttgtatttttagcagagacggagtttcaccatgttggtcaggctggtctcaaactcctgacctcaggtgatcttcccgcctcggcctcccaaaatgctgggattacaggtgtgagccaccacgtttggcccacagcatccttcttattaggacctatgggagaaatttatttcagatcctagtaccagggaaagtcatactatccaaagcaactgacgtagtgtgatcttgaaactcactgcccccttttgctttgtttgctacgttcagccccatttgggactcacatttcaccattttggagggtttagtctgtgttttctgtgaaacagttttcctggagctttcttttattcttgtctgtaacatcatgagtcctgattttgcctgatctgctattaatcacaagtatttttgttagccacctcacacaggattgttaccagttaagtgagagcaggaagggaaataaagaggcccgggggaatgggctgggacagggaaggaaaatcaggaaaaggggggaagagcagagaacagactaaggagcatctggaggtattagggattcgagagagaggatcctcagaaacagtgcacagtgccaccggagttggctattaacgttttgttccattatttaaccattccgtcaaccacttgggggggttctgtaaggatctgcagattgcatagcccctgaaactggatgaagtcaagctgcatcccatagccacacactttttttttttttttcttgaggcacggtctctctctctgagccagactggaatgcagtggcacagtcatggctcactgcagccttgaactcctgggctcaagtgatcctcccacctcagcctcccaaagcgctgggattacaggtgtagccactgtgccagccacatccccctttcacagaaagcacccttaagtgttttgcttttttacgtaatccaagggatgctttaatgctggcctcagtaattcatacatttgttcaggcctcactgatttgaaatttgcaaaaatcggaggatgactctggtctaggggtagggtgccaagggatactcagaggaactgagtgccgtgccggcatgggagagcagtccttgatgtattctgatgtggcataaggagccgagacatgaaagaatcctcacaagcatcctgacactactcggaagaagcttaatgactaaaaattttctgaaaccctgtacttcccttggggaaatagtttatttctgaataaaatatttatgtggtatattgactttttaaaaatatcatctatttatcagaagggtctatgatgaattataaaattgttttgctttgttttattttgtttttgaaacagggtctcactctgttgcccgggctggagtgcagcagcatgattgaagctcactgtggcctccaccttctgggctcacgtgatccccccatctcagcctccagagtagctgggactacaggctcatgccaccgtgcccagctaatttttttatgttttgttgagatagggtcttactatgtggcccaggctggtctccaactcctgagttcaagtgatcctcctgcctcagcctcaaagtgctgggattacaggcatgagacactgtgcccagctaatattcttaagtcattttatccattaggacctattttattagcccctaataataaagataaaatattggacagatattttatccagaatccagctatttattttaaaatatgtacatttcattctactaagttgggaaggacttatttacctatatgttttccagattttgtagcactatgaaaaacattataattaataaacttgtgagttctggaacagaagtctctcatgtagaatccagtattcagaaaaatacatatttttggaacgtcttgggctttaactctcacaagttagcaagacagttagcaccgtctgtgcagatggtccccctagagttagttctgagagccaagccttgccaatagcagtcctaaataatgtatggagaatgagcttggcacaactaatgaggatccagcaatcccaccactgcgtctgtagccaaaggaaatgaaattaggatgtcagagagagatctgcactcctgtgtttattgcaacactgttcacaataaccaggatacggtagcaccctgagtgtccatctgtggatgaatgtgtaaggaaaatgtggtctgtgtctacagtggagtactattcagccataaaacagaatgaaatcctgccattgccaacatcagagctgaatatggacagcattctgtgaagtgaagtaagccaggcacagaaagacaaatgccacatgatctcactcctaggcagagtcttaaaaagttgatctcatggcagtggacaatagaatagtcattaccagaggctgggaatggggacgtcggggagatgtttgtcagagaatgtgtatttacagttagacaggaggaatcagttcaaggggttattgtacagcctggtgactcgagttcatcatgatatattcctgaacattgctaagagggtagatgttaaatgccctcaccacaaaaatgatagctgtgtcattatttaatgaacaaatgtactccaaagtacatttgtacatagtgcattactatgtagtacatttgttaattagctagatttaatctttccacaacgttcatgtacttcaaaacatcaggttgtatgcaataaatacgtacaatttatgtccatgtcaaaaaaatttgaggccaggcgtagtggctcacacctgtaatctcagcactttgggaggctgaggcaagaggatcacttgagcccaggagtttgagattagcctgggcaacatagtgaaaccctacctctaccaaaaatacaaaaaattagccaggcgtggtggtgcatgcctgtggtcccagctacttaggaggctaaggcaggaggtagaggctgtggtgagtcatgtttgcaccactgcactccagcctgagcaacaaagcgagaccctgtctaaaaaaaaataaaaaaataaaaacggatatattcttattagctaaaaggtgaccatgaaggagctgcttttaataacttggctgaaaaaaagcccatcatagaaatgactcatggaaacaaatatttgttctacatgttattctgtaccttgttcttcttgaagttcacgttgtgtatttccgatagttgaaattaaatcatttcgtcaataaatatttacagagggcctactgtgcaccaggaatttctgctaggcctcaggaatgtagcggtgactgggatgaacgtagtcactggcctcactgagccaacacaatttctctttacgttcatgtatatgagaccgagtttctggtgacaaaggctcatatcgtgttgggtttttgtagtcccggtggctaacaacttgagttgtcttgttcacccttagttccctagagccttggcgcagtcttagccagcagtgggcgttccgtaaacacagtgggcgttccgtaaacacagtgggtgttccgtaaacacagtgggcgttccgtaaacatttgtggaatgagtccgttctggccggattctccatagttcttccccaaggatttcaagtggtgttttgatcatgctaggcgccaccaaacaagccgctggtgcttaattattgtatccatacctcctgacaattcctgctcactttgtcgtttctgtctttgcagtttcccttcttaagtgttaggattttcattttccattttcctttatataacccatttaaatcacgccttcatgtccaggttagatcattcattgttcatctccaggtctcattacagcacttttttttttttttttttttgagacagggtctcgctctgtcacccaggctggagtgcagtggtgccatctcagctcgctgcaacttctgccccgccaggttcaggcgattctcctgcctcagcctcccgagtagctgagaatacgggcacatgctaccatgcccagctaatttttgtgtttttagtagagactggtttccccatgtttctcaggctaatcttgaactcgtgacttcaggtgatccccctgcctcagcctcccaaagtgctgggattacaggcatgagcccggtcagcccttttttttttttttttaaagacctcattagtcttaggagtaatacgctttctctgttcttctacattcatttcactagtcttactttagaatgtctcaattcttgtttataatatttctgattttcactgtgcactgaaactgttgaggcagtgtgctccaaacttgttgctttctgcaaagttagccgactttaagatgttctcctcttttgtagactctttaaaggtgggtgcagaatctgtatgggagttccaaatctcttttgtgcttcatgccaattagctgcagttttactacctttgtctttagttggatttgttacttcactgacagcagagttggctcctgcgtggtggaggtgccgtcggtgcctgagactgtgttgtgatgtggctgcctgaatgttccttggagaataggtttgagattttcaccctgagacacccctagctctagtattgaaagatttcaaatgagagatgattgtcagtttgctttgctgcccttgtaacattttgtctaatcactgttggtccgttgttttggcagtatcctgaatgatttttctgaacaagtccaagactgaatatggggatagtgtaaaacaaagatcaggaagaagaaatatggatgcagaattatgacaaatgaagaagtcctaagcagcattgctcattgccatttctagtgttttggtatacagagtcagagagttttcaaaaagtggagtatggcggttttttctacggctaaatttagccattgctttggaaaatcagagtggtacagcttgtgcctcatctccacccggcccttacccttccctctgcacttggacatcttaaacggcttgccagggaggagcagcttaatatactctcgtggcaccatttattctgggagggaattaagtgacttcattttccctgtccttctgagcttcctaaaaaatttaggagacttcctaagcagcgctcacagtgctctacagaaatagttgcaggcatgcctcctttgcctcctcagctctccctgccagggcagccaagggctgtaagtggaatgagagatggatggcagtgggagagcacatgtgcacttgagctacaaataacgtgttttaaaatagcagatggtatttgacgattgcttcttcattcacttacctgccaaggcaaaactttttcttctcctctggcaacaagacctgagatggctcagctcagcagttgtaataacaagttctcacgtttgccgatattattcattagctgatgtgcaggcattcatattcatggacgctttctggggctgttctagaaagtgttccttttgtttaacccgatcgaaacctcatgtttatacaacagttgaacctggctgacttgttaaacaccttggtaactaacgaaagccactcctttcattgaggggcgctgccagtcatttgtattccaaatagtccatttttctcttgaaaagggggaacatctcaaagttaggggttgggtggttttttttgtttgtttgtttgttttgtttttgaggcagagtctcactttgtcgcccaggctggagtgcagtggtgcaatctcggctcattgcaacctccctctcccaggttcaagcaattctcctgcctcagcctcctgagtggctaggactacaggcacctaccaccatgcctggctaaattttgtatttttagtagagacggggttcaccacattggccaggctggtctcaaactcctgacctcaagtgatctgcctgcctcagcctcctaaagtgctgggattacaggcgtgagccaccaggccaaagttagggtttggtatttttcatgagaaactcagtggctatagaaaagtgacactgctgggaagttccagtgtgtgcctgtgaagaagtcacctcatacccagccttgcttccagagtcttcactgtagctgcgtggtttccttccctgagcttaaagcagatggcagccagccgggcagacacttgctttccaagtcagctctgctggccttggatcactttgaccatcctctcttgcccctggacaggtgataaagctgctcactggtatatgagccacctggactgcacctggggagcggaggctgctcagggttcttgccccagagtttggatgacctcatcaataaataggctcccaggagcttaaattagaaaataatcctttccacatgcactcactttctgaatggtgctagggatacaagacaaggtccctgctttcaaaaagctcacattctagcctctagcaggaatgacacctaggaaaagaactatcccttcattggctcagtactgttaggacccagggcaaaatgtggaaggtttaccaggcatagcagaaagaacactggtctggagtccagtctgtgttcaaatctctgccctgatacttacaagtggtatgctcttgggtaagtaacaaattttcttagcatcagcttcctcatccgaaaatgaaggggaaaatctttatttcagagtcattttgaggattagacataatccatgtaaaatgtctggcttactgtagatgtccagtagctgctattattattattaataatattggagtgatgtctgagccacactctgaagagttaagaagttcaccaggtggatgaggagaaaggttggcctcggcagaggcccagaggtaagtaaaattcctggtcgtgagccaggaattttggagaacattgagttatgagagaaccctagaaacgtagcctgggatggttggtaaagaacagtccattctgtgtcacaacaaagagtttacattttattttgtatgttcaggaggagggatttattttaccttatttttatttatttatttttttgagacagagtctcactccatcgcccaggctggagtgcagtgtatttttattagagatggggtttcgccatgttggccaggctggtcttgaactcccgacctcaggtgatccgcccacctcagcctcccacagtgttgggattacaagtgtgagccaccacgcccagacagaggagggacttaattttttaaactaaattatctgataaaatatcaggaaccatctcctggtgtattgctcagtacaaccaggaaaattgattagatttgaagattgaaagtgagttgtgtaaaatccagaggaagcagtaggtgctgctggggcctgagggcctgggaaatctggctaggagctggtttcctggcatagacactttctcactcacagcagacgcccagacactcgggattctccacttttacagcagcaaatcccagcccttctaaacttagaacacactgtgggtgtctgatttcatgaaattgtctctgtctttaaaacattgctaaggaattttaaacatttaaatgaatattaatttgggacattttaaagtgagtccctttgaaggttaggaacccctgtcagagaaagaggaaaagatgtcccatgactgtgctgtgtgacacttcgtggaacagctgtgatggagaggctaggatggggtcgacccagcaaaagaaaagggaatctgaagccccaactaaccattccttgacccttgggccattgtttggaagagttttttcatcttcttcttgatcgttgtaatactcaaagctattctgggattatgagtctatttctatttatacttatgctttctaatattgttggaaactaagaattgaagtataataaggtaaatgaatatactactatactataacctatgcttatacttttgagatacaggagttaaacctgaaggtctcttttttttttagtttaatatatcaataaggtttcttttcagcatttcatttatcggtttattacagctaggtaacacacacagttactttcatcatcatttgatctatttttaaaatgccagctgggcatggtggctcatgcctgtaattgcagcactttggaaggctgaggcaggcaggaggatagcttgaggccaggagttcaggaccagtctgggcaacatagcaagaccgcagctctaaaaaaaaataccctcagaaggctctaataaacactgcagtgctatagtagacacagagacatcagtaggaactcatgtttacattagtgtgtatacaggtagatatatacatatatacgtatatttcctagctttcccatcgagaaggcctagaagcagtgatacctcaatagcaatgaacgctcagcacccagatgttcatttctaaataccgttctccaataaaaagaaccaaagctccactccttagagaaatggacagttctaggattggcacaggggaaatgagagatgaatctggagcatcttgtaatgccagaaaggaaggaagtgctaaaaggaagaaaaaaggatgagggcacgtcagaggggcataagggtcagccggaaagagctcctgatggccaaagctggaacacttggagcaacaaaataaataacagtatcagattgtgacccaaagtttagaataaatgtacaggagtccatactgatataaataagtgattgactaaatacataaataaataaggacaaatcttccttacaggagaactccaaataatatatgtagatactcccccgtctgcgaggtggaacttagttaccctcttgttgttgggactggacttagtgacttagttccaaagaacggaaagagaaaaattgtaacttcacagtacagcaatgtagcaaacattgccttaaccaaatgatggaggctgacctctccaggacatcattatacctctgattgtatgtgatgagcagggtgcctcacctctgatactcttcctaaaaacccagaacccagtctaagggttagaaaacaccaggcaaacctaaattgagggatgtctccaaaatacctgaccagtattcttcaaaactgttaaatttttgtttggagatagagtttcactctgtcacccagactggcaggctggagttcagtggtgtgatctcagctcactgcaacctctgcctcctgggttcaagtaactctcctgcctcaatctcccaagtagctgggattacaggtgcccaccaccacacccggctaatttttgtatttttagtagagatgggtttcaccatgttggccaggctagtctcaaattcctgacctcaggtgatccaccggcctcagcctcccaaagtgctgggattacaggcgcgagccactgcgcccggcctaaaactgttaaaatcttgaaaagtaaaggaatatggagaaactgtcacagatccaaggacactaaggagacttcaaaactaaacacaatgcgggatcctgggttagatcctggaacagaaaaaggacattcatggaaaaagtgctaaaatcggtttcaagtctttaatttagttaatagctctaatataccaatactagtttcttagttttgacaaatgtgccatggttacataagataccatgttagaggaaactgagtgaggggcatatgggaactctacgatctttgcaacttatctgtaaatctaaaattactcgaaaaaatgtttaattttttaaccatgctcccatagatggggctgggcagaaggccccagtctactagctcaggcataagagagtcatattccttcaaaagattgcatgtatgggccgggcgcggtggctcacgcctgtaatcctagcactttgggaggctgaggtgggcagatcacgaagtcaggagattgagaccatcctggctaacatggtgaaactccatcaatacaaaaaattagccaggtgtggtggctcatgcctgtagtcccagctactcgggaggctgaggcaggagaatggcatgaacccaggaggcggaggttgcagtgagccgagatcgcactactgcactccagcctgggcaacagagcgagactctcaaaaaaaaaaaaaaaaaaagatcgcatgtattagtttatttcatcctcacaaacaagaagggatatgtatataaatatccccattttacagatgagaaaattgaggtgcaaagtgggaatcatttttccaaagtcacacagtgacaggattaaacctggggctcttatttctactccagtgttctttgcactgtctcagagctgcccaggctgaaactgctgcttccacaaaaaaggagcacagggagaagaggttcatgaagagaagctttgaatgaatcaggagccggacggttgctatgaaagccgtcagaatgattgagtttttgtccggggatttacatgcgcgtgcatgtctggaaggtagcgggaaggaactactgcatgaaggtgaatgtatccttcctcattccctggaacctttcaggaaaatagactgctttagagaaacacgagaggcggagacagacacctggaaagacagcccatgttgtcagctgagtaaaggacaaagtaataaagaggtcagatgcaatgggaatggtagaggagtacttgatccgttgcagacagcagtgcaggtggctgggttttaaatcgttttcgagtatcgcctggtctgagttggggtgcttgagaagaaaatgtgcacccagttattgtcaacagagctactgcggatggctctggcatggttcacatgaggtgatgcctcacatacccatgctgggtaggaatctctgcttctgtttgagcaggtggttctgggatcattcttaacaggcacttgggtggaggagagaggagtcattctttcactgtggaaacaggccagggtcttagggcagcggttcttgaaatgtggccctagaccagaagcatcagaactgcctgggaccttgttagcaatgcagcctctgggtctcactcagacccactggaccaaaactctgggaatagggcccagcagtctgtcttaagaagccctcctaaagtttgagaacctctggtctagaggaatggtcactgggatgagcagaagccgccatctagggcagcacacagcctccagccaggaacaggcgggtgggtcacacacacagactcacagcctccagccaggaacaggcgggtgggtcacacacagactcacagcacacggcctctagccgggaacaggcaggtgggtcacgcacggagagtctgccactggaagggaagctgagactcacacccagaggttctgcaccagaagtaagacatcattcagagctcactttgcctgagtctttagatccaggagttatgggacttacccagaggggttaagagttggggaacctcagcccagttgacactttattttgtatcatttgatacttccttgtctgtcaaaggatttttttttgcttttgccttttcctactctgccctgctcttccatgccctcagaaagtttatagtttcgctggggaggacatggctgatagctcagtgtagttctggatctaacattcacctatacaccccgcaggatacaaactatatgtatttatttatagcctcctatgtggccacaaaagtttggtcattgttcccacttgaaggtagggtatcattgcaactaacttttgtgaggtttgtattgatacctagaaggctctaagtaggtggctctttatactgttttttactgaagcatgtatgtgtagaaatgttatgtaaatttttattttcttgggtaaaatgcttaggatggtggtgtctgtctctgggttatgcgtctgtcatcctcatgtcttcaacaggaggccagcctgtgttactagaaacaggcctctgtgcacctcttttctgtacccttgcccagagttcactcgctgcagcaaatatagagtgcctgttctgtgatgaagcaggaacttgttcttccggtgcgacggatatagcctaatatttcaggataagaactaaaaatctcagaaccgccaggcaggaagtggagctagagcagctggctttctttgcggggacctctggagcctcctgtggccttgagccacctctgagcctcatgtgcccatggaaacttgcacttgtaactttccttctgtgcagaattttctcccgatggagtagttcagctgcttcacttggactgtcctaaggacatccacttggaagccctcaaagctcaccctgttgtctttgtttgaagcatcatgggtaagaactaggaccaaactcatcagctccctaaatctacgcattattcctactcccctttctctgccttgtattaatttttttttttttttttttgagacagagtctcgctctgtcgcctagggtggagtgcagtggcgcgatctcggctcactgcaagctccgcctcctgggttcacgccattctcctgcctcagcctcctgagtagctggaactacaggcgcccgccaccacacccggctaattttttgtatttttagtagagacggggtttcaccgtgttagccaggatggtctggatctcctgatcttgtgatccacctgcctcggtctcccaaagtgctgggattacaggcgtgagccaccgcgcccagcctctgctttgtattaatttaaaactccaggtttgttcgggctgcagaaattatctgttggtcgacaaaagagggcaaggatattttcactgctgttctaagtactccctactgcctggtgcatacatagtaggtgctccagtgaatatttgtgcatgaataagtgaatctttcaaatgtacttatttactctaatgtaatcagaaattcttctttgcttctaagtaattgtattccctatatcccgtaatcacacacagcatacagttaaagcaatgcacagctctcaatttgccaaatatttcacagtgttttaattatcctaataaagctgtaaaaccaaaacaagcgtaaaggcgttgcttttggcttgctagtgtggagatgtaaagaccatcattttatccatctaagccttacaacctcaagagctgggccctggccccgtgcagaggaaaggacatgtgaggagaaagtctctctgaacttgcatagcacagtgcaacagaccgcactccctgggtgccagctcagtcatttgcatttgagattggttttttattttaattatcactcgcttcccctttggaattgagaggctcagagatgccgttatgcatgatatgattttgttaagaggcacataattgcttctgagtattttcatgaggtgcttctcagagcagcttaatatcatgcactcatggcatagcaacagggaatgcagctggggaacaaaagctggtcacctctgtggcacacacagagtcactgtgactgttggaggggttgaccgggtgacgccgtgggcagggcctgactcagtgatgtcagggaaggtctgtttctgcagtgcccgtgcttggcggggggatgggcaggggacagctgatgcggggaccgcactgcagcacactgcagcacaaagccacctccacgggcagcaggcaggctcgctccaggctgaccacagctcagagagcacctttggtgcttttctgcccctttgtctgccaccggatgttgatcttggccactcagttgcagattggttccagagtgctctggaacaagtgaaatggatgctgaaaactcgttaaccagatgcaagatttgtagacttgcagaagaaatcacagatctgtggctatggaggtttaaaattcagtcaagtcatttcaatgggatgcataacgatctccaagtaggttccgagatcaatggttgtctggcttagcagcatcaggaataagcagaggagtttataatatcctgcaaagggcaactgccatgctgcttggaactgaactctaactgaagagtcaacttcttaggcttcacatggaagagacctgtgatctgcaagatttcagatttctaacaaagaggcatggcatctggagtaaagacaccagcgcaacctctgtagtcatcttgtgttttctgctggtggtcacaggatgagaacggccgtgtgcaggttaccccacacagtgtgtattcagagttacctccctgtgggaagttgccactgagtgagacacttagtggcaggatcctccaagtttgcctgtgtctgtccatccatagttgtgcaattggaaggaagacgttatttttcgctttaaaagaggaagtatctttcttgcattgttgttcctggaagtagtttattagaaattaatatgaggaatctttttttttcttttttttttgagacagagtctcactctgtcacccaggctggagtgcagtggtgccatctcggctcactgtaacctccacctcctgagttcaagcgattttcctgtatcagcctcctgagtagctgggactacaggcatacaccaccacacccagctagctttttttgtgtttttagtagagactgggtttcaccatgttggccaggctggtcttgaactcctgacctcaagtgatctgtctcagcctctcaaagtggtgggattacaggcgtgagccaccttgcctggccagaaaataatatcaagattcttaaaaagcaaccttcctcttgcttttgtgttttagtaaagtaaaatcagtttgatctgaagtgaggactgaactgctgactgggtattgactgtcttttgagtagagctaagctttctagagagtgagaatattgtctccttctggtaagactgcctcatgcctatgcatcttttcttcccatcacccttccttcttcttggcgtatctggttatactcccagccctggggccagacagatgggttatctccatgtgcctcagttttctcatctggaaaatgaggataataacaacacctacctcacgtgatggttgtgaagagtaaatgagttaatatctgcacagtgacgcagtggtgcctggtgtgcaggaagcattctgtgagtgctatctctgcctgttgttttctctcacatggaaccgtcgtacgctttgctcgctagtcttggaatttatagtcaggatggtaaggagtggtgataaaatatttcttctccagattatccctttgcatgattcagatgactgtattttgaaaatagttatgttctcaacagttggaggagaaatatgtggtcacagctgttcagtcagcttccacagacattgacttcatttgtctaaagatgatggtgatggcaagcatgctaacctaggatttatcatgttctgagcacttacatagattaacagccctctgaggtaggtgtaactactgtccccatttaagggttgaggaaacggaggcatgaaaggttttgttctaagttcaaagctacacagcttttatatggcagagccagggctctgcacagccattcactggtctgactcctgcacacctccagctctatcgtctcctgcgtctcctgctctccctccctctgtgctccagccacacggtcttctgctccctgaaagccctgcctcagggccttcgcatgtgctattaccaggcctcagttctggacatgtttggctctttctcatcattctgagcaaactcgaagtgtcacctttcctgacttgtctaaactctgtccccatcccatccctccttattacgttatcctgccttcttcacttaccaaggcctgcctgtgctagagtagggagagacctcccctcttcgctattgaatatctggcacagtgttccttaaaatttgtgaggtgtggccaggcacggggtttcagcctgtaatcccagcactttgggaggctgaggcgggcagatcacttgaggtcaggagttcaagaccagcctggccaacatggtgaaaccccgtctctactaaaaatacaaaaaagattagctgggcctggtggcatgtgcctgtagtcccagctacttgggtggctgagccaagataatcgcttaaactcaggaggcggaggttgcagtgagccaagatcatgccattgcactccagcctgggcaacagagtgagattccatctcaaagtctcaatctctctctctctctctctctatatatatatatatatatttaacatatatatgatatatatgtcataagcgtatatagatatacatatatgaagcgagcgtgggcatgattgattttaacatcgatttaactcctcttatgtacatggataggtgacccaattctaacatgtgtatgtttgtgtgtgcatgcacatgtgtgtgtaaatgcaggaatgtggagagacgtgttctaatcttagtaaagtggtacagaatcacaacgtgttttctctttgagtttcaatcctagctccaacagtaattcctgttgtttctctgatgtagaagtgaagtacctatttatgtttgtctccgatgagacatgggttaaaagaaatgtggggctgggcgcagtggttcatgcttgtaatcccagcagtttgggaggccgaggtgggcagatcacgaggtcaggagttcaagaccagcctggccaacgtagtgaaaccccgcctctactaaaaatacaaaaattagtgaggtgtggttgcaggcatctgtagtcccagctacttgggaggctgaggcaggagaatcactttaacccgggaggcagaggttacagtgagctgagattgcgccattgcactccagcctgggcgacaccatgacactctgtctcaaaaaaaaaaaaaaaagaaaagaaagaaatgtggctgagtacggtggttcacacctgtaatcccagcacttttgattccttgagcccaggagtttgagaccaacctgggcaacatggtgaaactccatctctacaaaacaaaaacaaaaacaaaaattagctgggcatggtggtgcacacctatggttccatctgctcgggaggctgagatgggaggatggcttgagcctgggaagtggaagttgcaaataagcctagatcacaccaatgcactccagtctgggcgacaacgtgagactgtctcaaaaaagggtgtaacagtctcaggcactgaatgatgctattcctgaaataaattataaaagctagagcttggctcaggaaataaaatttaaaacaatttttttttgtaaaaactcagtgttttggtaaaagatatactacctttttttttttttgtctaacataccttcctttcttgctgtgattgctttcttctactagtttaatttaaattgtatttatttattttacttgctctagagggctctctaccagatctcatgtcagggtttccgttggggaatttgacaaagaaactagggggcaggaacctgaacctctttttgatctttgacaaaaagagaatttctggtcttttatccgagaacttcgggctgctgaaggtgccaccatcctgtgtgaggtggtgacagattcacgatcgtgctggggaactctggctggcggagacctctctggtttggtgaagttacggacggcatttggatgctggtcccgcaaggctggcgaggccacgtgttgactgcttttcttccagaacacaacctcactcttcctcctgctctgccctagataaccagttcaggatgtccatcctggaacgactggagcagatggagaggaggatggccgagatgacggggtcccagcagcacaaacaggcgagcggaggcggcagcagtggaggcggcagcgggagcgggaatggagggagccaggcacaggtacgaggcggtgctgatgctcagctcccatttcgcttcatgtttatggattggcgaggcagtggatggatcacaggcctcttctctgctgctgatgcggtccctgtattcaggcagaaggcctgagggagtactttacggtacctgtgcttttaagcattataatctgtgcagtatggaagaagccttggaatgtggagcttctcagttgtttacccccctaatccttaagttatctctattaatctcagaattcactactaaattacagggcagtgggaattaaggacaaccaattgaaaaatagaggctggctgggcatggtggctcacgcctataatcccagcgctgtaggaggccaagacgggaggattgcttgagcccaggagttcacgaccagcctgagcaacatactgagaccctgtctctatagaaaaaaaaaattttttttaattagccaggcgtggtgggacatccctgtggtcccagctactcaggaggctgaagtgggaggatcacttgagcccgggaggttgaggctgcagtgagccatgatcactccactgcactctgacctggtcaacagaataagaccctgtctcaaaaagaagaagaagaaaaaaaaaggccagatggtgacttagacctgctagggttcagaattaatttagaatcttcctactttctattctgtattttatccctatcttaagtgtaggtataaaacataattgaattcagtaattcataagccttttataaactcaaggtcagtatgaaaagagcccagagaaagtgtttatgtaatgattcagtgtagaatgacattatacattacagcctctttcacaaactttctgtaagttccataaagaatgtatgatattgccaagtacgagtaaattaccaaacattgtttcagagtcccattggtcttgaaggctttatatacatttcatttaggaagttcatttttgggaagtctcccagggagaaattatttctcaggggaccctagagataaatttaaaggaactgatggtatttcttatctccactactcagtcgttgcaaaaaaaacctcaaataatgccccctctttctcttcaagacaaatgatgatttcctttacacagttaagtttttaggtgaatatttttggttttatgaacctcataaatatcaagtttagttatattttaaataataggttaaaagaacatcatatgccacacccaaaaggctagcctccttcctccccgtgttttcatattgctcccctgtcttcagaaatcagcaggaaagaaacaacttggcacgcagtagaatattattaaggctaagataggcttcttttttttctttttgacacgaagtcttgctctgtcgcccaggtgcagtgcagtgacacaatcttggctcactgcagcctccgcctccgaggttcaagcgattctccagcctcagcctcccaagtagctgggattacaggcatgggccaccacgcctggctaattttgtatttttagtagagacggggtttccccaccttggtcagactggtctcgaactcccaacctcaggtgatccgcctgcctcggcctcccaaagtgctgggattacagacataagccaccgtgcccggccgatagtactaagttttataaaagaagtaatcattgtttaatttacctcatggctcacataagagatctccttaaaatacttttcctttcaccaacaaaagtggcataaaaggaatggtatgtaatgtcattttaaagctcagccactacgcagctggctcaaacgctatgcaactggcctagaatctcatcccatgttaaccactactgaatatcctttcatcagtttaagttgccttcagtaaatgtccgtgtttgccatgcgggatagagacatgactgtttttgtttaatacaaaaaaaaaaaaattcccttttcgttcactctggccatttccatgtgctcatgaatgtgtcttgtgtgtgtagaatggctgtgccttggccttttgagtcaaggtcagtttgcggcatgttgggatcacctaactctgctcctgtaggtgtttttacagctttgatgaggctgagataacaatcccatcatctgccttttttattttgggaggcattttttccacatttaaaaataaaaatcagcgaggagccatagtatttctgtagtaagtaaagtttatggagtttattgccagaaaaaaaaagtactttttaagtaacaccagagatacaaattagcctagaggtgccatttatttgggggagtgttaaacataaaactgctatcacagagactcacataagctgttgaagttactaactttcattttatttttcttccattacaactggttcataggaagtaacccatgtggttaaaattagtaaacttctctttcctatagcccttattgttattaataacacttaaatttcaggatctctaaatgcttttctcagtattctttttactttacataaaggactggattattggatacttctagtcatttctttaaggaaaaaacagtccgcatctaagtgatctaattctccttcagaagaagcaagaggctgggcgcggtggctcatgccaggaacctagcacttgggaggctgaggcaggcagatcacttgagatcgggtgttcgagaccagcctggccaacatggtgaaaccctatctccgctaaaaatacaaaaattagctagaaattgcttgaacctaggaagcagaggttggaatgagccaagatcgtgccactgcactccagcctgggtgacagagcgagactctgtctcaaaaaaaaaaaaaaagaaaaaagaagaagaagaaagagagtgaaagagccgctatacccgccagtggaaacattaggaaagctactctgctccactgtctcacaacagtttactgcctacaggaaggctagaaccacttttttttgtttaaggctgtgtacactttccccaagacgaatcggcatgaagttcctaatcagagtgtcagccctaatagatagactcgtgtctgtagagctgtggacttcagagaagtgctactgagctgaagctaagcacattctagtctcaatttcatggatggttcttgggggtttgggttttttgttgttgttgttgttttttgagacaaggtcttgctctgtcacccaggctggaatgcagtggcgcgatcacagctcactgtagcctcaacctctccaggctcaggtgatcttcccacctcagcctcccgagtagctgggattacaggcacccaccaccacgcctggctaatttttgtatttttagtagagatggggttagggttagggttggccaggctggtctcgaactcctgaccacaagagatctgcccgcctcagcctcccaaagtgctgggatttcaggcatgagccactgtgcgcagcctaaattttgtactttttgtagagacagggtctcaccatgttgcccaggctggtctcaaactcccgagcaatcctcccacctcggcctcccaaagtgctaggatttcaggcatgatccagcatgcccagccaatgtttctttattttcagtgttttatgttttccgttgtgagtttctaatcgtaaagcatttgtttcccctacatcgaagcgctgatggggtcgagggcctttagtcctgaggtcgtaacgtgcgcttttttgtgacagtgtgcttctgggactggggccttggggagctgctttgagagccgtgtggtcgtggtatgcgagaagatgatgagccgagcctgctgggcgaagtccaagcacttgatccactcaaagactttccgcggaatgaccctactccacctggccgctgcccagggctatgccaccctaatccagaccctcatcaaatggcggtaaggctgtggtgcagctggctgggggtcagcctcgcacatcctcgctcacattcttcctgagcactgccacccgtggaagaaatctacccattcagtccactttatagccggcgagcaaagggctttgtccttggacagtttccaagggagttttataaacttcttcccaagaaatacccagagagataagaattaaatgttggacttgtcattttctttggacccctagccaaatggagcgtccacactgccctgggactctgtttcttcaccatggggatgttatatacccagttgggtttcatcttggtggggttttataatattctggtgtttccttttaacggtggtgaatagtgtggtaatttctggtgctctcccttatagtacaaagcacgcggatagcattgacctggaactggaagttgaccccttgaatgtggaccacttctcctgtactcctctggtaaggaatggattcctgtagcccccccttgctgttcttccagtctggcataggatttgcctggttcccaccgttgtctcttgctgacacatggcatgtttcggagatactttgggatgggaatcttcaatggccccaccgagattgccagcaaggaccagtttgtcagttggcagcaatggcaaaagtcaggtctggtcttgacctctgattgagaacgcttgctgtgtctccctgtcttctagatgtgggcgtgtgccctagggcacttggaagctgccgtcgtgctgtacaagtgggaccgtcgggccatctcgattcccgactctctaggaaggctgcctttgggaattgccaggtcacggggtcatgtgaaattagcagagtgtctggagcacctgcagagagatgagcaggctcagctgggacagaaccccagaatccactgtcctgcaagcgaagagcccagcacagagagctggatggcccagtggcacagcgaagccatcagctctccagaaatacccaagggagtcactgttattgcaagcaccaacccaggtaagaattcagaatcatgacatctcagagcttgacagagatcccgtttgctttcatgcagctgccctcagcagagtccataggatagtcacatacatttcagtttttttgttaatgtttctgatttttctttaagaatgcctagtgctgccccctcccccagtacagaagaaagtagcaaaaattctatgttcatgcaagaaatacataattttggaggaggaagatctgaatctggtgtatgctactggggatatttaaatgttagggacgtgtcttgagttccggctttgcactttgtgtctctcaggcatagagaaagtgttgattcttgaggattcctagttgtatctcctgtcctgactatcctttctactgtacttttcagagctgagaagacctcgttctgaaccctctaattactacagcagtgagagccacaaagattatccggctcccaaaaagcataaattgaaccctgagtacttccagacaaggcaggagaagctgcttcccactgcactgagtctggaagagccaaatatcaggaagcaaagccctagttctaagcagtctgtccccgagacactcagccccagtgaaggagtgagggacttcagccgggaactctcccctcccactccagagactgcagcatttcaagcctctggatctcagcctgtaggaaagtggaattccaaagatctttacattggtgtgtctacagtacaggtgactggaaatccgaaggggaccagtgtaggaaaggaggcagcaccttcacaggtgcgtccacgggaaccaatgagtgtcctgatgatggctaacagagaggtggtgaatacagagctggggtcctaccgtgatagtgcagaaaatgaagaatgcggccagcccatggatgacatacaggtaaaaagcagggacagggtaagcccgcagaggctggtgcgttccagttgctgtgatctttatggtccatttccgaaggttgtgtcattttcctccccgtgaagccttcgaagttggctttgtgcagaacatcgttggagtatcttctttccttggggccacattttcattcggtgaatcgggcaccgggagtagggcctgaataccagtgaccccggtctcagcaaagccttccctctttgtaccaacttctcagaactcactgaggaccctacagtacgtcatctgcttcctccttgcatttaggttgattgatttcactgttttaagtactagttactagttagaatatagtcaagacctaaaaatagctagaacaggaagcccgtggatagattttgaattatctgagtgaccttgatcggcatagctatcatctagccattgtaaagggcatatatggcgtgaggctctcacgagggcagcgaaatattcctgaagctgataattgattgcccttataataaatctaaaaattccagaatcttttcaggaccttaaacttgttatggactaagagaatatataccaaaataaacttgacattaggctaataagcaaattccatctattaaaatatgtaggggaggaccataagggcagcctaaaaacatgtttgaattcctctctttccaacttcccattgatgcaacctaaaacaaacgtaaaagggaaaaaaaacgactcagaattcaacagggcacccatgcctgtagaagtgatacaaggagagggaggtgtgtggaggagatcatatgtcctggtcagcatatcttgggagaggcctgatttctgagccattcctgctcattgcatcccagggaccccttcatgccagccctctgctgtttgcagaggatgagaaagaagcttgcatgctcaccaatgtgttcccatttctggggagttgccgggggcaccacttctgacctaccgtattagtccattctcacgctgctgataaggacatactccagactggggaatttataaagaaaaagaggtttaatggacttacagttccacgtggttggggaggcctcacaatcatagcagaaggcgaaagtcacatcttatatggtggcaggcaagagagaatgagagccgagtgaaaggggaaaccccttataaaaccatcagatctcaagagccttcttcactaccacgagaacagtatggaggaaaccacccccgtgattcagttatctcccactgggtccctcccacaatacgtgggcattatgggagctacagttcaagattagatttgggtagggacacagccaaaccatgtcacctactgaccaccgcagtttccctaccacaacacatgggaattatgggagctacaattcaagatgagatttcggtgaggacagccaaaccatatcacctaccgaccactgcagtttccctaccacaacacatgggaattatgggagctacagttcaacatgaaatttgggtggggacacagtcaaaccatatcacctaccgaccactgcagtttccctaccacaacacatgggaattatgggagctacagttcaacatgagattttggtggggacacagccaaaccatatcacctaccaaccactgcagtcatagggaggactgcccagaaaaatcaaataatgttttagacaagagtctggtacatttcttctataaagagccaagtagtgaatatttttaggttctgtaggccatacagactttgtcctagctacttaatcggccctaacagcaccaaagcagccttagcattaaacggaggagtgtggctgtttcctagtaaaactttatttacataaacaggcagctggctgaattcagcctgccatcatttgccaaatcctgttttacacaattcctgatggaacccacaccagacaccaaaactgagcaatctagaactatataaacataaatatctaggaataagttagattacatcgaaaatcagcagctcaaaagaggggaaccaactgagcatcgagaacagtaccatccactagaccttcccacagtggtggacgtgccttctatccataccacgcaccgtgggagacacttggtgccacatgtggaatcgggcacttgatcagcatggctgtcatctagctattgtaaagggcatatgtatgaaatatagccagtgcaactcaggaactgggtttctaattttatttaagtttaaatagccattggatagagcagctttttgaaagtggccttcactgaaacagagttcatgcaggaaatagaaaataacctttaaaaaatccacttcctattttcacagatctgttagagaataacatcttgccaaattaagagcatgtgtctatgaaaaaagcagcagtctaaagaaagttttttagccaaatgagaagataacacttaaaaataatgaaataattttagaaaaagtggcaaaaccgttcatagaggagtgaacaatcaaacagtaaaactgagcaattatcgatagtgtggtatatgtgagaggaatttgttaggaagggactctttaaatagaagacgaataatgtttaaactatctcctagaactaaaattctaaattattttaacaaaaccagggagtgtagggaaatgaagagagtaaaagtgtatgaaagctctcgggttcagggacagtaacagattttgttccactcgtgatatagatagatgtgcgctggataggctgaaatatgctagttagaaatgttggccgggcgcggtggctcacacctgtaatcccagcactttgggaggccgaggcgggcggatcacgaggtcaggagatcaagaccatcctggctaacacggtgaaaccccgtctctactaaaaatataaaaaattagccaggcatggtggcgggcacctgtagtcccagtactcgggaggctgagtcagaagaatggcgtgaacccaggaggcagagcttgcagctagccgacatcgcaccactgcactccagcctgggcgacagagcgagactctctctcaaaaaaaaaaaaatgttaagttggtaggtagcataaaaacgggctacagaaggacaggtgcggtggctcatgcctgtattcttagcattttgggaggccaaggtgggaggatcacctgagttcaggagttcgagaccagcctggccaacatggtgaaactccgtctctactaaaaatacaaaaattagccaggtgtgttggcaggtccctgtaatcccagctactcgggaggctgaggcacaagaattgcttgaaccctggaggtggaggttttgctgtgttagccaggatggtctcgatctcctgaccttgtgatctgcctgcctccacctcccaaagtgctgggattacaggtgtgagccaccatgcccggcctcgggttgtttttttttttttttttaaataaaagcaggatatactatatgctacttgtaagaaatacaatcaaaatgaaatgaaagagaaacaatgaaaatgaaatgatagataacagctataatagataaacgagtataaaaagaaagataaaaagtacaattcaaggcaaattaatgtgtgtgtgtatatatacatatatatatacatacagtttatctagaagatatgacagttataaactattgtgtacctagcaccataaccttgaaacattacagcaaatactagtaaatacaaagaaatgtggacccataatcacagtgtgctactaacacacatagctcagaatttttcagatcaagtagatatgaaaagcatatgaacaagttgaacaacaaaatcagaaggcttgatttcatatatatttactatatgatagatttaatatatgatatacttatatataactatatgtgtgtatgtagttaatacacatagcaactacgtatataattgttcttttcaggtgtccaaggcatgtttatgaaaactgctcatatactaggacacgaagaaaatttgaataaaaatccaaagctacccatttaaaggccgtcttctctgagcacaatccatgaaatttagaaatgagtgacgtgacttttcaggtccaactactgagaacgttacttaagatgtttttacattgttacatgtttataaaatggaggatttaggaaagtgattgtagagtgataaccttttaggcttcagaaattccaccttacttttaatatatttgaatactttcatggaaaaagaataaagcaagatttacttcctaccgtttgagtcacaaatcaagacggccaatagagaaggtgaaagaaagctgcaatttttttttgagacagagtcttgctatgtcacccaggctggagtgcggtggtgccatcttggctcactgcaacttccatctcctgggttcaagcaattctcctgccttggcctctctagtatctgggattacagatactgtaagaaagcactaggcctgcaccaccatatctggctaattttgggggtttttttgggtagagacagggtttcgccatattgcccaggctgggcttgaactcctgagctcaggcgatccacccgcctcggcctcacaaaagtgctgagattacaggcctgagccaccacgcctggcccaatatatttttcttaaattttttatttttattgttattacaaaaacgaattgttctttgatgaaaatttataaaattatccacaataagcatttttaacagctttattgaggtataatttacgtatgataaaaaatttataaaattatccacaataagcatttttaacagctttattgaggtataatttacgtatgataaaatttacccattttaaatgctcaggggatggcttctagtaaacatatacagctgagcaaccatcaccatagtccctttctagaacacttccatctcactgcacggtgccctgtgcccatctgcagtccgtctctgcccagccttaggcaaccactgatctgattctatccccagaggtttgctttttctagacatttcatgtaagtggaatcatgcaccatgcagcccactgcggctgtttccacttagcaggatgttgttgaggctccttcgtgttggcaggagaagcattttgtcactttgtatagttccatcgagaacattttcagttcacttaagaacccgaagtgctgtgtttcagttaccactcctaagaggtatgcaaggacatttttaagaatcagtccacatctctgattctcataaagaatatcttaatccagaccagctttgaggattctttttttcttttcttttcttttttttttctgagacggagtcttactctgtcgcccaggctggagtgcagtggcgcgatcttggcttactgcaagctccacctcccaggttcatgccattctcctgcctcagcctcccgagtagctggcactacaggcgcccgccaccacgcccagctaattttttgtattttttaatagagacggggtttcaccgtgttagccaggatggtcttaatctcctgacctcgtgatccgccagccttggcctcccaaagtgctgggattacaggcgtgagccactgcgcctggcctctttttttttttttttttttttgagttggagtctcgcgctgtcgcccaggctggagtgcagtggcgcgatcttggttcactgcaacctccacctcccaggtttaagtgattctcctgcctcagcctcccacgtagctgggattataggcaagcaccaccatacctggctaatttttgtatttttagtagggacagggtttcatcatgttggccaggatggtctggaactcctgacctcaagtgatccacccacctcggcctcccaaagtgctgggattacaggcatgagccactgttcccagcctagaccggggttctctaggccagacaaaagggggtggttagatattggttatgtaactaatagtgacacctcattaatattacaggttactctagaactgcccagtgtcattaattggttgaccctgagagtagggagtacatacaagccagaagttctccaagactggactaaaggtttggggccagactatgacttggagataatcaggtctcaggatctcagcacattttggtgtgttatgttataaccttaaaatggtatttcattgcattggattgaggtggaagtctgccctcctgcctgattatttttttctctccaaggcgaggcagggaggtagacctggataacttgtaaggttcctttctaacctgagtgttctgtgaacttctgacttcaggtgaacatgatgaccttggcagaacacattattgaagccacacctgaccgaatcaagcaggagaattttgtgcccatggagtcctcaggattggaaagaacagaccctgccaccattagcagtacaatgagctggctggccagttatctagcggatgctgactgccttcccagtgctgcccagatccggtgagtaaagttacggaggtcactacccagcatagattcccggatgtaattggaggcaggggaggctgattgtatttgatgaatgccgtgtcatagaagaccataccaaggaaggaaggaagcatgaggacaagctctgttgccactttcaaggcccagctcctattcctacctctcccattattttttttactgctatcagagcataagagatcgtgttaagctgggcgcggtggctcatgcctgtaatcccagcacttttgggaggccaaggcgggtggatcacctgaggtcaggagtttgagaccagcctggccaacatggtaaaaccccgtctctactaaaaatacaaaattagccgggcatggtgataggcgcctgtaatcccagctacttgggaggctgaggcaggagaattgcttgaacccaagaggcggaggttacaatcagctgagattgcaccactgcaccccagtctgcgcaacagagcaagattctgtctcaaaaaaaagaaaaaaaagagagataatgtagcataatgtttccccctaattcagctgaagttttctaatggcagtagagtgtactgctactaggttttagtatttagcatagtactaaagttatgataggtgttgagtataaacttactcaatcgaaggacactgggtatgtttagcaacttgcctaactgaatgaaggcatgttcctaattgcccacagtggcttctggcagataccatcttggctcattcattaatatctaatgggtggtgcaaatcaatcattaatctgtctctcctttttctcctcttgtttcagaagtgcatataacgagcctctaaccccttcttctaataccagcttgagccctgttggctctcccgtcagtgaaatcgctttcgagaaacctaaccttccctccgccgcggattggtcagaattcctgagtgcatctaccagtgagaaggtagagaatgagtttgctcagctcactctgtctgatcatgaacagagagaactctatgaggctgccaggcttgtccagacagctttccggaaatacaaggtaaactagaacagaaccttcgttttgtgacattcttaagatcagagaggacagatgaaagtcagaatcatgcgaacaaaaacatttactatttctttttttcctctgaatttgtagaatttttttggaagtctccaatttattaagattcactatataacatatctgtgtgtgtatctgctttgtaaaaatattttatggtaaaatattcataacataaagtttgccattttgtctgttttaaagtgtgcagtgtgggggcattaagtatattcacagtgctgtgcaactgtcactgctacccatttccagagctttctcattctcccaaaccatttgcttttaacaaccaatttttaaacagttaaacatgaaatttttatcaaatgtttacaaagttcctaaagcaccttcatagaagagtttcagaagcgtagtcttctcagttatctgaggcatagagaataactggctgggacaagggcccatccatggttaggccagggcgggaatggggcttttccggcacagaacaatgctgatttttctttttctttttttgaaatggagtctcattctgttgccaaggctggagaagtgcagtggtgcaatctctgctcactgcaacctccacctcccaattcaggtgattctcctgcctcagcctcccaagtagctggaattactggcgcgtgccaccacacccgcctaattcttgtatttttagtagagacaggttttcacaatgttggccaggctggtctcgaactcttaacctcaagtgatccgcctgccttggcctcccaaagtgctgggattacaggcatgagccaccgcacccagccttgattttcctattctaccttgccatcctgagtacaatgtctctttattattccttaaaacaaatttcatgagttcatagaatttttaattaaagttattaatgtcacattaaataattctcagaagctttagtaaaataatgttagccaataatgtaatggttatcaccatgtcaacatactgttggtaatgataatgcgtattattcagttaatataaagtaaggtgacccctctgctgctaggaggtcgtgacctaaagcaggggttttcaactggaggcctgggggctgactccaggcagcccctgaactcctaaaattaagcagtaaagctttttctgtgtgcatttttggtgggaaggggacccatggctttctacagattctcaaagtagtctctaaccactcccaaaaaagtgttaaaagccattaatcattgatccaaaagtaaagtagttggggttatcttaggaaagatagttgagatctggcaagacaaacagtacaatgcctaatttgttaaatactttaaaagggaatatatttttagtctgcttaacattccaatatcatagttttatttagaagcaaggatagtctaaggtttattctataaattcatttttcctcatttataattaattatcaatattttttggtaaacctgggatctcaactctgagaaggtgcattaaatgagtagtaataaaaagctgacatttctggtagttaatcattactgattttttttctccttactttacccttaagggccgacccttgcgggaacagcaagaagtagctgctgctgttattcagcgttgttacagaaaatataaacaggtaaacctcagttttgcaccacagaaggaaactgtgccccacccaaggccactgaagatcctggtttggctaaagagcactacatctagtacctcattacagagacttaatttgttttttggttgtttttttttttttattttttttttgaaacggagtctggctgtgtcgcccaggctggagtgcagtggcatgatctgggctcactgcaacctccacctcccaggttcaagcgattctcctgcctcagcctcccgagtagctgggactacaggcgtgtgctaccatgcccagctgatttttctagttttagtagagtcggggtttcaccatgttgccaggctggtcttgaactcctgacctcaagtgatctgcccgccttggcctcccaaagtgctgggattacaagcatgagccgcagcgcccggccagagacttaatttgaactgccatgataaaacaaacaaacaaacaaacaaacaaacaaacaaaaacaggggaagccacacatgatggcgtgtgcctgtaatcccagctcctcaagaggctgaggccggaggatcttcttgaacccaggtgttgatgtccagcttggacctcgtctcaaaaaaaaaccagaggaaaacaaaataaaaccatctgcaattagacttgtaccgcaaaagggtttttgtccaaatttttgatcttttagtaatattacctacctgagatactggtctgatcctaacaccagtatctttgcagtgaggatccgtggtccaatactttgataaactccctagtaattagagaactgtagggaatccagggtgtgataccgtgattggagaaagtaaatgctggctatttattacctttgagtttgaattatataaggtatttaatctttggccattttcctttcagcttcttatccattttaaaatgaagaattgttaaaatctttgaaaatcagaagaagctcagaacatcttaaactgcttttgtgcaccttagttaaaggtgcaagaagattatctaagtactctttcatgcagtatttctgtttgcaaaccaccttgtagggttatgtaactagtcagatgggaaagggaagtcatatttttggggcagctagtatgcactagattttttaggtgccccatctcatttcctttttacaattatttgaagtaagcagtatttatttccagtttacagatgaagaagctgaagctcagagaaattacatgaatattaggcctttctcattatcaaggtggttataaaatattaaaaattgcctaatggagttttgactggttcacacgataaaattcaggcctgtcagtagattcgagaaccttttatcagattgtgctttaggtagttataaatttttatttaaggaataataaattctaatatgtgtaatggtcacatagaaattagggattctatcaccttgtcataatccaggacttgcctcaatttctgatatgggttgccgtttcctcaagcttctctaggattaagccctattaatgggggtggggggacgtctttggcttcgagccagttgagttcatgatcccagaaaaggaaggtttattgtgcaaacgctgacaccacagtgcctgtagctctatagcagggagccgcactggcttctgtttggtgagcaggcttcctgggagcacaagtgatacacagaatgaaggtttcaagtctgtgattacaacaggtattgattccaaaatatgagtttggttttttaaaaaaaaaaaccctccccagaaactgtcatctacagctaggaagacagaaggcattatttttggaaagagtaacaactataaaacaaatattttggaagatggaaggcattaatatagccaggttgccttttttttttttcttggttgggagttttattgattctggtttttaatttcattatattcagcaatgtaacattaatcttgtattttctgtttttcccccaagctgacatggatagccttgaaggtaatgatacacccaagccctctcacaaaccattccaccagagtcacaaacttcacacccatcaccagctacagggagggccattaagatggcacagtcatggagtaaacatatcccccttgccaggccacctaagcacagttcctctgtcgtctggggaccacgtggttattcagctggagtgggtttcgacattaataactggacattttttggctggtgttaatccatctaagccagttcctgtgagccctgtggccactaagtaaataccctttttcccaaagcgcttcactgtggcccgatgggtctgagtgtgtagtgtgcacaggtggagacgatggaaaccacaggggctctgtagtctgcagcattcttgtcttcaaagactttcagaccagtgaaaaggtaaagcaggtcagataagaccaaagaaggttcttgcagaagggtcctggttcttggacaattctgagaagtcagtttccctccctcatttcacctcctcatacatccagagatacagttaggcagatacagggattttctggggaatatttttccttgcgacggtaagttgccgtcttataagcaaagggcttcattgcaacttctcatccccagagtcatactctgtttgattagaaatttggacgtagcattttaagaccatggagagctctgtatttttagtgcctagagactgatgttgagaattcaccctgggccttcgtccctcacttctgtagctctgcagcgggctgcgtggaggactcctggcactgcctcctgggtcgtccgcagctctgtgacagccgtccaggtttcacggcttcaccaccgtgttggtcttacgagtgttcatcttttacaggttaaaatggcttaaaggtgtcagcgtttcatgataagccttgtatttgggaccttgcaactcagtcagaaacttgtcgtgtggaatgatagttaaaaatcagaggctgaatgctaagtagatttgtgtatggtgggaattggaaggcataaaaaaattatgttagtgtttcaaaactggatagaaaatattaatccgaagcatttaaaattttactgtcgaaatctgtttttagattcataaacgtctaagggtattgctattaaaatttttctccaagaagggcaagatattttgatattttagggaaaaaatatatgtctgaaggcaacccttaaagtaatattttacattttggaaaggtaggtgtaaagattcctcatttgcctcttttgtgattaaaccccggacagagaatgtgataatagaggggaaaagcattttctcttcttcccttcccggtaagctcgaaggacgctgagcccgtgcagcccctgttgttactgtgtcgcttgttcttgtttcccctgcagtacgcactttataaaaagatgacacaggctgccatccttatccagagcaaattccgaagttactatgaacaaaaaaaattccagcagagccgacgggctgctgtgctcatccaaaagtactaccgaagttataagaaatgtggcaaaagacggcaggctcgccggacggctgtgattgtacaacagaaactcaggtgggtggagaagagctcatggaggtaaagctccctagggaagagaactctgacttctttgaaagacttgtcctgggctgacattggagtctggggtgggcctaaagcattggcagtcactgtgttccagaacgttttaggcatggtggctgataagtacacctgtgctgagtctggttttgaatatttagctctttctctccacctcccacccaattattttgatattgccacccaattttaccttatatcagaatttggcagcaccagtttctactcagaaagttaccactcaattatagtagtttaacccatttcctgtttaggaaaaaaaaaaaaaagtacagcccgctgccagcactcatgtaattttacataaacatgctctttgaggctgaaggaaatctgattttcaatgtgaaaataaaatatgaaaactattcttggagttatttctaaacagaacttgttcctaatcctaatgtaactgaaacgtatatgatgctacattccgattagagacaaggctattcttgacacaaatgggaaatgagtgaaattgtagaattactgcatgtgagaccttgggagagtaattagggttaagctgttccattttagagactgtaataaaaatgttgagccaagtaaaatatattgatcagtacatttacaaaatagcccaaagagtgtatcaactccggtgaatcaccttgtaaactaagaaagcctctctaatgccagaatgccttttgtggcaaaatgagcttataatgaattgtggaagaatatttaagtgacattttattttcagtctttgtatagtctgtcttgaagctgagagcgcctatacacaccctcctttctcctctagtgatgcccggactcgatactatgggaacagcatacgcactcatcccccttcagattgtatacatctttaacatatgctgttggctttgctacacgaactgcttaattcagagtcctctgtcactgctgaccagttttccatattgggctttactgtaaccttcttgtgacaataatattctgactttttcaggagcagtttgctaaccaaaaagcaggatcaagctgctcgaaaaataatgaggtttcttcgccgctgtcgccacaggtacactagtccttgtttatacattctgctcagggagaatgatgaagcaaccctgaccttcttaaccctcactaactcctatgtaaagctaatccccctgcagataatcagggcagacgtcccaaattacaatagggcggtagagctctttaactagggatcaggttgctacccttggagtgctggtaaccatgtcagacgatgctgtttgaacaatggagattcatgcccgtgtttttctgttttaatttgggtgtgaggtcaacttagtcggactagcttttaattctaagtttctctttaacctgtgattgatatgccacattgcagtatgttctttgctctaatcctttactatgctagcgcgtgtccaaacagaaaacagtttctagtctcaaggaagggaaagaaaaccacgaattccaaacaagttttctgatgtagaatttccaccagatagctggtgccctctgctggtcatgtaatcgccaacatgctctattattaaactatcaattaaagccggtccgtgatgaggaacaggagagatcactggaatgcagctgttcaggaaaagaaagacatctgagactctgggcacatcttcaattagtaggaaatggggtcctgtgaccccagcattctgtgggatgcagcatcttctcatggagctaagccagaggaatttctctttgttcctcaaatttgagatttctttatgaagactagcgtctctacttagatttcagagggctggtgaaagtggtttgtgttctttatccaggtgaatattccagtctgacgtctgtaactgcggccatccgagctgggtgtagaccaccttctgtgtggttgggttgttgctctgtgtgtcaggagctgtgcagtttataataccaaacattaaagcagactctctaatgtcttacttcctcttcctatttaattataccaaaagtcctagtattcatatttaattggattccttggatgtttcattttgctttagtttttcttactcctataccatatgattgccggctttgaaaatatcttgcctttaagacttaataggtttaatgggttatttgtacttttacttaaattaacagaagaatttatttttgtgaccatagaaggaaacatgcacagccactgcattaacatcataaaaacttaaaaaacggcattcactaagatagatggttttccccagctatgatgccatgcagaagctaatgttcactcgccctgtgcctcagcaacatttactttccaccatgcaaggatgggagatttttcaccatgatagctaatgagtaacataccagtgtcagtactctgaaacaggaagtcctgttaggaaatgcatccccaaaacgggtatggctctaagatcatgaaattaattctgcaagccttaccaaaggcagcctctttcctttattattcaatcataccttttacttagcagggacttaggaccaaagagagtagctgattttctttatatggtgaacagatcaaggactcacctgggcccttttccttacattctccaatacgttcatagttccttcctcccttttcctcttcgacctgcaaaatgaaaaacctgagcaagatcctatccagcactgaaaccaatagactttggccactttgagcagaatcacatcttctttcatgacactgtggttaatactttccagatagattttgttttcaagaaaattaccttaacaccactcttctttaggccacttcagacaaaccagaatgtctgcaagttaagtcgtgctagactttttcctcctttcttctagtctgatcctcaaactttgaatgaatgtgtgggtaacgtgggagcaaaattgcataaagtcctacactcatctcccttttgtttttgccaaagctgtgtcccgtgtttactttgggagagttaagagaatgagatatttaaacaaaacataaattcatgaaaggttgcccccacaaagtaagctgaacaaaggagtcctttcacttttgtttttagagttctctttctgtaaactggtagaggaaaatttcatgaagatttttgccttaagtataaattttaactgttaataaccttataagatggataacaagaaggttcattatgaagagaacatcagatacgggctctggattcctgtgcattaattggaatgaaataaaaaatgttattggctctttacttgaccatttacagtttagatgttagaaaaataggcaaattttaatagcctctgtaataagatcagtattcacttcccatttctatatattcaattaatatgttcaatcttgaagaaatcctaaaaatctatcctggaagtttgttttaaactgatattttctttaggatgtgtgtaatcctattttcattctgggttgagttatttaatgttattttaaaagaaactattcatgtctgttgtccttagaagcattaaaatcttattaagatagaaaaccttggccaggtgcggtggctcacgcctgtaatctcagtactttgggaggccgaggcaggcagatcacttgaggtcaggagtttgagaccagcctggccgacatggtgaaaccctgtctctactaaagatacaaaaaattagctgggcgtggtggtacgcacctgtaatcccagctacttgggaggctggggcaggagaatctcttgaacctgggaagcggaggctgcagtgagccaagattgcaccattgctctccagcctgggcgacagggagagactccgtctcaaaaaaaaaaaaaaaaaaaaaaaaaaggaaaacctcatatgacaccctctcaaaaaggtaggtagatagtagcttcaggaatcagtcagaagtatcccatttctaagtcatatgaccccaattttttaagacttaaattgatgaatttttttacctactcatttcacgtaccccaccatcactctccttttctttctttccaaaaaagaaaccatgttatattcttttttgttgaaataaagctatttgtaagatttctgttgtgaccctcatgtgctaatagctctctggtgttgttttactgtctaaagccccctggtggaccataggctgtacaaaagggtgagtttagctgcctgctagccagtttctcttctcttccattttcagtattttgctttttgcttgcttgcatgaggctgcagcctaggtatgccagtaagtttcacatccattttgaatgaattaaaatcaagtaaaaactaaccctaattactaacactgctattttatatgacaggagaacagtcacatacattagatgtacaaatgcatgagtgagtagaagggagggccgttccaaaccactgcagggcatgccgaggatgcggtggaggaagcctcaggacgaaaacagggctggcaggccacgtacacggccaaataacgctgcgttatacgaaaacattcagccagtggctttttgtgattaagataatttgccacatgaaattttctcaacgattgctttgtcaaaatttctaaagcaaggaggctcactaggaggtcgtactagggttttttttttttaatgaatctatttcttactgagaatgactgtttccctataccctgctcctgtgcctgcattttctaaatctctccctccctggtgctgtgaggtaagtcactgtacaaggctgccctttcagaacaaacccaggacgttcattataaaatagcgaactggccttccagcacttgatgggaatgctgaataatgaaaatgtggtgtgaaatgtctcgaatatttatattttacataacaagagcagggattccaataggctttgaattttagagaaattacaatgagtaattttagttcctgagattttagaatatgatgctagtttgtaagcagggcaaaaggcaacagtctcccagaagcaactataatgtgtttgaattataataaaagatttagtgtccgaaaaccattttttcaaagccaggaataggccaggtacgatggctcatgcctataatcccagtgctttgggaggctgaggtgggaggagtgcttgagcccaggagttcagtgccagcctgggcaacatagggagactccatctctacaaaagataaaaaattaaccaggcgtggtagggcatgcctgtggtcccagctactccggagactgaggtgggaggatcatgtaagcctgggaggttgaggctgcagtgagctgtgaacatgccactgcactccagcctgagcaacagagcgagaccctgtctcaaacaaaacaaaacaaaacaaaacaaaaaacgccaggaatagaattcatcaaaatttaattaatttaaatgaatttagattaatttgacaacctgtttcttatatataatcttaagagaaaaaatgagttgaaattataacatgggaattttctctatcaactcaactatattcaatgccccctcttcttaaccttacactaatactttatttagtcatctttaagatttctgagaaaaggtcatagttcaaaaaatcttaaaactgctaatgtttctggagatattatttcccatctaactagacttatgttggtgctaatctttatttattatattttaacccagaagttggcaaatgtttttctgaaaggccagatagtaaataccttaagctttgtgggctgtatggtctgtcccaactactcagttcttttaatgtagcaggaaagcagccacagacaacacataaatgaatggctatggctgtgttctaatacaactttatttatacaaatagatactggactagattttggcccacaggttgtagtatgccaacttgatgatagaagaatttagtttttataagttcttcttaataatgaccttaaccctagatttaaaagctttaaaagggccggccatggtggctcatgcctgtaatcccaacactttgggaggccgaggcagccggatcacttgaggtcaggagttcgagaccagcctggccaacgtggtcaaaccgtgtctctactaaaaatacaaaaattagctggccatggtggcgtgtgcaggagaatctgttgaacccgggaggcagaggttgcagtgagccaagattgtgccactgcactccagcctgggcgacagagcaagactctgtctcaaaagaaaaaaaagagaaaagcctaaaaagccttaaaattttaaagatttaaaggctcatttatttaaaactataaataattgctaaaggaaaaatttgttttttgggggaaaaaagcagctatactcttacgtaaacttaactaattaatcctctctagacttaaggaattgttctcaattaaaatatttcaggtcccttgtgatagagctggctcggagacgttttttttgaaatgtaagaaaaaaagaggacaaaaatctccatttctccctctattccctctcaccctctgcatatatatagataatctttctttccattttaaaaaacctccaagagaatagatgcatgccctagtgttcagttcaactacaacttgtagtatcatgcatgttatatgcaattaatatcacctgctgcaaggacaacatttttacgggaggtggttgcttatgcgtttttgaaacttgttagtttctggtatgttaatgaccgtttttaagagcacattttcagaaggtgcttttcaatgcaaaccagaatcccaacctcaatttctttaatgcctgctgcattctattgtgaactcctaaaactcctactcatgcatggaaagttggaatctcatgacaccccttatgcctcacgacatctatgcaagtttgagagataggggctgagaaggttccttctatcctggtgatatttagctaactctgtgaaccaaggaatagcgtatatatggctttgtatgattgccaataagatcttctctccctcgttcttccatcggagaagtcacagtggcactccctctaacaatccccaagttgaaattagtcttgggaggcagagcattctctgaggaagatttatagtcgtggaaattatgttaagataaaatacttatttttgggccgggcgcggtggcttacgcctgtaatcccagcactttgggaggccgaggcgggcggatcacgaggtcaggagatcgagaccatcctggctaacatggtgaaaccccgtctctactgaaaatacaaaaaattagccggttgcggtggcgggcgcctgtagtcccagctactcgggaggctgaggcaggagaatggtgtgaatccgggaggcggagcttgcagtgagccgagatagcgccactgcagtccggcctgggcaaaagagcgagactctgtctcaaaaaaaaaaaaaaaaaaaaagataatatacttattttgttaatttgtaaagtattccatatttaaaacatggtttatacattgaaaaataatattttcccagctactggaggctgaggtgggaggattgcttgagcccagaaggtcgaggctacagtgtgtcatgatagtgccactgtactccagcctgcacaacagagtgagaccctgtcccagaaaagaaaagaaaagaaaagaaaaataatatctggaaacttacagaattaaattttatgggacagtatttgttaaacactaatactgacccaaactcctacgtcagtggagcagggggagatctaaaaaggcagaattaagacacgacagacaaattccagcagcagagcaatcagaaaataccacttgtgtcttgaaatgtttagtctttgcttggggaaggctaagaaaaagcaccaaatatttttcactgagtacagctcacttttatccccctttccttcaggcctacctcttaatttatccagtaacttaaagtgaaattaacaaactctcgatactgtcatcagggtttttggttgttttgttttttgtttttctgttttttgtcttggacacaatagctgtgtttaggagagaacttttgttctacacaaagagattatttaaattaacaaaagtgatttctcagcaaatgactgaaggatttttaaggtttaagaaacttttaaagtacatatgctgaaaagatactttcatttggattttgagtatatctaacaggatattattcagttgcatagagaaaaaccaagatacctcatatgttagcaggtagttcagttacataacagatttatcctcaaggtattgagacttgcttgacctaaaaaaataaaaactaaaatgcctgtttttctagacagaaaatgtctttccacttctctaagacatttatttttcgtggatagtagaaagtgttctcatagatgagtgacaccgctctttgaaaagcaatttctagacaaattcctcctttcccgatacgagacactatttctgtgagaaggctttataaactgtaacaatcactatgggtgttattaaaagcagtgggaatgctagtatttaattaacctatttcttataaactgctggcctagtcacctgtgttcagtaaaggcaggtgcagttattttactggaacaaaaccttaattggaggaagaagaaataacactttttagtcacatattttcaaacaacatattttctttttatttgagaaccgggtttccaaacactttgccagaagctggtaagtaggggtctcaacagagcagctctgctgtgtgcttctgagaacagccccgggtcatagctgcactgggtcattaccaagttctgaaaattacgcttacacttttggctgttttatgtacacttttatccaagggacagttctctaacaatgcggggaagtgtactgagaagtaaacagtgctctagggtcaacaaatgtgttctcacacttccgtagctcaatttggcatgaggcatagtttctaagtggcccgatgtgttcatgagaagtaagacgtgaatgtgggatgtgtcatcatggatgtattttaaatcttcaaagtaattttgtctcacttgcctcttttaggaaatgaatatttttggaacacagtggtgtgtgttaaattgcagacaacatgctctgtgtcattcttattgggcctctctgtcttttttgttttgcaatccaaatgagatttctggaaaatggcaagatctctcttttcctaaattccccacaagctattgcagctctcaaagcaacaggtaataatcagaaagccgcatccgctgccctgtctatttttgacgtccagcattgcgagaatattcccgctgaactccactgactcatgagacatttctctggctgagcatcactgagtagatgtaatgaagcagctttgccttacgctttacccatggagccattgtttgctacaagtttctgaagcaggcctacttcattgattcataaatgatcattggacgtctgatggaagtaaaccctgtgggcttttgctggctttcagtgctgttgcttacgacatcacttcagtacattacgatgcaactttttgggaagggggaattgagactacaatggtatcccagagtggtgattattctcagcctagaatgcttggggaaatactgggattgtctttaatgttaatagctgaatggtaacaggtcagtcttgctattctaattactgtgagtctgagccaataagagttctactttgcaagttactgataggagtcagaaatgtggccgcacagctctcctgagggcagcactggcgctgtgggaactgtagcttctgtcctgcattgcctctatgagctcagggaagactgctttgcctgtcttctgtgtaagtgaatttagaagtaagtgcagttataattttttttttttagatagcctggacatttttagattcagttctttcttagccctgaatgagtcgaacagttgtaattccttaagagaactgagcactcagtaacccttagctaagtgtgtgtaacataacaaaagtttatcatgcacctgtgttccaagttctatagatatggtgaccacaggtcctggattttcaagtctaattccaatttcaaaaattcttgtctatatttaccaagtttgtatactgaaaaatttgcttacaacataggtaatgttaatgaaaccagttcagtccattgattttggtttcagtctacaaaattgaatttttttccttccaatgaatttttcagttgtttttatataatatgaacacagcatttgtaagacagattagtaacagacagatagaaaacgatctaattcactttttttttttaagactaacaagcagctcatgcctgtaatcccagcacttttgggggctgaggcaggagaattgcttgaggccaggagttcaagaccagcttgggcaatatatttagatcccctgtctagacaaaaaaattttaaaattagccaggtatggtgatgtgtacctgtagtctagctactcaggaggctaaggctaaggattgcttgagcccagaaattccaggccacagtgagctatgactgttccactgcactccagtctggtcaaccctctctctaaataagtggagaaaataaaagctaacaagcaggaataattattattacaaaagcagcacatactaattgtagtgaattctggaaatacaaataaccaaggagaatcacccagagataataatggttaaacttctattttgtatccttctcattggtaaagatttatttttaacatctgcctgaataatcattcatgtccttaactaataacaaggtgatcataaatttagccatttgaaacactctgatttgaaacatctatttcttaaaatttgttttaaaattctagtatatgttattctaaatcactttggtgatataattgttttctgtttctttggaggcaatataacattcaaacattattttatccagttgacatttgatttaaaacaaaacaaaaattaagccccactgtctcatcctaataatctactctcaagtaacataaaacttcatttatgatttcactagggcagatagtaagcctctcaatttcatgttaactttcagaggtaagttaacatctatatggtccataaattgcaaattggagaataaagctaaaaatctcccttgattcttacacacattcttttcacacattttaggattctaaataattgtgttgtaaaatcaataagtacattttatgtgagggtcttcccccaccaagaatgttttttattaataaaatcaatatagtgtcttataaaagatgacaccttagaattgagaaaatgtaattgttgttaatttcatctcataccatggaaattttccaaatgcatgtttcttataaagtcttttagaaaaaacaataaaatatgatttttaaaatacttctgtgttatcctgggagatatttttagagacagtgaaatgttgaaactataggtttggaagtcagacaaacctggactcaattccctgttctgccatttattaactgtgtgaattggggcagattgcttaattcctataaatctcagattctgcatttacaaattggagctaatggcagtgttgtgaggactacataaagtaacagatattaagtaacctgtatagctattggaatttaatactttttctctctcattttccccttttttttctaattcctccttgaacgactttctgtaaaaaatgtttgtgccatttaagtcattttgatgtcatgtataatgctagcatactatgataactttatcatgaagctaagaactaaattctccactttaactcaggagttgtggaagcctggaaaatatatctgaaaattgcattgttctcatttttcctgcgtagacattgtacgtggacatgcacctctccttaacctcgtggtctgtgaggccatcactaatttcatagagtatttacttgacaactttaaaaccttatgaaaacttaactttttaattagttctgaaagaaactgaaaaaactgcaaaaacaaatgtgaccattttaactaaaagaaaaatgtttagggtatacctcccctgaccagctgattatagattctttggtatgaaaccacataaaacatttctggcttataattcactctcctttttatttcatctcaatgatgaacttaatatttctaaagcattcctgttcattcgagaaaaattgtgaatgtataacatcgtcgtgtttatgctatcagattttgagttcagaattcctcaaattatagacatctcatcagtgatggagtcactgtcgcatatttgtgaatgaggtctgtgctagtgcagaaagaaaatgtagcatttgaagtggcatgcacacgctgcagaaattcagcagataggtctgcacaagtacagatattgcatgtccagaagcgaagttggcatcagtgcatgccttgcatttccagccaaagggatgttagtatagatattgcatgtttaaaaattgaacagactatagcatgtttcaatttttaaaaagccatttatttatcaagtatgcatgtccaaaattagggacctatagtgatgtacaattctatactgtaatatgacccaaattaatccatggtatatttaattataaaatttaaaactaaatgatatttggatctactcatgaacatagcaatgtattctaactgtgcctgttaacaaaaaaagattcaacagttttagagatacactgtttgtcactgtcatttataaaaatcacactaggaccaagctagggcttggtatatgtagtaagtaaatcagacaagtaagcaagttttcaaagattataattctttttagtattactgataacatcataaagcttttcttctaaaagagagcatcttctctatgaagagattgtatcaactttgcagaatactcagaaatgattctgcttggaagtggtaaatataaatgttttcttaaattgctattataccatatgtgccattccagactctcaacctatacaatatagcaataactgattactggttttttcacactattttctttctgcctgagtattatcaggttttacttgaggctgggcctggtaggctcatgcctgtaattcaagcactttgggaggctgaggtgggcagatcacttgagctcaggagttcaagaccagcctggccaacatggcgaaacatcatctctactaaaaatacaaaaattagctaggcgtggtggtgcgtgcctgtaatcccagctactcgggaggctgaggcaggagaatcacttgaacccaggaggcagaagttgcagtgagccgagatcgcaccactgcactccagcctgggcaacagagttagactccgtctcaaaaaaaaaaaaaagttttactttactggtataacttaagataataggagagcctcttagagaatcagaaaaatatatttgagattatagccctctgtatagcaccacgacaaatccaccttttcctgatcatgctgttgcagtagagtatggtgtcctaagaaactgttgctcctatttggctaaatcagcctctcacatccatttttgggaaacaaatgttattatatggtatgcagtaccacaaactgtgacttacaccacatgcattgccttacatttgatcattctgctattaaggcaggttcgtaattgtcagtgtagagaaatactcttacagcagacagcagcttccccagcaccccatctacatcaggtggccatatccaaaaaaactgagactgatttttatattaaaaattacagattggcagtgataattaataagtaatttgctgatgtgaactttccatgactcagtctataacaatgttatttaaatttgtttactacagtatgtttgatgaatagaacgaagtaccttatcagtatcgcaccctatggctgtccatctgggatcactgggaggaggaacctaaatgtctttttaagttataatgtggaatgggaggaaagtaaggaattataaaaatcaaagtctccacaaaacctgtgtgaaggagtagagttgtacagatgtatgattaggttcaagaaagctaacaatcttgagtctatgaacaaagcagtagtagcttaatccctagatatattaaaagctaaataggccgggcgcggtggctcacgcctgtaatcccagcactttgggaggctgggtgggcggatcacgaggtcaggagatcgaaaccatcctggctaacatggtgaaaccctgtctctactaaaaaatacagaaaattagccgggtgtggtggcgggcgcctgtagtcccagctactcgggaggctaaggcaggagaattgcgtgaacccgggaggcggaggttgcagtgagccgagatggtgccactgcactccagcctgggtaacacagcgagattctgtctcaaaaaaaaaaaaaaaaaaactaaataaatgcatgtacagtttccctaatttacatcatacagagtgataggacattaatggtggtccacgagactaaaaagaaagttatttgaatagttaaatttttattaagataaacatgtgattgtcacacttgatttaatacattagactttgattttgctctattcttagagcgctcgatgtagagcaaagctttagaatgatttttttttcaccttaagtagggtcacgtctttcctttgaatattttccccaacaatttcacaggagtttcttttgccgtcaatcctcaaaacggttttagtcttggcttttcagttcagagggagtggtaatacccctttcctttacttggtcacaattcactatagagttatcgcctgctgttttgttttgtttctcttccagagtgaaagaattgaaaaaggccaaggaacttgaagacatacagcagcatcccttagcaatgtgacattgcttttcagactgttttcatttctgtttttagcagagacatgcaacaacaacacacacgcacacacgcacacacacacacgtacacacacatacaaaatccctctgcagttttggggagatcagctgcaggattttaacaggaatgttttggtcattgcatttgcactttcatggacaacttttaatttgatcagcaagacatcttggaactcaatcttctgttggatcacgggaaatcaagacacccaggaggaattgaaagaggcttcctcttctcaggaagaagccatttccttctcatatagggctgtattcaaacatcgtgtggaactgtacaaatatttataccaaaaatatagataagaaaaggtggggctatactagcaacaaaaaaagaatgctgttcctgcacctgccggttatttccaagaagctgaatctttgggactgattctcagtggagggcttagatcatacaaaaatctttattgggtccgtgtgttctcatttccttcactgtttatttttgtttgtttgtttgtttgttttaatctctacagcacatttaatgcaacttttgaaatctgcaggtttttaatgtcttgtggaaatttgcagaggggcaggtgtgtggtaaacgggtaatgcatgggaaataatgagaagcagctcacagagtttaaactattttcttgtccccaccaccttccaagaacctgcgagggtagtaatcatcttgtcccctttttcatgttcagcactttaatttttttgccttactttcatgtgcaatgagaattacttaagaattggtaacgcatgtagccttttttagtaaccttggaagctgtagtaattctaaggaatcatgaaccttgcctggacatttgccacctaaacgatcagtgtggtgctgcgttctggccagtaaattccatgtttttggctatatctcatccaaactgagcagtttctgtgtatatatagaaggtagaaatgaaaagtgagaaaatatttgaaagggattatattaattgctaaatattttattcacaaaggtcaataacatggcaagataaaattatttgtatagttttgtctgaatgagcgagaaaaatgtggatgtactgtttgtatatattgtatatattaaaacagagatatgtgcatgaaatcaagaaaaaagaaatgaacaaaagcaaagcattagtggctatggtctgtaaaatgaaacaaaaaaactttatttcactataagagtactttattttaaatgttctttaggagaacattttgctaaagcatgactaaactgcaaaaaaaaaaaaagagctactgtatttagacttaggaaaaaaggcagagtaacattacttaaaaaaaaaaggatatgtttacatttaattttggctaccaggagtttagtttattttatttaaaatttttttgccaatggtgccaagtaatgtgaatgctaatactgcttaagaaaattaagttacttttgcaaaacagataatcataagatgaatcagtatgtagcttaacaccatccactcactccaacaaagaacacttagaatgataaaaaaaaaaaaaaaaaacctgacaaaagaaatagtatgaaaagtagaaaaatgtcacgtttccatatctcctgctggaaatcagaaaatataataaaattgcacaaaaaaaaaaatgaaaaagatgcagactggtcttttagagacggcatggtatattactatttccacataatgaggagccaaagaaatctgatgtttttaacaattaaactgctaatgttaaattgagagaataaagttcgtatttgctgatgccagtttaaaattcccaggttacgtctgaggatcagttggtgtaaagctgagatgttttttcttggttctggctgccaactgtgagttaaaactcaaggcttgttgtgaagcctaaaaatattcacaaataagcttttaaactggtgtctttggaaggaaggtagatacaaaaagattgtggtaaaaactggggtcagtgctcttggtgccttttctataattgtacttgttttttaattacttcctttcactgccaacctcgaattactgtacagtatatgtctttctgcttgtgatcagctttgacaacagtgacagccccacaactagtagccacctgtacatttgtaaactgacctgactccattttgtttttaaatgtgtgggttatgttgcagctgttgcagtcccccagatacctattattttacacaatttgacctataggaggacactgagtaatttacaaacacaactgcattcataaatgggaatagaacgtgaaagccagctctttcagaatatcctctattaatactgaatttagatatctttattccatttattatggtacaaataactgatgttttaaccagagtaatgacctcagtggatttgctttaaccctcacattttttttttaatgtttcacatgttacattattagctgaatacgttagaaaatgacagatggtagagacttccatagaattaagagggttctcatggaggggataggaagtaggtttaaagcctaccagtgtaacctaccagtacaactgtgaatcctaggcaaggcaaaaatgcacttccactgaaacgaagcatttctgaccgctttttcttggttatgaatcttaatttcgaatataagatgataggtaagcgcagctttcttggataatctgaattcccaagtgccaggagtaggatttcattataaaattaatagctaatcttattctatctcctgaagatttaattgctattgttacccattcgaaatcagctgtactgtgtgaacgaaataaagacaataatacgaacccctctctggctgcacggtcgcttatggcagttccacacagtagttggcgcccaatggggggtccctgagacttgcatgtaaaactagtctagatgtcttctttttttgtaagttttatttttgtaattgtgcatgtaaagcatcattgaatcaatggatctgttgaagaactcagctgctggaaaccatgcaaaatgttttgaattgcccttaaaatatggaaaatgttttctgaatgctttatattctttctgctgtaaattaaaaatgaagaaaatttccccata

SEQ ID NO: 762 - DNA, 86725 bp, Homo sapiens
ggacgctcctcccggagagtagtgagacccctggtgcggggcgattggcggcgggagcgatgagtggcagccgcacggcccaacgggagctgtgcgtgggccgcggggcggggccagggcgggtgcgcggcggcggcggggtggctgggccggcggcggcggcggtacgaggcgcgcgctcggggtcccggtcgcgaggaggaggaggatgtggcgcgcggaggggaaatggctgccgaaaacaagccggaaggtaagagccggagcgcgaggggctggggggcggcgcggcgggcggcgggacccggccccgccggacatcccgggcatcggcggcgccgggcgggagcgcgggggcgcggcgggcgggcgggcgggcgacccggccggggagggggccggcggggtgggggggcggagcgcggccgagtcctgaggtgactcgcggggccggcggagcgcggcgccccacaccccacccccgggggcgggctggggccggagggggcggggggctcgcggggcggggaccgggcccagcgaggaggaggagccggcggagggccggcgcctcccccacccggaccgggcatccccgccgctcccgagcccgctgcgcggcccccgcacccccggcgctgggtccacggtgggggccgcggggcggaaagtttatccgcctcgggtcctcctggccccgcgccccactgctccgggccggtccccgtcgggcggcagcggccggcgctcagccctcgccggccccctgctctccggcgggcagggccagatgtactctctccggcaccctcttcagccccgtggacacctccctgagcgggcggggggtccccgagcttctccccgccagggggaccccgtcctgccgagcgtccctcggccgaagggcctcgtgtgacccctcccccttcgcttcccgggaagggaagggggcctgcgcagcatccccgcccctcgcagtcgttcacatcctactcttgcccttgcaccctcacagccaggagggtggggtctccgtttctatggcaagtgaggatctccacactcccttgccctttaccttccgtgaccccgatccttccttggcacaggggtccgtctgatctgctcatcttctttggattcttttggggcctctgcacactctccgttgaccctttttgccaggacaaggggactcaggctgcccatgttcttctttcctcacccagtggatagtgggggcttgtgcagctctgaagtcatttctaaataggaaagcagacacttcttccagatcatgcatactcttacactttgctgggttagggcgagctcatttcctaaataccctttgagttgccctccttttcttatggagacaactggacgttcaccgtgctcctttcgccatttgtgtgtctacactgacttgttctctcttctcggagttccttgtctgggtgagagtgggcgccccaataagatgtagggcagggcttccattgtgcctagtgcttgagtgaaaaggggccacactagttgctcctgtgtctgaggaagaccggggtatatttttgcctccacttgactcttgtgtctcaggagggggcaaccttcatcagttgacactacctcactgggaaaagggtcatgtggccttgttttttgatgttttgattactgtcttctgtgcagtgagaaccagactttgtccgtcccacactcaagagtccttgaacctttcctggatataaacttcccgattgttttttgagagaactcatatcctcctctgtggcttctgcttcgcagtcagccatatttagtgagcctgttactttgactttttctaattttctcaaattgtattcatgttggctgggtaaggagaagccatatgcctttccattcagaaaagggagtgtagacacccgtgtcgcccacatgccatcctggaagaggttgcttgtgtgctccttgttgtactagaaccttcctttggctctggtgttgtctcttgtgggatccagacatttctttagatcttgtagctttcagaagggggaatttgaatgctttctgttttttgctgttccggttctgctttggagaaccagatcatgatgctatattcatttgtttacatatacatacatgtaggtatacacagatgaaatcacattcattacatatacagtgcacaggaagttggaagggtcagatgactagctctacattttgggtgcatatggggacctttatgtgtaatgatacagatagatattaacgttgttggtaactcttcaggcttagaagcagcagcagaagaatcacggataaatggccaattctgactattctttggtttgtaatgtgtactgtactgaataagcagaacgacatcctgcgtgttcaccaagtccctgaatgtgcgaagcgtacagtgcctgcccatacgcatcgcaactttggcggtctgaatttaggggtggtattcgttgcttgattctgcatagagtgaaaagttcttgatttctttactgcagtgtaggggaaagagatttcgtgtgtttggacaaacgacaggagatgggtgagaagaatatgttttcctgtgacagaactaggaacgaatgaccgtaaatatgtcccttttgtattttggccatttaaataattgagagaggttgtgaaattagcaaaatgtacctgtggaaaggccctcgacgcttcatgagaggatggggaacgttattcttcaagttcttttctcttggacaggggaatgatttgagccctgtcggctctagtcaggtgctttgcctcctcaggtctccctccctccctccctccctccctttctccctctttcacgaaattcagaatggctgctagccgctgtcactcagcagggaagtcttactctttgacaggcttagtgtggagactcatcctccccaacaagttccgttgggctctggggctttggcctttaaaactgttctagctcagaggctcgctttgcctcagtttactgtgtaaggagaagtggctcatcggagattgggtcagcgctagttctgtgacttctggactttgcctttcagttagcattgagtcgtccagtgggcctgattcccaatgtcagaaagtagagcttttgagctcattttcttgtttttggttttaaatgtttttatgctgttcgtattctgtgtctgtagtcagcttgatgggattgtgtatttttagggggtgttattagggaacttcggaaaaacgaagagtcgaatacctgctgtagatggtgtagactcagcggagtcatcccgtttccagtggtggttcttcctaccgtttcctccatggccccatggagactttgggagttttccctggtaagcagggggctccgtgcaaggcgcagtggaaggaaaagtggtaaagattggttggaagaagacacttgaggttattgtctgaagctgggccctttttcttgagtttgatgtggttgtgtttctgtgtcactggtcgccacagatgattggaaattagctttttccttttaccttgtagtgcagaatgctctgttgcagttgggcagactagacgggttctctgaaccacatagtttaatctttctgttcgactttctgttaggacatgactctttcctctccttcaccccttacctccagtttttgggactaggttgggtgacctcttcctcctttgtcttcttggaaaccttacttatcctgcttctgcaaatgttgggtttctccatctcatcattgagtggattcaaagtgttgacatacacagagcaacctctactcaaggtcagattgggtcagcttttccttttcaaaagagtagtgttgctcttacttgctctttgagacatatttatgcatcctgctcagctgtgttttctgtttccttagtttttaggctctggcgattttaggctttcccccagaaatagcctattctttagagagtagtgtttagtttagtctcctgtttatgctggatgtccgcccatgtgtcctgctcggtttttaattctttgtgactgattttgaggtagcccatctcaaaatcttaacgtttttttccccactgtttcattactttgagccattcttcctttcctgtttgggggaaatacccctttgtgtgcagttgtacttctttctcctttccttatggaaaaagcagtagaaggtgattctcttattttcttctgttcccctcatagttgtgtcagttgactcttttgtggaacctttgaatttgcccttctggggagaagtcgtttttgtatttatactcccatgactggagtcattcattcaggagacctttaccgagcttctgttatgtacaaggagctgtagggggtgatgtgactttgcttgagaccatattggatcttgttagccttttatattaatgacattttagtgtatcttttttttttttttttttttttttgagacagagtctcactctattgcccaggctggagtgcagtggcacgatctcggttcgtgcaacctctgccttccaggttcaagcaattctcttgcctcagcctcccaagtagctgggattacaggcgtgcaccaccatgtccggctaatttttttttgcatttttaatagagacggggtttcaccatgttggtcaggttggtcttgaattcctggcctaaagtgatccgcctacctcagcctcccttgcctcagcctcccaaagtgctgggattacaggcgcaagctgccacgcctggccttcggtgtggtgcttgtcttaatgcttgtcttttatatagtcttgcaaggaattttttttttctgatttttaagtttttggattgttaacttacaaagatatagtgtaatagtgtgctatcttgttgaaccttttttcctcctcagcaggagtgggggtggtgaagagggtgggagggtggactgggagaggcatttagcagctttcccccagactgtgtgcagagtgtgagagagagagagagagagtgtgtgtgtgtgtgtgtgtgtgtgtgtgtgtgtagacaaaagtaaagtcagccttcttaatctgattgtgtaggcataacttttaggttgtttagatacatgattggttggaatgcttatttaatatttgaacggcagcatcgcactaggcattctatagaacatagagtcaaatgtattttttatataaggaagtggtagaaaaatatttttttcttcggattaactggtatggttcatagtagatagtgagaactgtatgagctgctgttacattttcactgccatgaagaattatatccaaatttaatacctaattgatgctcattcttaggctaggcatctgatataattatcacttttattatatgacttttaatttatgctttttaatggtattattatttttgtaaattgcctcaaattctttgtgggtacaggttaggtataaataatgataataataaaaattactaacaatttgaaataccccttttcttttttcctctattaaattagatttaccatctccacaacgtatatagaaaccaattctgctactatttcactcttgtgaaaactcctgtgtgaggtttgtaatatgtggtttggcagtatgagtatgtgactgagtgtattttgtgttgacaagtgatgtgtgtgtttcttttgcatttccattatacagatcttttcctaaggtggtgtgtatcttctagaatcatgtaccctgtcctttttttttttttttttttaaatgttctaggtgacttaaatccgacctccctttcttttcttcggcctttccttttattttttgtcctttcccacatagagaggtttcttcactgacctgtcattattataaaaaagtgtttgttagatgtactgtatttgtagccttttagtaagaaggggatgcccaccatccctttgtcctgtagcacaaggcattgcttcttgtttccctaagaataggtagatggaatgagatttaagccagaaggccgctggtaatagtatttgtaactagatagcatctctagataaaacactgggtcctttctgctctgggcctccccatgtaggattttggaaatttttttttgctgcatttagccagcttctttctgtctctttggcttgatacaataaatttctttaagcacagccaagtatattatttcatttggagccttcatttacaaggaagtatgggggcctctcctaatgttcctttgcctgttatatatagtactgcctttagtttttggtgtgtttgagagtgagagtgagaagcattcttgctctgctactttgtctgtgtaacttgaataagagtgtacggtcattcactctattttccagatagtgtataatctttctttttatttttcttgaatacctaatcaggttcgagctagaggttgatccgactatcatatccttttattttgtgccatccctggatatagtgtcccttagtcctgtgattaagccatgttcctattttgtcattagagagagggacttacaaacatatagatggtctcccatgataattgtcatgcatttataaggaaagtgtttcttttctttttttttttttgaggctgagtcttgctttgttgcccaggcacgatctccgctccctgcaacctccgccttccaggttcaagcgattgtcctgcttcagcctccaaagtagctgggattacaggcgtgcaccaccatgcccggctaattttttttcgtatttttagtagagacggggtttcaccatgttggccaggttggtcttgaattcctggcctcaagtgatccgcccacctaggcctcccaaagtgctgagattacaggcatgagccaatgtgcctggccggaagtgtttccttgtataaattgacaatggagagcagttcacgtgatgggacaaagtaaagggtgagtaaagggtggttttgggtttttttttttttttgccatcagtatgctagctgtatatttctaaggttgtattgcatccttctgctttgaacaccattgcttgtagaaggtcatgggcctcctgtgtaaagattggtactgtttcctgagcatttttttttttacctcattaccctggacttacagagaaatattatgtaccccattgcaaagagaggccaagggtcagccacattatttccccttttgctctttttctggaggattgttcatttacttcgaactgattgacatggcataagatggaatgactagagatttttttttttaaaggttcctccatattcaacctcagtgtttggctctatcctgacatggttgcttgttctcctgtacatgaatccttttgcagttactttcttgtttttgtttttcaaatttagccagggctttcaagtcacgtaacatatcctttcctgagactgtgagccgaaggtaacttcaaggaagatatgcttgtttggggctgtattcatcactctgctctctacggttttgtagttttcatgtgtacaaagtgacatttcttgaaagaaacgtttggggctgtgttcttaatagttttaaacatgttattatgtggagactaagtggcaaaggtctcaccccaacttcatttcttcataccactcatatatatcttatatatatataccccactcttatatatatatataccccactcttatatatatcttatatatatctcccctacctgcaaatcccaaaacaatagtcatagcaacagaaaagcaaaaccttgtgaagcccagctctgattggttctgctgtgcagttcagtcgctagttttggacaggtgcataagcagataatttttggatgtgtaatattctcagtggggctgatgtgtgacttttgggacatagagcattcattcgttcagcagaccatgcagtatctcttccatttttttccccttatcagttaccacaaggtaagattatgtattcagtcacttaaaaacacttgcaaagtggatttttccccatttattcctatctaaccattggaataaatgttgacagtagtaaattaccatgtccctatttttgtgttcaacatgtctaagagaatggggagctaacttccagtaagggcagtacagtcagtcatgactctttctccatgtagcctgtgcattgtgcagtgatgatttatactttcagctaaatttagtgtctatgataagggatacatcagatgtttaagttcacttaatctcttttacagtgtgcattcaacaaggtgtatttgtgtcttatattagaatgaaatgcagatacaaccagaggtattctttcaacgtagagagagagagaaagcctttctttttacaagttttgaaaaaaagttattgtctatttttccttcatggtgcttgatttagattgccaggagtcatttctgaaggtatattaatacaatcaagaattaatgttcttaaaacttaaatttgttttttaatccttttctgaaaagtcatttctgaggatatatgtgccctgttggttttctgggcacttggatatcaaatcatttgggagtgataataagaaattggtacaaagtgtgaaattatcagatagaaagaaaaaagatgttatagtggaaaaaattactcatttatgattaaaaataatctcaaagtgatgactggaagtataaattcagatatttgaagaagaaatggaatgttgatagggttattgtattgaatcaacacatgcacacgtataaagaatgctccccaaaatggggacgcttagaggacaaataagttgattggattggttttaagaaaaatattgtttgtctttttaaaaagtaattgaaataacccttcttagtgaagaaaatgaaaactttgatggaagttcagcagaatggaatatttaaaaagattcaagagaaggatttttttattgcgaatccacaagggggtagtgatgttctttcaaagatatttgtggtggcaacaatgtgagatgatctcttcacattttagatttacagataaaactggcatgtttgcattttaacttaataagatcttctttttaaaatgtttattggcaaaattgtttattgcttaaattaaaaaaaatccattttgggtgaatggctactttaagccatatgaatggtaaagaagagagaatgtccttacagttttgtgctttggagaggtcaccaaggatgtgagggtcactgttattttctaagaatgtaataatcttaaattccctgggaaacattagacatctaggaatcagttacttaagtgtcctgaataaaaggattttagtaaattgtgtctaaactttacagaagtttgtattactagttgtattttcagtgctgccgagagatgaaaaatatgaacaatccatgccactagccacttttaatagttctaagtaaatcaaatttttataatcttttttattagtttatattacatcattagataaaggctttttttttgttttttttgtttttttgtttttttgttttttcttccctcacataaaaattcaggagctttcttctggtcactgagttccaccccatattattcagaattacttaaaatcaggtgtggtaggcctgtgctgggtcattttcagtggaggactgcctagctgtattatgcactcatttttgaaagttatgccgtgtggtgggagaaagatttaaagttggggggcggctgtgtcctacttatttagagacacaactagtcatcacctgtaacaaatgtgacttcttttaaaacttattttatcttacttttttttagagacagggtctcgctctgttgcccagactagagtgcagtagtgcaatccatagctcactgaagccttggcctcctgtgctgaaatgatcctcctgcctcagccccctgagtgactgggactacaggtgtgtgtcaccatggctgcttaggttttttttttctctttttcgtagaggtggggtcttgctgtattgcccaggctggtcttgaactcctggtctcaagcagtccgtctgcctcagcctcccgaagtgctgggatttacaagtgtgagctaccatgccctgcctaaaaaatattatttctaacaataacacaaaataattatgtggtttagaagttatgatagtttgtgccatatacattgtatatttttcatttttggtttgtggaaaaggttgttaattgagcttttctctttttttctccattccctcattctgagcaaggaatgactttttcttttatttcctttacgaaatgactttggtgttttaacattccagaagatacactgttttttatatgctactctaaactctgctgggaactgaactatgacgtcagcattttcattcatgaatctgattcttctaaatttttttcctgttttgtattcctgagctgacttctggcacatgcacaaatcagtttaccattagtcagcccataaatcactgataaaaggtaaaacaaaagataagatactggagttattttgatagtgctatagttctcatgctgatttgcatcagtacagtttggataaggtttctggctaaacagattgaaacctaaaaagtcaatttaattatctcatgattttgtgacttgaactgtgttgtgaacatattgacacaatatttttgttcttacaggaagttgagagtgctatgctatggctcctttgttataaaatagcatttcttttttttttttttttttttttttttggagacggtctcactgtgtcactcagtctggagtgcagtggcatgatctctctcggcttactgcagcctcgacttcttgggctcaggtgatccctcagcctcacaagtagctgggactacaggcacgcgccaccatgcctggctaatttttgtattttttgcggagatggagtttcgccgtgttgcccaggctggtctccaacttgtgaatgcaagtgatccacccactttggcctcccagagtgctgggattacaggcgtgagccactgagctggcctaaagtagcatttcttgtataatttgactaagttggaagattatataatgctttatttcagagaggttaggcctagagattaaatgatgttttattcaaattacctttgtaatggatttagatttttttttggagcattttcttgcctttgacatattttaaataacttcattgtttgatacttttattttaagatattattattgtggtggaactagcctagtattccttgtattggacttagggtgcatctaccctggattgtgcactcgtgtagctgttgactccggtttctcctctagggaggtcactgcttgcagttcagtactacgttagaacagttcttgaagaaatcttatttggagttttcttctgcaggccaaatttcaggctaagcctccggcccatagtatctttcaagcctgctgtagctgatgaatggtgagccgtaaaaaagtttattttctctactttcgtgggggatttgctgactttctggatactcaattgccaagaaacatttagaaataaaacgtgttatatttaggaatcatcattttagctaaataataatgcatgattagaattgatgattcaagctgcaaccactttgattgatacccagtcttactcttgagatcacttttttttctgagacagtcttgctttgtcacccagactggagtgtagtggcgtgatcttgtgtcactgcagcctccacttctcgggcctaagcagtcctcctgcctcagtcccccaagtgactgaggctataggtgcgtgccaccatgccaggctaatttttgtagagacggggttttgccctgttgtccaggctggtctcatactacagggctcaagtgatcctcctgcatcggcctcccaaagtgctgggatgacaagcatgaaccaccacgttcggctgagatgactttttattttttatttactgggtttttttttttttgagatggaatctagctctgtcacccaggctggagtgcagtggcatgatcttggctcaccgcaacctctgcctcctgtgttcaagcaattctcccacctcagcctcctgagtagctgggattacatgcatgcaccaccacgcctagctaatttttgttttttttagcagagacggggttttaccatgttggccaggctggtctcaaactcccgacctcagctgatctgcctgcctctgcctcccaaagtgctgggattacagacgtgagccaccgcgcctgtcttgagatgactttttaaatgccataacaactcacagatcctgtgtcctcccattcttaaatgaaactagagctttgtgttcctttaggttaaactaaattatctaataggtaacagaagagtggtctgttagctggctttctcctttcagtagatttgctaagagaaaggaaataaaagcaagtagactgtgaataaacattgaagatgacttaaatgacattgttttccctaataatgaaataatttatatattatttaaatataatttctataaaagaatctatttgcaagtgataatgaagaaaggaatttttttttttttttttgagacaaagtcttgctcttgtcccccaggctgcagtgcgatggcgcgatcttggttcattgcaacctccgccgccttggttcaagcgattctcctgcctcgccccccaagtagctaggattacaggtgctgaacaccacgctgggctaatttttgtatttttagttgagacaccatgttggccaggctggtcttgaactcctgacctcaggtgattcacccacctcggcctcccaaagtgctgggattacaggtgtgagctaccgcacccagcctaaaaaaggaatatttaatggtagagggctctgtaaaaaccccctaattttcaaagccatgtgccactgtagaatttatgaaaagttatgggctattattattaggtttcaaaaagtctggaatactggcggtagcatcagaattatttatttatttatcttttgagacagagtctatctctgtcgcccaggctagagtgcagtgatgcaagctccacttctcgagttcacgccattctcctgcctcagcctcttgggtagctgggaccacaggcgcccaccaccacacctggctaatttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctctatctcctgacctcatgatccgtccgcctctgcctcccaaagtgctcggattacagacgttagcctccacctccacgcctggctaaagcgttatcatttttatctaaccctgaaccaatcagtgattggttagttctctagctgtgaaggctttgcacttcctagacagcttgtagaacaagcccacttggattcccagctcaaactctttcctttttactatttatttattatttatttattcgttacttattattaattaaaaaaattttttagagacaagagtcttgatctgtcacccaggctagagtgccatcacagctcactgcaaccttgaactcttgggttcaagtgatcctcctgcctcagcctcctgagtagtgaggactacgggcgtgtgccaccacacccggctaattcttttttaattttatggagaaagggtcttgctatgttgcgcaggcttgtcttgtactcctggcctcaagcagtcatcctgtctcagcctcccaaagtgccaggcttacaggcatgagccgctgtgcctggcttgtactctttcactagctgggaatgctggtgagcaggactcaaggatcccagcagagctgcatcctgtgctgtctttgctgccacttaggtggaccaggagctagaagcctttctctccatggcctccataccttcttttaccagatggtatttctgcatttatcactcttgattccagcacagcttttcctcatcttgcttttctcagacctcagctcttatgtaatgagatagttggtagtcattttgaggggattcatgtgttgggtaaagggttttcctagcgatgacctcgaaagttccttcccattaataataattactattaataattaatagcaataactaatgataaaacagaacagttgcagcaatatactgtaataaaagttgtgtgaatgtggtctctctctctctctgattatcttattgtaccatactcacctatttttggaccttagttgaccgcttgtaactgaaaccatggataagagggggactattgtgtaaggaaatgaagtcggagatatggaatttcatttcagggcttgctttcctgatattcagctattctgtataactgtatcttttccttttgaggtccttgctccaggacaagaataatatgttgactcaagctgtatggggggatttgaactacagacactcagatatctcctttctgaggtacatagagggcttaattttttaggtctgtctgtttaatatactatatttactttaaaaaacgtaggccgggtgctgtggctcggtgcctataatctaagcactttgggaggccgagacgggaggattgctttagccctggagttcgagaccagcctgggcaacatagtgagaccttgtctctactaaaaatagaaaaaattagccagatgtgttggtgtgcgcctgtgatcccaggtacctgggaggctgaggttggaggattacttgagcccttgaggtcaaggctgcagtgagctacgatcacgccactgcactccagtctggatgacagagtgagatcctgtctcaaaacaaacaaaatgtaaaaaaatttaaatttattaaaaaagatgtacaacaccaaaatgttcatagttattctgtatgacagatctgaggtctttgttcagacatagatgagggttcatagttttggaaaatagacttaaataatatatgattacagatgaaaaatatttgctaacctcagactttttatgtttaaggtagtatttatattcatttagttgtactttctggagttgattaatataactgttattaaaatctatcgattcccagtaattcagtaaatgaagactcttcctatttagaaactcgtgtggattggggagttgctgtgggcccactgtcattgatcatatcacatcttcacttgaacctgctccctgggcctcctataggcctcgcgtttggagaggccgtgaacataatttatttttggaagtttctttcatttttaaagatactgagaggcaagttgaagttcctggtgttcgtgtaaacattccctgccttatcctttccatctcagccattatgaaatgttctggctgaatcatttgctttcacaaagctttgatgaaagtttcttcctcatttggttttcttgatagaggctgttgtgctaaaaagaaagctataacaagttagaagggtggagagtgggcacttaacatttttgaagtacttgtctttcttcctaggggtcctccagaaattgatcatagataacttgaccaaattcaaggcccagagatttcttccaggcattctgggagggaaggaacatcaggctttctgtactgaatctaattattctaaatatttcccactgcagcttgtatgagtgttttctgatgcaaatatggtgatagtggcgacctctctaactgggctaaatatccttgacagctttttatctgtcctctccaagtatttttagtctctttagcttctgtggccatgtctggaggaactgaggatggatttagctgctctggtgctgctccaagttgttgtgggtgctctttgctaccttcgtcactgtcctgccacagtcctgccactgatgaggctcctggcccttgtcatttgatgagggaacataaacacttgtttaataaaaataaaaaagtcatgattttcagaatgctttgaaaataagctatggctaatggtgatacacaataggaatgtccctaatttcactaaattgtatgctcaaaaagggttaaagtggtaaattttatgttatgcatattttgccacaattaaaaaaataaaaacttcaaatggatttgaagcttaatgagaaaactagttataatgtcctaacagtaaatatatggccaatattttcatgaccccaaggtgggaggctgtgccttaaataaactgtcagaatcacacattaaaaaaaaaaaaaagtgatggtaatcaggccctgaggttcatttatacagaaagtgatttttaggtgagattttaatatttgcaatatttatatttgtaaagaggattggctagctcattcagaaaagtctgaggttcttaataaacactaggaaacagatggtttggggttgatgtcagggaaggtaagcaggccgtgctttagattagagcacttttgattgcaagtcccatgagccacacagtttaggccaagtgaaagcagttttagtctaagaagagcagaagcaatcgtagcctctcgggacagaaactgaagtgcagctgggcagtgggaactggatctggagagtctggagtacatgtcttctctggagctgggctttttccattcacatgtagcttccttgcttgagttacatgtagtggccttagtcatggctcctgcatgtcctgactctagttccagtactcatcatcatctgactcccatttctatggctcagtacaaaaatattcaagactgggtattggactgactcctctcagccatttgctttgtttccataggccaggtgatcatctcactctggtcgactatgaaagaaggttggttagatccagcagcctgctgatcatttagagggtcttagagtgagaggagattgtgtgagaagctggttatcatagcagggggtcctggcacctcaaactctgtccccatcaaacagtgtaaaagaaaagatattgactcctaaaggagtgtcttatgttcagatgctatagagttttgcagagaaagtgttcagtgtagctacagatagaaggccaagtgtccttggtcagccagcctgggtgtgtgtggagtaagttagtggtaggtgtagtaactgtctcaaagctttttctttgtctctctctctctcttttttttttttgagacaaggtcttattctgtcgcccaggctggagtgcagtagcacaatttcagctcactgaagcctcgacagcctgggctcaagtgatcctcccacctcagccccccaagctgaggacttagctggaaaacacaggcatatgccacaacgcccggctgatttttatgtttttagtagagacaggggtttcattatgttgcctaggctggtcttgaactcttggccagctcaagcaatccacctgcctcagtctctcaaagggctgggattacaggcgtgagccaccgtgcccggccccagaactttttctttgaatagtggagaagcagaacaccttggaatgctatggtctgtgcggtctttgccctgtgggtgttctcaggtggaatcaggcagtttgggtgatgtcagtatcatttgaggtcttccacagttcagctatttgggtgggcttccccacttttccccttgttttgggtcggtaaacataaaaggatggagatgtgtatccttagtaagaatgggagacgttgccttcagaatgggtagaaagcagaaaacaagcggggaagaaaacagaaaacagcctctctttaagtgtatgtggctgcctgtgtgcacagtccttcaccttttccttagtatatccctcctgcctctgatctcttgttgttcttgatttttcatggtagaaggaggaaacaaaattatagaagacaggtggaatactgtgaaagaatagtagtttggagataactatgtaaagggctactagcctgcgcaccgttgaattctctgaatttacagctgtttagtcattgatgtttcatagtgttgaccttgagtaaattcagaaaagcaatactgagtatgttctgctaaacaaaagaggaaagtgtatgtttttaaagaaacaaccttcacagtggtttcagtagttacagggatttggttcttttttaaattattttatttctttttaaagatggtctcactctgtcatccaggctggagtgcagaggtgtgatcgtagctcactggcaccttgaattcctggactcaagtgatcctcctgcctcagactcccaagtggttaggagtacaggcatgtatcaccatgcctagctgattaaaatttttttttttttggccaggcatggtggctcacgcctgtaatcccagcactttgggaggctgaggcgggtggatctcctgaggtcaggagttccagaccagcttggccaacatgggtgaaaccccttctctactaaaaaaaatacaaaaagctgggcatggtggcgggtgccagtaatcctagctacttgggaggctgaggcaggagaatcagttgaacccgggaggcagaggttgcagtgtgtcgagattgtgccatcgcactccagcctgggaaacgagcgaaactctttttttttttttttttttttggtaaagacagggtctcaatatgttgcccaggctgatcttaaactcctggcctcaagtgatcctccagccttggcctcccgaagtgctgggattgcaggtataagccactgtgcccagcctgatttgttttttaataatagcttaagatgtaattcatatattataaaattaacccttttaaaatatataattgagtgggttttcttttgtatatttacatgtttcgtgcaactgtccccactctctaattccacattttcatcactccaaaaagaaaatctgtacccattagcagccactccctgttgcctcctcctcccggccctagtcaattactaatctgctttatttctttatgcatatttatgcctagtgtgaacatttcatataaatagaatcatgtagtgtttgtccttttgtgacttgactggcttatttcccttagcataatgttttcaaggtttttatctatgttgtatgtagcatgtactgttacttcatcccttttttaaaattaaaaaattttaaatttaatataatagagatgggggtctcgccatgttgccaggctggtcttgaactcctgggctcaagtgatccttctgcctcggactcccaagtgctgggattacaggtgtaaaccactacacctggccacttcactccttttatttttgaataatcctctgttgtgtggatatataccacattttgtttatccattcaccagttaatagacatttgagttattccactttttggctattaagaaaaatgctgctgtgaacatttgtgtacaagcttttatatggacatatgttttcatttctgttggaaagatacctaggagtggaattgtggtgtcgtagttaactctgtttaactttttgaggaactgttttccaaacttttccaaagtggttagatcatattacattcccaccagcaagtatgagagttgtaatttctccacattcttgcaaacacttgttattgtccatctttttgattatagccattgttgtagatgggaagtggtatattattgtggttttgatttgcatttccctagtgactaatgatgttgagcatctgttcatgagcttattagccatttgtatgtctgctttgacaaatgtctattcaaatcctcttccatttttgaattgagtcaattgaatttttgctgttcagttgtaggaattctttatatgtgttctagatatcagtcccttatcagatatgtgatttcaaatgtatgattgacatgtgatatgtgatttttctctgattctgtgtgggttgtcttttcgcttttgttttttgagagagggtctcattctgtcacccaggcaggagtgtagtgatgcagtcatgtctccctgcagtcttgcctgcctgggcttaagcggtcctcccaccttagtctcctgagcagctgggacttcaggggggcaccactggtctggctaatttagaaattttttaatagaaacggagtctctatattatattatgcccaggctggtcttgaactcctgggctcaagtgatcctcctgccttggcctcccaaaatgctgggattacaagtatgagctgctgtgctggcctttactttcttgatagtgtcctttgaagaacagaagttttaaatttgattgtgtcccatttatctgtttttttgtttttttttttggtcacttatgcttttggtatcataataagaaaccattgtcatatccaaggtcgtgaaggtttacacctgtgtttttttgttagagttctgtagttttagctctgacatttagttctctgatagatcttcagttaatttttgtacacagtgtgaggtaggcttccagcttcatttttttgcatgtggatattcagttgtcctagcccatttgttgaaaagaccattctttcctcactgaagtgtcttggcacccttgttgaaaatcaactgactataaatctgtgggtttatttttagagtcttgattctattccattgatctatatgtctatctttgtgccattaccacaatgtcttgattctgtagctttgtagtaagttttgaaatcaggaactgtcagtcctttaactctgttcttctttttcaagattgttttggctgtgctagctcccttgtatttccgtatgaatattaggatcagcttgttagtttccacagaagagacaactgagatataatggggattatattcaatctgaggatctatttggggagtttaaattcattttatggatttgctgtatgcttaggaagtcctggctaactcagacacccaagcatcttgccttaaaaacacaaaattttgttttaatttattgatgtagtaggctgccttggtgaaacactgtaattcactgttagactggaattggacttttcaggttctaagagagcaaacagctcttccacgtagcgtgtaggttgacttcctgtagtaaatgtttttttgatgtgaaagtttgctgataccttgcatgttttaaaaaaaatgtggtattctggttaatatacattctggttaatagagaactagcagattatatatatgaatatttatcaaagagttaggacatgttacaataaaattgtgacattaaaatttatataattgttattattactggaggaatcagaagatattttaggaccttgtagtcccgcaggggccacgtgaacattggttattgttatacttttaagtcacttcatttactcaacaaataacaaagtgcctatctgtgccaggcacaaggaaggacagacccagtctctgtccttatggagctaagggggagacggacattaatcaagatgccatatgaaatttcagctgggactcagtgctgtgaaggtgcgtgcaatatgtcataaagggatttgactaatctgcaaggttgggggaggcttcttgagagctctggaggaaaatgggaattaattgtgggaagaattaaggagaaaagttccaggtaattgggtgagtttgttagtgagttgtgtggagatactctggttatatcctgtttatcacttttgggaaagagtatctgaatacttggctctggcctttactctgtcccttaaatgccttgtggctgagcaggtactctttctgagcttgttcacatactgttttttaaatttctgtagccatttttatttacagatacttacatgaaaacatacagaaatctaggcttttggttgattgttttcatataattaaaaaatcattcactttgggaggccgaggcgggtggatcatgaggtcaggagatcgagaccatcctggctaacatggtgaaaccccgtctctactaaaaatacaaaaaattagctgagcgtggtggcacgtgcctgtagtctcagctacttgggaggctgaggcaggagaatcgcttgaatccaggaggcggaggttgcagtgagctgagatcgtgccactgcacttcagcctggaggacagagcaagacttcatctcaaaaaaaaaaaaaaaaaattatttctttgtgaccttccatggttagctatttagaactgctttagtggtaaattgaatacttttctgaacatttttcctagactttgaaattaggagtcatttctgtttacacatacttcagaagcctgtcagggacagagtctgtagtgacagaagtctgtagggaagcagatatggatgtaagtgattcaagacaagtcataatgctttaataaggctctggaagggaagatggaaagacttccgggaggaggtggaatttgacctgaaatcattgacgggcaaacatggtagttggaggagaaattccaagcagaggaaatggaacagaggcatagagccaagagagtacagggagtgggtggaattcatgtgcatatgggtaggtaagcctcggaaagtaggtaggggtcatgttgttaggggcctgaaagtcagaccgaagaatctggatttaattctctgctcaggagaggcttttagaagttttttttttttagtagaggaatggaattgattggataaagtcgattctcctgaaacaggtgctaataagggccacctagttacttctccagcttcctctctacagtcacgtcacattttttagactctgattgttccaaggtcccacagtgtctggtggttttaggcctcccacattgctgttgccttgatttagaagttgcacctgcctcaggaacacaggcacacacgctcacccatgctcttgctgactttctgtgtcttctgtgtttcagcttaaatgaaacttccaataggagaagccttcttgaccttgcccctcttttcagattggatcggatgcccttcctgtgtgcaccatagcactacgtggttttcctagtcatggcacattttagtttgcattggagttgcttgtttacttctctttctctctcaattagatgtgcatttctggaggtaagaggcttgagtacctagacttagtaaatgcttgttggctgaatgaatgaatgaatgaatgagcaaataggaaggactagagtcgggagaaaatcacttctggcaagagttgtctgtagaattggggtgaggaaagagctcgcatggctgaggagtgtgtgtgtcacacacacatgcaattttgtgactgactgaatgtgggccttgagggaaggtgactcctaggttttgaaccataactggggatttagtgaggccagactgagatagggaagacaaggcaggtatatttggggagaatggctgcaaaggtaccactgtttttcttcttcttctttttcttttttttttttttgagatggagtttcactcttgtcgcccaggctgcagtgcaatggcatggtctcagctcactgcaacatccacctctcaggttcaagcaattctcctgcctcagcctcccgagtagctgggattacaggcacccaccaccatgcctggctaattttcgtatttttagtagagacggggtttcaccatgttggccaggctggtcttgaactcctgacctcaggtgatccgctcaccttgacctcccaaagtgctaggattacagacgtgagccaccgcgcctggccggtatcgctgtttttaaggcgtcattgggtagctttagaatgtgtatatacagcgtgacattggagatgtgggtcaaagatcagggagtccttcatatcaccctgctttttttcttcattgttcttccagagggcaagggagggagccttggtgctggagtccttagaggtcagccccctgggcttggggcagggagagaagggctgtgaggaggtctggaggggcagatgcagtggcagcagcacagcacaaaaggtacagacagtacctttgcaaccaatgaatgaatcagttcaaaacaattagaagtcacagttgtgagtgagattggaaggggagcagagaaggggcctgagggcagaaatgtgatgaatgcttacattttaatgccaccagaggggagagaaccagtagaggctgagaaagaatggtcggagaggtaagggaacaagcagaatatgaattcagggttgctgagtgtggagggttgaaaggaggttgtcagtcgtaatgctgcagagttgagtagactgaagactaaggaagggtattggttttgtcaattcgataatgagagaataaaggagtagagatagggtggatgattatttcagaaccgtggtggcatatacagagtactggtagaaatgatggtgaaatgattgatccagtccaagatgagaaaagaaaccactgtggcctgatgggctgtgagtgtattagttatctatagctgctgtaaccaatcatcacaaacccagtggcttcaaacagcccagggtggaatctcctggttcccatgggtcaggcatttgggcagggcagggctgggtctgctggattgggactgctgaactgtggtcgaggtgctggccaggactgggctcaccttggaaacctctggtaggggaggatccacttccaggctcccttggccatttgaaggactcctttctttgggctgttgggctgagggctcagcttttcgccagctgttggcccgaggctaccctcaattcctgccccaggggcctctgcaacaccatagcttgcttcatcagagccaggagggacagtctctagcaagacagaagtcacagtctgcccattacctttgccatgttctgctggttagaagcaacttgctaggtccagcccacactccgggggagggggttacacaaagctgttaacagtggctgggcgcggtggctcatgcctgtaatcccagcagtttgggaggctgaggcaggcagatcacgaggtcaggagatcgagaccatctggctaacacggtgaaatcccgtctctactaaaaatacaaaaatttagccgggcgtggtggcggacacctgcagtcccagctactccggaggctgaggcaggagaatggcatgaacccggaggcggagcttgcagtgagctgagatcgtgccactgtactccagtctgggtgacagagcgagactccgtttcaaaaaaaaaagctgttaacatcaagaggtggggatcataggaggtccatcataaagtttgtcctccaccgtagaggggtggtgacgggattagaaggcattataacagttcttcaggtgaggccttggaggatgcagatggaaaaacgggagctttcagaggcggaagttttggaagtgcagttccagttgaaagttgggatagtcaggtggtgacgcttctcaggaggccttctgtgccctttgtcttcatgtgccttctatgtgctctctcctgttagacaaatgaacattctgtgttacagttgccaccgataaatccatctgtctggctaaaatggaattatttaccagccaattcctggccagtggaggtatctgccctcttgccttatggttttgttgaggatcaaatgaggtaattcatatgaagtgttttatagactacaaagtaatatgcaaacaaaaggtattaaacggtgctacctttttctctatgttaagtagaacccatggaatttaacttacattttccttaataacttgggttcattatgttgtatgtagcttattaaactgggctttatttaacactgtgatttgggtttttggagtagagagtttacttttatgataaatgaccccaaactgctatacctttcaaatccttgtgtcccatttttattgtttaaaaaaacaatctcaccttgccgttgcctgtcactcttttgcttctgtgtgtcagttttgagctacattttttcccctccgatttgttgcttctgatctctgggcttggcaacctgataatgaagcatattagagctgtgagtagttttatagtaatcaagctacgaatgtgggtcggagaaactcttctcacagtggagtacataagcttttgtgcatggacttcgtaaaattcacttttggccttcagagtgttcttggcttccttcctagttctggctgtgttcggattaagggaggttcccagatagccgacctccattccggggctgtggctgccattttcttggcgtccacctcattgctctgttacgagaaacagtgtcattctcttctttagttttgatgaggttttagttctttgggcagtagcaagtagtgataggtgatggtggtctgtggttcatggaccaaaaaatgtttgagaggcatggaggatctttagacaagatcaccttctaggtgtatgtggtagcattctgttccaccgctctcttctccttcaggatgtctccctcccagctaacctgctcggtgttcctcagtgggagcgtttgccttagctttctctcagagcatcgtacttactttttctgcccgcatttttgcattgctgctttgtggagaagcgttgctgcattattagggagagaaccgtgttttcttgtggaaatcacacagtagtatgggagaactggtctggttctaattctgccccgtcctagcttgtggcctttgcccagtgccttgttacccatgtcttggtgtctccatttctagaataggcttaatgtgtgctttgctaccttttaggatcgaaataagattttatatatgaaaatgcttgttatacgtacataatattgaatagaatgcctagtttgttgggttgattttgttgatattttacaatgctctctctgaggagttaaacaaaattatcattagtatgggtaacaataagtactactgaaacaatatcattttaaatgttatacagttttttttactgaatgtattctagttgaatctatttgtacaaatgtggacatttagtaagtgctctttgattattttcagactttgagtatactggcttccaagccaaattaaatttatgaaaattctaatgatactgtgattcatatctagaaagaataatttaaaaaaaactgtaaaatcactttaaacatgctttacgtgcatctctggtaatagagaatcaattaatctgatttctcaggccataaatctggcttgatatattgtaatattagttcctgtgtcagcctcttagaacttgaactgttttgtagtctgttccagctacttgtttgcttttgaactcaattctaggtgttgaactcaatttgagagcctaaaatggtttgtgccccaattaccttagaggttactgtttcatttttttatttagcctgccccaggagtaggaagtcggctacctaccagactttttccttttaacttgactgtatactttaatttttgtctctatcccatgggggagttgtgagggttattatagtatagtagcacttaatggcatattttaaacttcttgaaaagtggtaatatgtgagcacataatatttttgtactgtagcacataattttttcccacactaaccttttgtggttcagaaaaagaataaagttacttgggcttggggtacatgttgaattgcccatctcataaaatcgttaacctgattttagggagtgtctctgaaacatgtcttttgacagaccttgtgctgtttcttatttattattaataaattgatatttcatttattattcataaattaatactaattaaataattaattgtgctctagcccccagttttagtttggttttcttggtatctctgaaaactgttgagtattccccctactccttttaagtttttttttttttttaagcaggtttaaagtagcttttatcatattccttgatttctcaaatgaatagagggataaggttcctttctttaaaaatatctgcaacattgctggactgagaggtcgtatttacagttttttctttttaaaaattttttttagagatggggtcctgctctgttgtccaggctggagtgcagtggcacagctcacagctcactgcagccttgaactcctgggctcaaacagtcctcccgcctcagcctcccaggtagctgggactacaggttcgagccactgcttgttcagtctcttgcttttgtctcagtggcacagtaccaagacatagcaaatcaaagtgaccaagaggatgagtggcaattcggtggccttataggaagagatgtgcttgaaaacgacagaaggcttttagtaaattccaccaccatcaccaggacgagagacgggaccatttttcctttccataaacttaggggctggttattaatttatgaattctataagtaatttgagcttgtgttatgtaccagacattgtattaagtattaccagagatactgggaagaacaagccagacatcctttcaaggatgcatttgataaaatctcattttgagtatgttaggaaaatatttattggagaaggaaacctcctagattggttttagatcccgaatggccttagggattgaaaatggagttgtaggttagcagaggacatttctgaaaggagtaactattttgtaattaaaaagcagtttacagaagatactgtggcagagactgctagttgatcatgaaacccatctccttctcttcctcctcttcctgggcattttccagtcccccttggaatcgtgaccaaattctagccagtggggtgagagcaacgaagtgtgccacttccagacttggcccctgaaactcttgaggcatgggtatcatgccttttccttatctggcttgatgcagagggcctagtgacctagaaagtcttctgccacaaggtagaaggagcacaggcagcagagccactgctgtgagaacagtctgcccaccaggagcacctgttttggactttacctgagcaagaagtgaacatttttggtatttgagccattatacagttagcctccctaactatctaggcacgatgcctaggatgctaagcaaaactggactgagaggtcgtatctacagttttttctttttaaaaaatagtaaaggtgctaagtagtaaaggtgctaagattcaggcgcggctttaattctgtggagacctaaatattctttgtctttatttcaaagaacggtaaatacacttttcattatgctgtttctctgttccaaagcctgtaatcacttcttactatatagcatcttgtttcattaatccatcttccaaaaactctaatatatgtatatattatccatatacaatgaatgtgcctgtgtgtaacatcctgatctaggttctctgagtggagacaaaatgaataaaacatagtccatggcttcaaagagtttctgcttgatagccaggtagttactgaatttccatactgctatcatctgtcccttgttttaacctttaagtcatatattattttttcattacctttttttaaaagtattgtttcaattagatagtatactttttgaaaacagggaatatatattatagagctctgcatctctcctcttgggtatttcttttttttttttgagacggggtctcactctgttgcctaggctatagtgcagtagtgctgtcatggctcactgcaacctcgatctcccaggctcaagcaatccgcctgcctcagccttccatttagctgggactgcaggcacacagtaccacacctggctaatattttaatatttgtagagacagagtcttgccatgttgcccaggctggtattgaactcctgggcttaagcagtcctctcgccttggccttccaaagtgctgggattacaggtgtgagccaccatgcccagccttcttgggtacttccagcagaaactgggcactatacttgagtaaccatccctagagtttctactaattatcttgtgtggatattctggtatagttttgtattatgtactaacagatgaaagtactttttaaatcttctaggaattagtggaattatgctgttgaggaatgttaggattggaaggatcttttatagatcatttatctaattcctgatcttttagtttgatcatctggtttctgatactcaaggtgtggccattaattgcagcatgggcatcacctgggggcttgttagaggcagaatctcaggttctccctcagacctgtgaatcagaacttgcattgaaagaagatcctaagataacccgcatgcacattacatttggagaagttctgctcaaggtcaactactcatttgactcttgagaaaactggggaagtcagagagttgcccagtcatacaactgtttatttcagtggttctcaaccttggatacatcttgggatcacttggggacctttaaaaaaatactgaggcctgggtcccatccccagacattctgacgtaattggtttgggcatcagagttttggagatttcactagatgactggctaaggctgagaaccattgatttgattaatgatggaatccaggtttcttcatgctctaatcaagtattccttccactccaccatggctgtacattcagaaacaatgaaaaacatcctatcaaatttttacagtaatgcatcactccatttcatttcctttataggaatttacccctattggatagtgtcccatttaccatctgtcttccccccactagaatgtatctccaagaggacaggacccttgtctgtcttgttcagtgctgtgtcccagcttgcgaacagtgtctggtacatgttaggtgctcctttaatagttgtagaacaaatggaaggagctaccataaagaaggatgtgttctgtgagaggaaaacacaggctactctaaaggtaccctgtgggcgagaggcttcctgaagggtgaggggtctgagttgaagtgcagaatcagcgggggaggtgcttgaagacctgcttctgaggaaggacttgaacccagatctgacttgaaagcttgtgcttttccattccactgtgttgtcctgtggacacagtggctcactgatttgcccggacttcttagtagtgagtggtggactggaacacaccaccgcggctctgcaggtgcttaaggccagcccgcctccctctatggcagagccgccccagtattgcagacaggcgcctagagggagatcaaaacacgaagttgtcctgtgaaagttcctggcccagtgtttggcacaggggtatctagtacaaggtagccctttcttatcatggaagtttttttgtgctttggcttgttttgagaacctatggttttcaaagatagaatgacttgatttcagttttaactttggtttctttcctagttaactatggagacttcattatgcagtgctgtggagagagtgtgattggtttttgtctatgatatttctgtgtcatatgttattttagtgccaagttcttcctgttatttcagatattctgtcactgatttacttattgttagactttgaagttgggtataaaaatccttttttatgaagctattcattagtgtgtcccactgaaccaaagtgatttttaaaaacttttcacctaagaccattgttaagatatctcaaatggtaatcttataccgtcagtttttgataataggaagccaggaaatgttaagccttgaatgtaagacattatttttaacatcgtaaaatttcaagttttaattcagaaactaaattaaaatgaggtattacattcatgtgattagtgggctgttactggtgactcttaaagatgttacaagaagtcagcgtgctgctgacttttcccctattggagatcttcccatgaaccacttttcctaaggtatgatgattccatgctcacagtcatgggtagaaagtaatgttggattttccaaaggatacatgaattccgagccttgtctagtctatagggtgaatccttggacatgactgttaccacagatgttatcatagttaactactttttttgtttttgtgtcagggtctcattctgtcacccaagctagagtgcaatagcatggtcatggttcactttaggctcaaattcctggctcaagtgatcctcccacctcagtctcctgagtagctggggttacaggcgtgagccactgtgcctagctcagtatactactattggttaaattggagagggaaacagtcctagaacaagagttttacagaaatagaaaagaaagaattaaggagctcatggttatcctggtagctaggagtcacattatagagaaagactttatttatatggaccctgaaaacaatttgacttctgaagcacttgatcatgggcataagggagaggaaaattaataattcttggaagtcaactttagtcagattgcaacattttttggcataaaaaactcaggcgcggtgggtcatgcctgtaattccagcattttgggaggccgaggctggcagatcatttgaggtcaggagttcgagaccagcctggccaatatggtgaaaccccatctctactaaaaatacacaaattagccaggcatggtggcggacacctgtgatcccagctactcaggaggctgaggcaggagaatcacttgaacctgggaggcagaggttgcactgagctgagatcccaccactacactccagtctgggcaacagagtgagactccgtctcaaaacaaacaaacaaacaaataacaacaaataaataactcaggcaatcctgtttgttcttagaaaatgttaacattgttaaagctcaccctcattaactatggtaacaatagtgttttgtatttgggtggtacctttgaattgaaagcacttgggtatgtattacctaatcctcctcctgcctcagagagaaggagagagaagtatccacccgccctttttggatgaggtagtacagagaggttgaattactttcctaaggacagctagtaaatgttagaactgaactctttatattttattttaattaattaattttttgagacagggtttcactctgtcatccaggcgggagtgcagtggtgtgatcatggctcactgcagcctcaacttcccggattccagcaatcctcctacctcagtccccccaggtatctgggaccataggtgtgttgccaccatgcctggctaatttttgtatctttggtagaggtgaggttttgccatgttatccaggctggtctttaactcctaagctcaaataatccacccgcattggctccgcaaagtgttgggattacaggcatgagccaccacatttatttatttatttattattattatttttaaagatgaggccttgttctgttgcccaggctggagcaggagtgtagtggtgttatcatggttcactgcagccttaaaagtcctgggctcaagcgatcttcctaccacagcctcctgagtagctgagactacaggcacaagccaccatgcctggtagcttttaaatataaaatgttgagggtggttgttgaacttgtaaactatctttggttttctaagtgtataaatatgtggtttataatgtaggatgaataatctaaaattttatttaatactgcagccaaacaaaaaagatatttttaggactgaaaataattggccgtcaatattcaaaaaattttctttttttttaaaaagttaccgttgtgtaggttttaggtgaaatctttaattttatctgagtgaagcagcctgacagccagagaccttgtttctttcctgttaacggaattccccttgatttacttgccatgccataatactagttggcgctctgcacattttttgggtgagtcgggtgttgggtttattgttgggaaatggttaaaaatgttgttggtgttgactgagcttcaaaatgaatatgacattggttcttagcaaaaatttcctctatgtacagcacacatacttcccatttaaacaaattacacaagttatgcatgttcatcagcacagaccttttctcacatatgtatctaaaattttgaagcagccttaagcttgcagtgcaaagaacggtttccccctgagccatttgaggataaattgctgataagttccatcactctcaaatacttgatcatgtacttcctacaaacaagaacattctcctccataaccacaagaacagtaatcacaaccaggaagttaacactgagacattcctactctccagtcctaaagtcctgttgctgtttgccagttgatccagcaatggcctttgtagaaaaatatctaatcagaaccttgggtcataactggttgtctcttcaatctcttaatacagaagagttttcagtccttttagactttcatgaccttgacactcttgaggattgcaggccagtcattttgtggaatgttccttgatttggatttgtctgatgtttcctcatgattagattcaggttttgcatcttggcaggaatatcacagaagagccagattatatctttttgaaagattagttttacattttattttctgtttccttagagcgtttcccaaagtgtattctgcggaactagcacctactgtgttctcaacaccgtgccacctatagaaggtaggatttgaaaaagcttttgacttacaggaaggggtgggcttggcagtggcagtaattatcatctagtacagtggaaacagccttcagcccggactcagaagacctgggttctgcacttaactgctgtgtgatcttagatgagttacttaatccttctggggtagcaaaaagaatgctctcctcataaagtttctgtggagatgaaaaaaggcaaaagatttaatcacacggagaaatcaaagcacttaacaaatgtttgatactaatacaacacttctgtaattctagtgtccaataccaggtgacttagagtaggagcagtgtggtattttgggaaaagccacaggtcatgtttgaatcccagctgagccactcagcagctgtggatcttgggcaaattaatctgagcctcatgttcctcctctgtaaaatgggagtaattaagcccttgtgttttatcgtgaggattaaatgaaagagtgcaatgtaagatcctttctgggtgcctgatacacagtagagtcccacaagtgcttactccctaataaataatggaaaatagatttacttaatcacatgtacctccagttggaattgaatgaagtagaggaggagagaatgtcccaaaacccaaattgaagtgatggcttacagggctgctgtgccctcactttatctgttccctcatacatatttttagattgaaaatgtaaatgtagataaacagtgagaagtttattgaacctgagttatgatttgacctaagcctggacccgagattttgtaatatgatcaacaggaaaaaggtaaatctgggctacctaaaaatagaagcggtaagttgatcatcacacaactctaagaacaagaaggggattgttaaatagcaaaactaattatatttttctacttaaaaagctgttagtttctgtttctttaaccttttaaaaatcttttgtagaattactactgggtttaattcactttggagactttggaaaagaataatgcaaaatcagatcagtgtttggcacatagtgcttaattaatatgtattttggatatatggtgatttgaaggccttaggttagtaatggctgtatttgctgctgtgagcattatgctgacttgaatataacaatatatgtttatgttttcagttcctatcctactaattaaatctaagcacataataattagagctaaacagaaaattgtagagcttccttttgattttactactccatgttgttgatcaaagatattcccaataagatttagcaatttgatacactgttataccaaactgtttgaacagtttggtctagagtttgaaagattaatcgtaatcaacttgaatgaataacagtgttcatcattattcatagaaccaacattattttttattatgaatcaaagtaaaatgaatgtatcatttctagattagttaatatagttataatttaccttggcagaagtcacagaattttcgaaggaaaaggtcaaatacatttctttggatttaagtaaaggatttggcaatgtgaatctcatttttttgaaacaaaacatgaaaacagtaattctgctttttgtctaagtgaatgagcatttttttgcatattggaaagttatattatactacaccttgtaggttgactagaaaggatggttcgttctttagaattagagttgtcagtcaagcaaatcatctgtcattttcaagagcctcactagttatttttttattgtgaagtaggttagaaaattattttgtaaagtctaataccatacacatatattttgttagataatgataatgaagtgttttactgtcatttggttgacactcccacttttcagtgtcaaagttcaactatttgtattgaatactgaataatgcagtggaaaccagtatatgccttaattttactgttcactcaagatactattattaggatttgaaaactggtgcatgtgtttagttattttatcattcttagttatcccaaaacattaaaaagcagattttaatttaaaaacagatttttatgcagtatagccatgtaaagttcttttccagtgtaaaatcaaagtttctctgtatcccacttcacctgtagaaacactgaaatttaaaaatatgagttttaacattttgcctatttgaaattccagtaattcttttctcagtattaaactcgcaatccttataatgtagtaggaaaatttacccattgttatgtttcttaaaaacatccagtttatattcagcgtgaacctaaaattctggaaatggtacactttaaaaactgatcaaggggaacccactggccagtcatattcctgttccttttgactctgtggccacacctccgtgtaaagtgtaatgtttagaaactagattgagagagtgcttacacagccctgccctttggtcacatttaccactgcctgatttggtatcagagtggaagactgaagccttttctatagcagttaattgtgctgttgagaagagtacctttattacataaataccacacacacacacacacacacacacacacacaaacacacacacacgcacactctttatataccgcacagtagctgggttcctcgaagaggctaaaagaacagaaaattaacatcagattgtgatcacaaacatagaagctggggtttaaaactctgctcgtaagtgttcagaattgtacttcaaactgatagctttctcagagatatggctattcatatacaattcagagcaagcccatccattgagcaaccagtatagtgccgttttcataaaaggtacctgtaaatgttgaatatttgaattgagtatagattttagaatttcacctctattttcagaattgtacatatcatgggggattttaaaaaatggaaataaaagtactttaggggaagagagaagggaggtaaaggctcacgtgatctggtattctctgctttaaagttttatggcccgtggaacctccctcgggaggatgaagtgcagggagcataagcacataagattaccgaggttttatagtgtgtaattcatacagaactttctatgaactttcttttagttgaacagtttccttttggtttcacaggaagattttttgaaaggtttaatcttattttcctattaaattaaaatttgaaattcttgaaagcagtcagtttttaggtttttaaagtttttatactgcttatagaaatagaggatgggtattataattcaattggttatgtagttcatggaccaaaaaagatttagtatgccaaaactctcttaagttcatctccataaaatctttctatatgatgtagtaaattttttagactttatttctatgcccaatattttccttttaagatcttttccttgagaagaagtgtgttaatcagatgaaaaatgtttggagaggattttgtgaccttagaaaatattttttgttctttgatgtttttcatctgttcaaaaaaatagactgtactgaacaaagccgtagtaaataactggaaaaagatattgttgtatttcacttttaagattattaaccaatgcctgtatacttatgtaaggttgcttaattgtaaggcctattaagttatttaatgacagtaaattttatagggatttgtgtctggagaagaattagagataatctaatcttgttgatttgggaaaactgaaactattaagtaacttacccaaggtcacacaattagaaagtagcagaactgggccagatcttggactcttgactctgagttcagtgttataaaaccttattatatcatgaaaagttgtttcaactgtgacttactggagcaaattaagtctttgatgttttaatgtgcagctccttagtacctagttatgtgtaccctttgtatattggggatcttatgtagcataaaaagcctgggatgaataatttgtaactttgacctaaatgtgccaaagcttgtgagaaattttgagtcaggcaaagaaactttgttataggagtgaaaaaataaatgatatgtaagcaaacaaatgagtgaaataaatgttatataaaggaaatgatctcttctagaaatcatcaggtagactgattattaggtagtcagacataccatctagtctgaaagtaattattttttctctaactcatttagaagagttacattttgatgaaatacattaattatgtagatatgtatatgtaaatcaagttaattaaaatgatgattttatgttcagacctagaaaggccagcttctgtattacctgagtagctaactgcaggcttaaatcccttatatttataagatttgtgatttgcttttgaaaggataaatctcttttatagtctaggggatgaagtagtatttacgaacaaaatagtcatatattactataattcttcttacctaagaaacttaacattttttcaactgcttaataaaagatttttgggctttgtgaggttaattttataatttttatgtgcttcatcaaaacatggggaaagaaccttttaaaataactttcggttatgggcagctgcggggattttccctgttcactcacatgtcagggagcacaagcccgatcctgttttaaatcctcttgaccagattcctgctgccatcaatctgataaatgggtaaatgagtattattaactaagaggaatagtggggcctctgatgctcttggtctcacattgactaaactgagctgctatttctgactttgtcagtgtactttaaaggagattttatctattattttctctaaatttattgttttcttctttgtagatgatcatgggaacagcaatagtagtcatgtaaaaatctttttaccgaaaaagctgcttgaatgtctgccgaaatgttcaagtttaccaaaagagaggcaccgctggaacactaatgaggtagataagtttctttttttaagggtataattattttaagggcaaattttttaggttgcttcacatagtcctactttatgttagctttaaatttaaaatactgatctaggaaattgtaaatgacattatttaatctggatttgacagaaaccaaccaacatgttttttgatctgtctctgatctgcttggcttgcattgaaagatacacaatgtgcacgttgacttaactaaagtagcatgagtttctgtctgtgttttcttgcattttagtgtcttgcatttagtggttaaccctgcctgcatgccagttaaacgttagttgttatgtcttcatgaattaataaatatacagtcccactgttccacagaatgtgtagtgtcttgacaatgtgaatttttgtagagttggaaagggcaggtttcataggagtgaaacagcttttcgtcctttctaatgaagaaagtttgcttaatgctaagaatttttattaagattgaaggctgtacagtagattatgtatttagcatccaattagaaagtagatttatgaagtagaatgaaaaaagttaatcatcttggatgatgtttccttttttggtaaattttaatccaggagtcttactgttaggagtggattgctttgtcatcttttttattttgaaatctgaatatttcaatttaaggtaatacccgtttagtgtggtgatgagaattgggtatacgtccatcaatttgggagttatattcctttaattcagatggctggggttgctggttttgccaagttccatttgtgtgccttggctcaacattgatgtccaagttaaagcaaatttagcaccctatccttattggacactcagttctgttaaaagacacaagaagaaaatagtgctgcctattgagccttattttttaaagattctttggcgctaactacttcctgattcagaatgcttttgttttgcgtggtgggaggttatgtggataaaagtctctttccttatcacaggttagatttaaatactcactggaaccttacagctttgttaacttgtctcaactgattgtaaaattctttgaaggactctatgttttgatcattttcataaattacattttcccgtcagacagaatgtttttgctttgacaaatgtttgctagtttagaggcctgctgtttaaccagttatttattaactatttcagacatttttagacgtgaaaatgaagtagatatgcttaaaattagtcttaatcatagtttgttactctttcagcaaaatagtattatataatttggaagccatttaataagtcggaacttgattatgaattatttaaaaactcagtgtatttcttagtattccctgaaacgtagatttgataccaaattattatacacgttagttctagtttatttataaatgtaacccaacccataataagtatgtatttttccatattatatttcctgtggaattggcagcttatttattttattttttcccatggacccatgtcttgtggcagtttattttaactatgatttgacattatatttgaaaccagaaattgcttagtgaattaaaatcagtggcctgaagagtcttataaagctggatgtagcagtgctgggaatttagttggtagattatttccatcagtggcttcaaaactttttgaaacttttcagcataacccttcaactttcacatgtttaataaaacctctaaattatttacatgttgcaccttactagtatattagatacgttttaaagcatccgataaagaatttttatagaggatgagattaaaagaaaaaaatgagaagtttttccttattttctttctggacctcagtccacatactcccttggaggccagaggctgccataattcagattacagagaggaaaatgcatcccattctctcactggtgtaatgcaaatttgaggatctagatgggaaaacgtggattgttttgcatcagctatcactcatgctgaaatctaggtagaggagcgtatgttctgaagggtggaggcagcaggaggtggcacagctgatgggtgaagccatgcagcaccctttcccttgggatgggctgttctttcagttaattgtcagctcagctgacaaaagctcctatgagggaactgaatttacaggttgactcatttctctgtagaggaccttgacttttttcttgttttattttttggctttggaaaaatagaggaatattaagtgtgacagcgaagacttaccctacgaattgttaattctgcagaatgttatgtggcgatgataacctgctatttttttttttttaaactggctttggtaatataggtggaataaagcaatcagcggtgttactaaagcacttctttgatctagctgggaattggcattttcttacgttcttcagcctgccattcttcatgttgacatgaaaacctgaaggaaacgtagttcagtggacttgtttctcattggggctttgtggtcctatgtcatgctaaatcatatttagtcaaaattgcccgtgaaatcccttgacttgctcataaagtaaagtttagtcagactgcccttattaagagcccgttttccttccagagttggaatagatttctgtgttttggatgaggaccacatgaagtagttggcttgtatttagaagctgtgttgtacaaaaactctatttcttagatcccactgaaggggctcacactggaagaggcgtgtgggaatgcgcacagttgagagcacagtagatttgtgttttccatctcactccctgtacagcatatgttcacaaagtaagactggtggctcgagctgcctgtatgaaatgtcaactgtcatctttctctgttctccatgttcgtgtgtgctcgctcgctctctctgctggatgtgtacagttgaatttctgggtataatgtgactcctctatactaataaggaattcctttactcagacctgtgtttaaatatttgtgattgtttgaaaaaaccttttatactgtgtgtgttgtgagtgagattgtgctcattccatccttttttttttttttttttttttttgaggtggagtctcactctttcaccaggctggagtgcagtggcatgatcttggctcactgcaacctccgcctcccgggttcaagcggttctcctgcctcagtttcccaagtagctgggactacaggtgcgtgccaccatgcccagctaatttttgtatttttagtagagacagggttttaccatgttggccaggatggtctccatctcttgaccttgtgatccgcccacctcagcctcccaaagtgctgggattacaggcgtgaaccactgcacccggccccatcctaccatttattgagcacctgttctttactactgactgggtattttatataattatttgtaagccttaaaatagtattgcaaggtgggtaacatttccttttagagatgagggagtgtaggtagacagtagttattttttggtcaagagagcatacttgatagagcctgtctctgagcttaattgcatctgtgttgcttgttaattcttaggaactttcattctattgtttactctataggagtttaatcaaaggcctacaaacctaaactacagcaagtctattctgtaacgtagtttttttttttttttttttttttggagacagagtctcactctgttgcccaggctggaatgcagtggtgtcatctcagctccctgcaacctccacccctcaggttcaagtgattcttgtgctttagcctcctgggtggctgggattacaggcatgtgccaccacacctggataatttttgtattttataattttgtagagatggggtttcgccctgttggccaggctggtctcgaactcctgacctcaggtgatctacccgcttcagcctcccaaggtgctgggattacaggtgtgagccaccgttcctggcctgtaatgtagttttgaattaaaaagagttaatatagtcttaatattgtggattcatatgcaaatgtttggtgaagctgaaagtcactaaaaggaagactctaagaaggtaagagagatcgttggacctacttaagctacttttaaccttttctaacccattggaatacctaaaatcctttcccttcttggatgttatttgcaattgcagaataaattaaatgttacatctgaaaccaaatcaattttagattgtgctcccgcagccaccaatactggtcctcaggtggtaaagatgacacaaggagtgaaggtgatgatggctgcactaattatggaagccagtatgtattgaacatcctttgtatgctaggcactagtgagtcctttacatgaatcatcacatttaatctttcagttaatcctatgagatagattatttgactatccttatcttatagatgaggaaactgaagccatggatatgttaactaatgtacccgcagtcagagccgggaagtgggggacgggggagttcagccgctgcagcccgactttgagtcccataatccctcattttgtcccacagagcaatatcaagttgacttttccaagatcttgtagctatttagttctaatcctttcgttttatagaattgtttggcttcttcatctgattttaaaatgttgtaacaaagttaatctaattttgcattatgattttttaaaaagtggcagacactcatttcttaggaaagtagttttgattcctttttttaaaaaaagttttctcctacgtgtattttgatagttttgattctttttttatttatttattttttatttttttttttgagacggagtctcgctctgtcgcccaggctggagtgcagtggcgcgatctccgctcactgcaagctccgcctcccgggttcacgccattctcctgccgtagcctcccgcgtagctaggactacaggcgcccaccaccatgccgggctagttttttatatttttagtagagacggagtttcaccgtgttagccaggatggtcttgatctcctgatctcctgacctcgtgatccgcccgccttggtgtcccaaggtgctaggattacaggggtgagccaccgcacctggccttgtttttttttttttttgagatggagtctcactctgttacccaggctggagtgcaatgacgtgatctcagctcactgcaacctccacctcccgggttcaagcgattctcctgcctcagcctcctgtgtagctgtgattacaggcatgcgccaccatgcctggctaattttgtattcttagtagagacagggtttcaccatgttggttaggctggtctccaactcccgacctcaggtgatccgcctgcctcagcctcccaaagtgcttggattacaggcgtgagccacggcgcccagcttaaaacaatttattgaggtttaatttatgtattacaatataaactgcacccatttgaagtgcataattcaatgagtttttgacaagtgtatgctggtgaaactacctccaaaatcaagacacggcacatttctatcaccccataagtagcttgagagagtatttttttgtttgtttgttttgttttgtttttttgagatggagtctcactctgtcgcccaggctggagtgcagtggcgtgatctcggctcactgcaagctccacctcccaagttcacgctgttctcctgccttagcctcctgagtagctgggactacaggcacccgtcaccacgcccagccaattttttgtatttttagtagagatgggctttcaccgtgttggccaggatggtctcgatctcctgacctcatgatccgcccgcctcagcctcccaaagtgctgggattacggacgtgagccatcgcgcccggcccgatagttttgattcttaatgactattagtatgtggactatggatagtgaaaaaactatattaaaaatagaaattttgtacctgtgtgtaacttgagcattaagcctgacttttatattcagggcaagggagaaagaatgtattaaacacagagcacattcattaaagaacctactcttgtttcataatcagtttggtgttcacatcttcatcaggtgaactgctataaggtttctgcattttaagttagtatttttaaggcctagagccagaaataattatgctaacacaactgtctgaattcacaaatgactatttcataattacgtatattagtactccatatatgttgtccagactgaaaattgttttgtttagtcattaattagctgtttgacttaaaatataactactgcattccctagtctctggatctagatttcacttggcattcttccaaagccaaactaatgcagcaccatgaaccttttataatgaaaatgttctccctaaatatgttcaaatcacttttgtgtgttactatttttgaactaatgttctttttttgtttttcctgtaatacacagtttctctagagtaagcaaacaaaatagaattctagtttgtactgatccttaaagaaagtttcatcagatgtttttagttggtggtagctttagagtgtcatattaaatgcattttttaatggtaaaaatgtctatgtagagagcagtataggttgatacattctaagccacaccaaagcgtctgcaggagaaaaaacaaaacaaaacttgagtaataattataatgctttttataggaggaaacttactctttaaaaatcttgagtactttttccccctaactttttatatttaggtaagaaaaatggcctttaacactgtaagaattattaaataataattaatttcaactgtttttaacatcaagccaccttatttttttttattttttttttttgagacagagtctcattctgtcacccagactggagtgcagtggcacaatcttggctcactgcaacctccacctcctgggctgaagcaatcctcccatgtcagcttctgaagtagctgggattataggtgctcgccaccacggacctggctaattttttgtagagacagggtttcaccatgttgccaaggcccatccaaacaactgagctcaagcaatctgcttgccttggcccctcaaagtgctgggattacaggtgtgagccactgtgcctggttaccttaccttttaaaaaatttatttagtctttttttggtgtcgatacataatcttgagtgtttcttgtgtttttaattttttttcctttgtgtaactttgtgttaggtttagggctgtaatttttcagtgattggtttttctagtgtatttatatgttatctctttgaaatatagacacacattttggggggatcatttaagactcttcagacttcctaaatgtgagctaagctgaaaagcaccagtactctaatcataaaggcaggtgagatatttcagttttgatggcgtggaaagtcagttaacctttaggtagggcttggttttgtttagcttttggcagggctagtggtttgaacggtcccagattattttgttccaggcagggcttttctgattaaattgcaaaaatgaaaatgcatataaacaacacagagagccaagttttaagagtgacattatgtgatttttgaacacagtatatagtacgaagtttcaaattaaaagtgatacttgtgtagcagttaggttaaatatagttcctctgtttgctttgctagtgtgaagtgagatacatgatactgaaatacaggtaggcacaagcctggagatcaggcagcctgtgtcaagtgtgcagtgcctcagcagcagcagcagcagcagcactccacaggatatattgaaaagctggggcggaatgtcctcccacacaggtgaggggagacaggtgaaggcaggtttgacactgaggaatagtaagagaagtaaattgcaccctcagagtacagcaatatttatagcatttgaataagatgttaaagaacattttcttttaaggaagaaattcctgtgggtcttcctcagtttcaatctaaactagttttattatactattacttcagcatgtggcacttaacctggccatagtcagtgttcaataaatatttgttggatgaattaacgtaaaaacacaaaaaactcagtataaaattaattcttggagttcttttgcaaatataaaactcagatatatgcattacataaaaagaaaatacaaaactaataaagttttatattaacagggttagttaaatgcaatagatgatgttttgccaaaactaaattgtctcgcaacatgagtatcatactgactgttctcaagcaggttcttttgaatttggcatgcggtactatcttgtgtcctgcaattattttatactgagaagctgttttttacatatcaagcatttgtataagtctgtcattaagccttggcacaaatacatcatttagttttaaattcacttctggtttttctcattagcccaagaaaaatttaaatgacactactgggtactaggggaaacgtaaccacaaatcacaaacttgagcaatgagtttgtgtgttagaacatactcggttcaggtgttactttttcagattatacattaaattaagatgcaaagttaaaaattttatatggacttacagccccttgataatacttccacagagccgcagttgagaaacactgctctcttggaaagggtgcagagctggtgtcagaagcagattcgagtcttggctctgccgctactcagctgagtgttgggtaaggcacttaacctacttggcctctcttgggtcttaggtgatggcgcttggtgacctttgaagatttgtctttgaagattattgttgcttttgaaggttttctttaggaatgttggactttccagggaggcttgggtccagcttcggagtttatttgattaattttttttttttttttactgttaatcatctttttacttacttttaagttgtacaattcagtagttgtttatttttatttataaatttaaaaatttattttttaatttttattttattttttgtttttttttttaaaaccagaacatttactgcatgactaattgttgaaattcttaagctgatcaaagtgctccaacagctgccctctttggtttaggtgttgtttcctcacggagtccatgcctgaatctgtggtgtacaatttttaggtgcctcgttcggccagtcctggtggcattttgtcttttagccttggcactccagttatacgtcctcctgcacttggcggggtagccacatttgccacaggtcaacttctgaaggtggtaggccttcacgccacagcggtggcacaatgtgtgtgtcctattgcaacactttccaaacggtcatctcacttctgtggctgagaccagagagacctttttaatttttttttttgagacagagtcgtgctctgttgtcctggctggagtgtagtggcgcaatcataacttaccgcagcctcgaccttccgggctcaagctatcctcccacctcagccttctgagtagctgggtctataggcgtgtgccacgcccagctaatttatacattgtttttggagatggaatctcgctcgccatgttgcccaggctggtcttgaactcctgggctcaagcagtcttcctgcctcagcctcccaaagtgctgggattatgggtgggagctcccgcccacactcggccaattcagtagtttttaatacatctacaaagttgtgtagccatcgccactacctaagttcagaacatttttcatcaccccgcagccttctggactgagtggagtcagcatgctcaggggttggcagcatctgttcagggggctcgaggttcttctttggtgtcttttcaagtttctatacctgtccagtactgaagctggaattggagattgaccttttgtccaagtcataacttaatatgctatttcctgaaactgcttttaagaaatgttaaggtgcaaatgaggatccagtttgggcccacatttttctaagttggatgaagagcagttgagtggagtttctagttgcactcgagactctgtactgtgcagacagtttattggtggagttgcctcaggataaaaatacccagctcttctcagtagtgggtgggagactttgggtgatggtgatttccgtaaaggagaagctgagcctggttggaaggaaaaaggaagaatatacggagaggctggcattctttagctgagtggatttaggcttgagctggagtcagaatcacctgggaggcttgttcaaacacagattgctgggccccatccccagagtttctgttccagtaggtcctgggtggggcctgaggatgtgcatttctaacaagtgcccaggtgaaagctcacttagaggaagaatctcagcctcctggaagtgtgttctaattaacttcactggactgtaggctcagctttgccatccccataccactcatgcatgttttggtgtgctttggctacataggttacagttgagctttctagagcttttttctcatgtctttagctagtaggcacctaaaagttgtagaatgcataggttttatttttggcatttatctgaagtatctgttcatgtcttgacatataggaagctcttttaaagtttgggtggcagtggagagggcatatagaagcatattctaatttttcaatgttttttgaaagggtagcatgaacaatagtctccccactccttcttcatatccgtttggctcaagtagctgaaaacagcagaaccttaaagctgagtgtcacagtctgcctgcctacctgcctgtctacctgtctacctgcctatccagctacctgcctacccaccttcaagtcttttcgaatactgcctaccccaggtttctgatgataaattctgttatcttggtaattatgaagttattttgaaggttttaaaagaagctcctaaaaaataacctaagttttacagtattagtgcttttagaaagctggaaaagcaagtgaagaaacaacaaaaagaaatcctttctagatggatgagaaaccacagatgggttggggtgaatgcgatgaaatagaaatgtgtgtttgggagagtgttttctctgtaaggaagaatattctctgtaaggaaggcaggctatgtggctttcatgaggtcttcttagaagcttctgtggtaatgttcactggtctggcgaagggggtagacttgaaaaaattgtaaaatggcgagaacctggaatttacatttggggagaaaagaaactgggaggcccttcagctctggggaattggacaaggtgaagcagagtccacatgtgtgtgtatgtgtgtgtatgtgtgtgtgcatgtgcgcgtatgtgcatgcatgtgcactcatccaggtggggcgtctgcggtagcaccgaggtggattctgaggcaagcttcatttggccctgagttcattttattgtgactccaaaggagttcatgggggaaataaaggctctcatgtgcaagaaacaaggaagcagaaaagtcatttgacctaggctagaaaaggcggccacctctagtctatagtcagaagagaagcagctgttcagaggggctgagacaggtaatgctggtcccaggccaagcctcttgaggaaagagaacaacattccgaaattctgtgagtagctcataccctgaaggagttcttttttttttttttttgagatggagtctctgttgcataggctggagtgcagtggcgcaatctcggctcactgcaatctccgctcactgcaatctccgccacccgggttcatgccattctcctgcctcagcctcccaagcagctgggactacaggcacgcgccaccatacccggctaatttttttgtatttttttagtagagatggggtttcactgtgttagccaggatgggctcgatctcctgacctcgtgatccacccgcctcggcctcccaaagtgctgggattacaggcgtgagccaccgtgcctggcaggagttcccttttaagatcgctgtaggaagagtcagaaggtcaaggacaaggcgccgaggtgcctaccctcttagtactttgtgttggggagtggaggctgtccagagaggctggccaaggggaggctccccctgggaagatggggatcttttttaggtggtgctgcaaagggacactttttcagagagacaaggggaaaacactcgcatatatttacttctttagaagttgagaaagttaaaagaatgggaagatgccatctgcttcccatttctgagaaagggtacattaaaatagcttgaaattaagcagaatgtataaaattaacgtctgagtatagtcatttcccgtttttcctgacacatctttcagctgtgtagcaacagatccgcattcctggtgtcagaagacagttgttaatgtgctagttaaaattttattttatttttgtactgttgagcaaaatttagacttaactctgttttatttaagaagcatttttgttaaatgctttaattattattaatcaaatttttttgtatttaagcagttttcaacaatctattcctcaagcaattcagagaacctgctgtgtggtgattatgtattttttatttcataaatgggggtagtgaggcataagtgttttggaattagcatttgtcatcatctaatatactgtgtaaattacatcttttcactgtgtattgtctggctgccactgctagactcttaagttccaggtggacagggatcttatgccaggtggacatggcatacatgtatgtatggcaggcactgttctaagtatatacaatagtccctggagtgtccagggactgttcattgaatgaatgagtaaagacttctgtcaacaaatatcatttagtctagtgctcaagtgggctgtaatactctgtttctgaattaaacagtctggcttggtgatagtcactgacagcaccaagcagatccatgggagctaccccagaaaagcttgtgatgcagaggagaggagcaaaatgtgcgctccctgtgtgcaaatggattcccacaaccacggaaggaagaactgcggcagacatgcttggttcttaatctcagactcatcagtcagggaattcactcctgtctaaggggcgagtgagggtgaggcaggaagccagcatgtcccctgtgaaggagctctttccaggtagaagcatgaagcccaggaaaggcaatttatacagcacatcaccaatagagagatggccaaaccactctgaactctaccatctgaagtgaacaatttctaattatgtatcttcagatttttttctttcagatttctttctgatatatgtatctacagatatttctctgtgccggtgtgggcattttttctatatttattaacccagaataggtttactgtacatgtagttctataacctggcttttctcttaatatgttatatatctgttaggcattttttgacagtgatccacagcatcatgtttgtttcttgattgactgagacagattctctctctgtcacccaggctggagtgcaatggtgcgattatagctcactgcagcttcaaattcctggacccaagagatcctcctgcctcagcctcctgaatggttaggactacaggcatgggacaccatgcctggcaacgttttttattttttgtggagacaggatcttgctgtcttgcccaggctggtcttgaattcctggcctcaaatgatcctcttgcctcagcctcccaaagtgctgggattacaggtgtgagccatcgtgctcagccaacattatgtttatcgactgtttattaatgttccatttaattttggctgggtatggtggctcacgcctgtaatctcagcactttgggaggctgaggcgggcagatcacaaggtcgggagatcgataccatcctggctaacatggtgaaaccctgttcctactaaaaatacaataaattagctgggcatggtggcatgtgcctgtaatcccagctactcgggaggctgaggcaggagaatcacttgaacccgggaggcagaggttgcagtgagtcgagatcgtgccactgcactccagcctgggcgacagagcgagactctcttaaaaaaacaaaaaacaaaaaacaaaaaacccccccaaaattccatttaatttaatgccatcatttatgcattcagcaatatttttgagggcctactatgtgccaggcactagttggagttgctgagggtataagatgaggttccaattctcatggagcttatcgtttagagggaaaacaatacaaaagtaaacaagtaggtgaggatttctgagtgtgctaagaacaaagtagagcagggtactgaggtgtgagcacatcagtagatttcgtaggaaaggcctttcttaggaagttatatttgagctgagaactgaatgataaaggaaagccagctacttgagtatctgggggaggaatattctaggcaaaggtaatagcctgtgcaaaggccctgaggcaggaatgtgcttgctttgaggaaatgtgaaaaaaaaagttgttgattggaacagtgtggggatctggcagatgagctgggtgaggtaggtaagggctagatcttgttgtgccaagtaggcataaagagttgagattttgggtcgggcacagtggctcacgcctgtaatcccagtactctgggaggccgaggtgggcagatcacctgaggtcaggagttcaagaccagcgtgaccaacatgatgaaaccccatctctactaaaaatacaaaattagccgggcgtggtggcacatgcctgtaatcccagctactcggaggctgaggcaggagaattgcttgaacctgggaggcagaggttgcagtgagtcgagatcgtgccattgcactccagcctgggcaacaagagcggaacaccgtctcaaaaaaaaaagagttgagattttgttttaagggcaacatgaagttattggaggatgagctattaggaagtgagcaacataatatgaagctttatgttcaaaggctttcttggctactgtgtggcagtcaggggaagcagagagaccagttaagagtctgttgcgataactggtgatcttggtaagaaatgacggtgggggtggagggagtgagaagtggatgtatttcagaggtggagctgtcaattcatgggattggatgtagggggtaaaggaaaggagaaattttgtggcctcagctactgcgttggtgctggggctcgtcagtgagacaaggaagtggagattaagagtgttcttctgggatgtcctggttgtgagatgtctgttagacaccagagtgatgatgttgaataggcaacttccataagtctggggagaggtcctgtctggagataaaaattggagagccgtcaatgcgcaggtgacatttaaagccatagactaggtgagatcacctgggatgcagaagatagatggagaaagggagactaagccccgagcagtgcaggaggagccagcacaggaggctgcaggggagccagggaggcagtgctgaggcaggcaggtgtgaagtggaagccaggagaaggacatgttttaaggagggtgcgtcacttttatgtttgctactgtaaccagttatcacaaatttagtggcttaaaacaacacagatttcttaactgttctgtaggtcagtcatctgacatgggtctcactgggttgccatcagggtgccagcagggccatgttctttatggaggccctagagaggaatctgtttccttgtttgttccaccttctagagtctgcttaatgttccttggcttgtggctccctccttcatccttgatgccagcgacgtagagtctttgtgaccctgctctcttctcattcactcaccctgacctcttctgcctctttcttccacttttaaggacccttttaattacgccgagtccacctggataatccaggataattttcctattttaaggtcagctgattaacaacctaaattctatcttcagccttaattcccctttgccttgtgatgttatttatttacaggttctggggattagggtgtgtatatctttggggttcctgttcttcctttcacagagggtatcacaaaggttactgggaagttggataaaatgaggacggagaagtcattgttggatttggtcaactgattagtaacctcaatgggtggttccagtggagtgttggtgcggtggcccaatgggagtgagttgaagagccagcgaggtgaggacgtggaggctacacatcttaatggttcttggtggcagttttgctttgaaggaaagtaaatagtggcaagaattacaaaggaaaagcacagaggacagctctgagaggatgaaatgggagacggaatgtggaacagaggttcagggacgactgctggaaggaaggggcattagtgtagtgtctactggaagagattaactggatgaagaacctggagtgaaaccaagaaatggtttatagggatggggacatatgaaagtgaaattcacagggttatttttaatagaacagcagaaggtactgatgactcctgttgcttgcgcctgggtcagtggacaggatccttgtcagcagccactacagggcccgcaagcccacctcagatgctgtcattccacgggtggtggccaaatctttgaagtcagtgtagaacctctgccctttcttcctggggagcctggatcagccatgatcttgcccagactcagcgccatggtggagggacatctcctttcctctcctgccccccaaccacttcccttacacttctgctcttctctcctcacccgctaaattgtaggcctgcctccatttctttctttactttgttacgttttaataacatttattcactccacaacatgctcacagaggtggaagaccaagttagtgcagacccattcattcctggacccagtggctctcaagtgggagaggtgctggtcttaaagggtgtttaggaacaagtgggcgtcatagtgagtgtaaaaacgccctcgccgtgaggctcagaagagccaggcctcctcctgctcctagtccagtcagtgctcctccttcatatgggtggttcgcagccctgctgcatgttagactcaccaggacagatttgtaaacatatcacgacctgggccctaccacaaactaattcaactggagtctcagggatagggcccaaactgaggattttaaaaagctccctaggagattctgaagtgcagccagggctaagaactacagccttaaatctactgttgactgctttcaaaagaagtcttcactgtgcttaaacaaattgtggttaaaagtaagcaaaagggccaggcgtggcggctcatacctgtaaatcccagcactttgggaggccgaggcaggtggatcacctgaggtcaggagttcgagaccagcctggccaacatggtgaaaccacgtctctattaaaaatacaagaaaattagctgggcatggtggtgcatgcctgtaatcccagctactcgggaggccaaggcaggagaattgcttgaacccgggaggtggaggttgcagtgagctgaggtcgtgccattgcactccagcctgggtgacaagagcaagtctccatctcaaaaaaaaaaaagaaggaagcaaaaggaaatctggaggggaacatttgtaataggcaagtggtcattattaaatgtacagttatattattaaaatgtagatcatttgaatcaactgacacgtctgaatttggattaaaactcctaagcagtatacggtactcaaagcttggtactggtagggcacagtttgttcatttctgtttttcacgttgccttctttacacttttttcctttctgaatagcctaatatgacgaagcagctatttgtaacatgtgggaattattttttcttcttttcctcccatagtctgtctccatctttgagctgctgttctttctacagcttaaggttcttagatgtccattccattccctacccagtcttggaacactgtgagatgagcattcctgataagtggtcatccaatttggaaagacagtattttacaaggtgatcagtttctgaggaatttcagttagaaaactttgtgtttttggtttggtcagggaaagatccagaaaagtgatcaagaggttagctcaaacctgatatagggagttctcagaatagagattggctgttaatggtctcttataattttttccttgaggatagttttattagtatgagagtaacttaaccatcctcattgtgcagttcttccgcctcagtctcccaggtagctgggattacaggcacgcaccaccatgccctgctaattttagtatttttagtagaggcagggtttcaccatgttggccaggctggtctcaaagtcctgatctcaggtgatccacctgcctcagcttcccaaagtgctgggattataggcatgagccactgcgcccggccccaaacttttttataattctctatgacattgacatactcccacaacagcttcagtataatttagatgcccttatacatctgcgtggccaaattaaaaaagacaccatcaggtgtcagcaagaaacagagcagggggagctttcatgtactgctgatgggaatctacattagtttaaccactttgggaaactagaattatctatgagagtggaagatttgcacaccataaagcccagcagttctactccttatgtatattcttgacagactgtatagctgtgaaaactaatgaattgatgaatattcaagaagtgagtaactctcacaaacataatgttgagagaaagaaaccagacactcagaatatatattgtttgattctgtatacaggttcaaaacaaaggcaaaattaatttatggtgttgcaagtcaggagatgtagttacctttggagagtagggaggatatattagcagggcttctggggtgttggtaatgttctttcttgatgacaggtgtgatacacatgcacacatacacacaaatatatttacaatttgtgctgtttcctgtttgtatataatattttaataaaaagttcactgaaatggggctgggcacagtggctcgcgccagtaatcccagcactttgggaggctgaggcaggcagatgctggagcccaggagttcaagaccagcctgggcaacatgacaaaaccattgcattacaaaaaaaaaaaaaaaaaaaatgcaaaaattagcccagcatagaggtgcgtgcctgtagtcccagctacttgggagcctgaggtgggagaattgcttgggcctgggaggtggaggttgtggtgagctgagattgtgccactacactccagcttgggtgacagagtgagagagaccctgtgtccaaaaaaaaaaaaaaaaaaaaaaaagtttactgaaatggtatatggtgtagagtagattattgaacagcagtgagaaatgagcaaaatacagctacatgcagcaccatagaagaagattctcacagaatacatacgatcagattctagttttctaaagttcaaagagtcaatgctaagctattgtttaaggacacataagtaactcgtggatatcagtcaggattcagtcagggaagcagaaccactgtattatgtaataagggatttattttttatagcaataagatattttacaactgtggggaaaagctggaaaaatgacagtctggaaggaagaattagaggaccagagaagagccacgaaagcacctctcctgaagcacctgtacgggtggctgagttagaacttgtgggaggctctgagaagccaggcatgagcagctgctagaacgggaccacaaaggaaagctgatgaaaaagtctatgaaaagctattacctctgcatagcaatcacttctctaggtctgctggccagcagctgatggtccaggggcttctgttcgctgacaaggccggcagttgggggaaaaagctagtgacagaagcagcacgtggacaagctggaaccctctggcatctccgtttatatctgctaccacctctaactacctcggccctcaggaagtaatggtggttttacttttcgctttttaaatcttgtccagattcagggaagggaatcctgagaaaattctagcctaaccaaattgagttaaaagctgcaatagtgatggttgcacaactctgtgcatatattaaaaaatatactttaagtgagtggactttatgatttgtgaattatatctcaataaagctgttatttacttaaacaaaactgccacatgttgaaaactttaaagaaacaatgttaccatggatgatttaagtgctgcttcttggagatatggaagtttcagtttagtaattgcttcttagcaggttgtatctatgttactctacactgctattctttggaaagctagagcgtagtaactaagatctgtttgttaatgacagacctcaaggtctcctgacaggtctgggaataagttttgaaaataggttaatgggatattgtattagtccgttctcatgctcctagtaaagacatacctgagactggataatttataaaggaaagaggtttaatggactcacaattccacatggctggggaggcctcacaatcatggcagaaggcaaaggagaagcaaaggcatgtcatacatggcagacgagagaatgtgcaggggaactcccgtttataaaaccatcagatctcttgagactcattcactaccatgagaacaatatgggggaaacagtccccatgattcaattatctccacctggccccgcccttgacacatgggaattattacagttcaaggtgagatttgggtggggacacagccaaaccatataagatacattttctcacttttcaccatgtatatttggttttaaaatttgaactaggatttctttacttatacttaaaagtaggttttacagattcattaaaactttcatatcaaatctgttttgataatctgagatattctcatcatctcaaactattggaaaatgcccttatctactctccatttacgtggagccacttttcatttgaatgtttgttatggctctttttattctctttataaggagacaattgcccaaataaagatatgcagctttcctgcctggggctgtagttgtaccatagtaaggaaatggatatgaaggttttttaaaaagttcaaaaacagagtagcttgtatcatttatatgcaaaaactagaaacatttttagctgtagttacgaagacttctagctttttgtcaactttttaactaaaaggagtcccaaaacacaggttatttctacatggattaaatttataataataaagaatcattagtattactaaaccatattgacagaattcttgctaaaactaggctagacagacaaggatggatactgaaggttgacactgaagacctagttgggaagaggattcagaggagcttggctagagtttggtcaaggagacactcttggtcagtatgtaagtctggctaattggaagtaaataaaaggcagccatagtcttggagggaagacagacataaaaaatgattgcaatatggtataaaaggtataatagaattataaagtatgtgtgtataagatgtatctgcggcaaaaaggagcagtgatggtctgcttgagcacatgaaggatggatttttttttttttttggagacggaatcttgctctatctcccaggctggagtgcagtggcgccatcttggctcactgcaacctctgcctcctgggttcaagctgttcttttgcctcagcctaccgagtagctgggattataggcttgtgccactgcgcctggcttatttttctactttttagtagagatggggttttgctgtgttggtcaggcatgtctcgaactcctggcctcaagtgaaggatggattttttttttaaaaatgacactaaagctgtattttgaagatgattagaaagtttgctaggcagacaaagagaatcagcaagaaaactttctgggctgaaggtactacgtttagtcaaactattaatacttcctttcctgtgcaaaggaacggaagaaggaagtagtttgagttgcttggataattcgctatggctagtttagggtttaaggagagagatggatgagttaaggttagagagtagcagctagatcatagaaggctatgtatgccacgttgcgtttaaattttgtttttttttttttgagacagagtcttaccctgtcacccaagctggagtgcagtggtgtgatttcggctgactgcaacctctgcctcctgggttcaagcaattcttcctgcctcagcctccctagtagctgggattacaggcatgcactgccacccccagctaacttttttttttttttgagatggagtccccctctgtcacccaggctggagtacagtggcgggatctctgctcactgcaacctccgtctcccgggttcaagtgattcttctgtctcagcctcctgagtagctgggattacaggcacgcatgtggcacccagctaatttttttttttttttgtatttttagtagagacggggtttcagcatgttggtcaggctggtcttgaactcctgacctcgtaatctgcctgcctcagcctcccaaagtgctgggattacaggtatgagcctccgcgcctggcctaagatttttatttctagtagaaaaagagtttcaccatagtgaccaggctggtctcaaactcttgaccacaggtgatccacccacctcaccagtgtgccaggattacaggcatgagccaccacaccagcctgggtttacattttaacagatttttttgttgttgttttctttgaaggtctcactctgtctcccagcttgatcatagctcaccatagacttcaactccttggcctcaaacaatcctctcatacctcagcctccagcgtggctgagaccacaggggtgcaccaccatatctggctaatagttttatttttattttgtaaagacagagtctccctacatttccccggccttgaactcctagtctcaagtggtcctcccgtttcgtcctcccaaagtattgggattacaggcataagctactgcatctggccttttagcacagtttaatcagaagaggaaaatgagcagatttttattttatgcagttaccctgtggaccatgtagagaatggtttggaagaacgctgggagtctggtgaggaatccatcccagaggtagtaactaagacctgtttttagacattggcagtagcgaaggatctgacttgggaggtagagttagtagcatttatgtgacctctaagacgtgatcctgtcacactttttctctactctgttaggttcagtacttgagggcctttgaattaaactgacagatgatagattagcaagagaaaaggtagattttaattttgtaaatacttaggggagttcacaaataaatgtgactgaaaagagttgttagaatttggggtttatgcaccatcttaatagatgaagaggagagggagaaagggtacttccgggaaaacaaagaactatttggaaagataaatgggctcataggagaataaatggaagctgtatattttcgtgacattttctgtttggttgtcttctcatctcagatgattagagttgcccctgtgggaaagggttcatgacaattgagttctttgagttcttttgggaggctctgcttttaggcagataaggggtttcaggaactcaaatgccttcagctcaaaataatttttatgctatagtggcttattctggatcctttcacggtgaaggagaggagaaattcctgagattctggtttgagtgatggtggtactgtagataatgaaatacataaagaagagcaggtttcaggacatactgtattttcatttgtatggttgagcttggagcacctggggaacatctagagatcctagaaagcagttggatgtagatttgggacctagagagagctcaaagaagctgagagtacggataaaattttccttggagagtaggagaatgagagaagaaagagcttccagaaatgaactgaaggaggctggaaaatgagagaggatgaaatgagagaggggacatagaaaggaaattgagcctacaaaggagactaagaaggaatagttgaagatgaggggagctgggagagttacagaaaccaaggcaggacatagtagcaaggagactgagcaatagggatcagcagtgccaaggtgcagagtaaaattatagaagtgttaaggaaaaaaaaaattatatatatatatatttagtatatgataaaggtacagttttgaggaggaaatggagggctgtttatttaaatggacatttgggacaattggcttaccacttaaaaaatattaggttaggccggatgtggtggcacatgcctgtaatcccagcactttgggaggctgaggcaggaggatcacttgaagtcaggagttcaagactggcctggccaacatggcaaaaccccgtctctactaaaaatacaaaaattagccagatgtggtgacgcatgcctgtaatcccagctacttggcaggctgaggcacgagaatcacttgaacctgggaggtggaggttgcaatgagccgagatcatgcaactgcaatccaacctgggcgacagagcaagactttgtctcagaaaaaaaaaaaaaaaaaaaagttagtttaggtccccacctcatgccttataccaaaataaatctaaaaattaaatgtagaaattgaaaatagtaaaaatattaggagaaaacgtgggtcaatacttactttgtgttcaagttaggaaggaccatacccattctaattataacagaaagaaaagactaagaaattttcatgtaaatccagcatgtctgtgtgctaaaaatatcataaaattaaagtgtaaatggcaaactaggaaaagtatttgccatagatttgacaggcagaggtttaatatccttcatatctaaatgatctatcaaaaaaatgaataactgaaggtttctggttaagtaggactcattgaagatgtctttatcttccatccttccaaaattttgataaaatgacaggaattacagaaggggtagacccacaaagagtgaaaaagggagagtagggaagatttttctggttgatgatagactaagttgttgggccttatttcctgctgagagcaagtcgagatgatggacaaaatttaaaacaaaatttatgtgaaggaaatggagagttaacaaaatagtgaagatttgtgggtgtaagaggtggggcgtggtgatgaggtagggaagcccaagatgtgagaccagcatttgcagtcatttctttcccagaggaatctgctcattccagaagaattaggcagatgagaagctggacggctgaacagagtttttgttagactcagagggcggaggacaaaaattggagtttggctcagatcagggagcaggaaaacttcttaggctttgagtaggagacccaaaagcctatatcttagagatagtagctcctaacaggtattgaagtccagctccagaccctctcagttcctggctggatcaaggtgttctggaaagaagcaagtataatttctttcattaatagaagaagataacatcactcagaacctcagatgagctctatgtttatttacaatgtttggcactcagaaatcaccaggcagatgaggatttaagacaatgttactgaacgccaagagaaacaacagactatggaagtggatcgacagggatccagatagtgaagttattagaaaagggtaaggtatgtagtatgtttacggagttaaaagattaagaatagggaaattggaaccacaccaccccctccccagtagaaaaaccaaatgtaaactgtagagttaaaggactgtaaatgaaattaagatgtcagttaatgggtttagcagtacattagtaataagtagaaaacaaatgttcagaatgaaatatggaaataaaaatggtctggacatacattatagagtgagtcttagggattctgtggaaaggtctaaccaacatgtaattgaaatcctagtaggaaaggaaggaggagtgctgcagaagcagtatttggagtgatgatagctgagaattgttcataacaggcaaaagccatctcatcacagatttaaaaaatactaccagaaatctaagataaggagaacattttaatagtaaccagaggccaggtgcggtggctcactcctgtgatcccagctctttgggagactgaggcggatggatcacttgaggccagaagtttgagatcagcctagccaatgtggcaaaaccccatctctactaaaaatacaaaaattagctgggcatgatggttcatgcctgtaatcccagccacttgggaggctgaggtgggcagatcagttgaggccgggagttcgagaccagcctggctgacatggtgaaaccctgtctctactaaaaatacaaaaattagccgggcgtggtggtgcacgcctgtaattccagccacttgggaggctgaggcacgagaattgcttgaacccagaaggcagatattgcagtgagccaagatcccaccaaagtactccagcctaggtgagagtgagactctatctccaaaaaaaaaaaaaaaaagtaaccagagaaaaactacgtactacattgaaaagagcagtgagattgacagctaatttctcaatagatgtaatagtgcatccttctcagaaggcaatgaactaatgttttaaaaatgtaaaaaagaaggtaaacagccaaactagaatgttatacccttcaaaagtgaggacaaaattatcacttctttagatcaacaaaaatgagaaggatttaaaagaaaaagccaaaaccccaattctctttcttctacactcacaaaacttctcataccaaatgtgtagggtttttttcataccaaccaattctccagttctctgtggactccgggtattctgcaatttaactcaatttggatactaactgcctggaattacttgcttcacaggttgagagcttggcctcacaagattgcttagaaaccaattgcaagtccaggtctccgatatttcttaccgactgctatgaagtgattcctataaccccctcctcagattcagtgatttgctagaatggctcacaaaacagggaaacatttacctaggtttacctgttgattatacagaatacaattcaggaacagctaaaagagagatgcatagggcagggtatggggaggaactcagaacttgcacaccctctccaggtgagtcaccctcccagctcccctatgtgttcaccatcccggaagctgtctggactctgttgtttgggtttttatggaggctctattacgaaggcatgattgatcaaatcattggccattggccgttggttattgaactcagtctctaacctctctcccttcccaggaggtggtggggtggggagcagagtgacaggggatgaaagtctgaatcctctaatcacatgattggttgctttggtaaccagtcgccattctcccgagagtcctctcatcataaactcaggtatgtctgctcttcttactaccgtgtttcagggctcaatgccaggaacttgaaatgaagaccaaatatatgtttcttattatatcacagtatcacagagttaattacaccagacctgcactaaagggaataatagaaagattggtctttggcagaagagaaatgatcctgcatggcagctttaagatgcgtggaaaagtgaagaccaaagaaaggagaaataagatggtaaatgtaaatgaacactgttgggtaaaataattatttgtggtttaaaatacacatagaatttaaaaatatagtagtagcatataagttgtgggggtgttaaataaaagttaatatcttacggtcttttcattgcccaggaagtggtaaaaatattaatttacttgagactttgataagtcaaggacacatgttgtaatctctaagatagtcattaaaagagtagtaaaatatatgtaattaacaaattaatagaggggaaatatggaatagtaacagcagtagtagtagtaaaacttgattaatctgaaagaaggcaagacgaccaaaaacagaaacagagcatgtgggaaaaataggaagtgaacagtaagttgttagatttaaacttagtctatcagtaattatattaaataaaaatgaaccaaaatttctaattaaaaagcaaagattgggaaattggataaaaaatcaaagcagatcacaactctgtaccgctttcaaggatgtagaaaagttgaaaataaaatggtagaaaagccatattactcaaacattaaaagaaaactggtgtacctttattaacaaagtgggctttagggtagaaataattgcttgggataaagacatacataatggtaaaatactcaattcagttctccaggaagttacaacagttctacctctgtatgtacctaaaaacactatctcaaaatacataaagcaagaattaacaaaaatgacaaagaacagacaaatctgcaattcatagtggaaagttttaatataccgtcttcattaactcagaaacaaagtatcagtaaggacatagaagatttccataacataatgaacaaacttgacctaattgaaatctcagtgggtttatgtgtaatctagacgtactactgtcctgtgcttcataacgatgtttcagtcaacaagggactgactaaatatatgatgctggtctcataagattttattggaactggaaaattcctgtctcgtagggatgtcatagtgtcatagtgtaacacattactgtttctatgtttatatgtgtttagatacagatacctatcgtgtcacagttgcttgcaatattcagtacaataatacgcagattcatagcccaggggcaataggatataccatatggcttaggaatgtggaaggttgtactatctaggtttttgtaagtacatctttgtgtaagtacgtttgtgtaagtacattgtcatctttgcacaatgatgaaatagcctagtgatgcatttctcagaatgtatccctgttgttaagcaacaaaagactgttgaaaataagatacattcaaaatgaaatatggaatataatgaaatatgaaatacaacactgcacccaataactgtagactgtacattcttttcatatgcatagggaacattgatcaaaattgttgatttatagagtaaatctcaacagatttcgaaagactaaattcagaatatcatacttacaaagacaggtttaatatttgaaaaattgatcagtataaatcactaaattaatagagtagagcagaaaaatcatgtgataatgtcagaggtgcaaaaattgcctttggcaaaatccaatacccattcaaaatggaatctcttaatacattatgaatgaaagttaacttccttaatttgataaagattactcagaaaaatcctatagcaaacaccatgtttactggtgaaatgttggaagttttcttttgagacagggaaagagaagttgttttcactgtcaccaattctgtttattattttactggaagtcctacctagttgagtatggcaagaaaaatagtacagggatgagaaagggaagaataaaactgtgattttgtagatgacatgattgtatatgtagaaaattaaaaaaaacctctttataacttattataaataataagctaggttgcaagattcaaggtaattctggacacaattgcaattttatatgccaacaacaaacacaaattccaaatttgtatcaatctggatccaatcaggagagagaaaccagttgtattagtttgtcctcatagggctataaagaaatacccaagactgggtgatttataaagaaaagaggtttaatttgttcatggttccacaggcggttcaggaagcatggtgccggcatctgcttggattctgggggaggcctcaggaaacttacaatcatggcagaaggagaaggggaagcaggcttgtcttacatcgccagagcaggagcaagagagagagagaggaggggaggtgctacacacttttaaacagtcggatctcctgagaactcaatcatgagaacagtaccaaagggacggtgctaagccattcgtgaaggtgcacccccatgatccagtcacctcccaccaggccccacctccagcactggagattacagtgtggacatgagatttgggtgtggacacagattcaaacttcatcaccagtaaattgaaagcagcgtttaatgtggataattactaattataacagggaatcgaagtaaggagggatttggttaggctagtgaaaagtgaagagaattgtaaagaatatgaaaatagcagataaacagagcaactgctgcccctggggctgaggtagagtctgcaaggaagagtctctccttcccccaggaccaagatccagacctcatccagagagggcatggctggtttactgcatggccaagaagttgctggcatgtcatactagtggaacttaatggaaatccaccctctgatacctgccagaagttgctcactagggcgccacacaaaagctcttcatggggaggtgtctcactggaggtaccctgctacaaaacctccagagtgggatgctggggggagctgctggctgctgggtatggcctgctgttgtgtgctgtagtctctggaggctggagcagctgcaggtgcttgtagagatgggtactggagaagccacctgcgttgcaggagctggacgccatacaattaacacaatgtagagcaatctggaaggctgtatatatcaagatggccaagatggaaccagtgtttttttttttttttctctgtgacagatagaattatgatgcttccccctgccgcttttttttttttttggtattcattcagcatttatttaatgaatgttgagtattttctctattccagacaatgtgtttgttacgagatacataacagcagacaaaatagacattgaacttgtttttgcagtttataggctgataggacagtcagtcattcatctgagctcttttgtgccaggcactattctagtcactggggggatagatggatagattaaatagattggttagatagatgggatggatgtatggatagatagatggatcaagataaaatcttgctttcaaagggagacagccattgagcagataattaattataagaatgggtacatacttacacagtgctataaagggtgtaagaaggaaaaatacaggctgctacaagagaggacaatgtaattcagatgagaagccagggcagacttctcttagaaagtgatatttttatgatgaaagtgatgaggaggaggttagcttggtgagatgagtgatcagagaagaatgatctagatggaggggaggcttgcgggcagacttcatgatgggaagagctcggcatgtctgaagtgaggagtgggaggtctctagagggtagggggaggtagagagtggcaggagaagaggccacagcaggggtcatgctactcacagccataggccaccttggaaactagggtgtccctgtgaagggttgcccgtgatagaggtctgaaataggagattcttggactgttttgctatttacagccaccgtgtggggtgctgagtggtcaggggattggaggcaagaatggaagttgagagaccactgggtgcaatttgcaggaatccagtgaaagttaacggtggaggtggcgccaaggcccagcagtggagctggagataactggatggcttggagatggggtttggaaatagagtcattcagaactggtgatggattgagtgtgggctgggagagacagggagacattgagaataactcccaggtttctggcttaagtcattacatggcatgtgatgccattttctgtgtacttttgtagtgaatacgaattacttgttcaattaaaaaagtaaaataagtttggatttgcagatgaagaaggctttggtgaccaaacaaacaaaaccaaagcagttgcagtgaaagtgaagaggtggagatagttgctacagactactgcagttctgcatcttcaaagaagccagaaagtagcaggcaaggtagggtcgggctgtaggacaaggacatgtgttttgtttacagagtaggatagatgtgagcaactttcattgggagagagagctagaccatagagggaagagaaggcattcgttaactcaacaaatatttgaatgtctgtatgacaggcaatactctaagctcttggaacatacaaaacataaaaaacattcctgtcttctggagcttaatgttctaaagtggggacactgaaaatcaaatcatgtgccgagtgcactgtaaaaagaaaaaaaaagcctattaatggggagatctagggatgttgaggtgggacggccagaaggatgtaattttatgttgtgggtggcactgatggatttgatgccactagaatgcaagatatgccagggcagagattttagttttactcactgctgcatctccagtttagaatggtgcctggcacatagtaaatgctcaataaagaattgctgtgcgaatgaattaatgattcaggatcccaggaatgggaaggaatgaggagtgggatactgaagaaagaaagataggccagtcataaatgaagacatattgtagggatgttagtactgatatctccaattcaaattacagttgtttttgcttttaaaggattttaactgttcaattgtattttgaattctttgaattagctttgtttcatggcattcattttgtttactgtatgtttcttagacacagtaatatagtttacagaactacttatccttagggacattacccacttaagaagtgactgttttcagtattattacaataaaattgagattacatatcactttgtatattgaggttctgttacaacctgtcttttcagcattatccttaaagtggtgtgtgtggtggtggtggtggtggtggtggtggtgtgtgtgtgtgtgttggggggggggtgttgtgattgttttatgcccattacagaaaccagtttagccggcattatactggtgtggttatatattaaataagttaaatttcttgcagctactcttttgatcagttaattggtctgatcctatagtgggtattttcatgggtctctgctaagtttagcctcacaatgattttgtgtgtctgaaatcgtattgacaggctgtagctccttctaatttatgcatgcgtgaagaagattgtcctctatttgctgagtcttatgcttttatatgaggaccccagtgtcgtaactttgccataactcaggaagatctaacttctgactgtgcagtatagagcattcctttgtctaaaaaaataatatggatgttttaagaccattcagtcataactggaagctgccttatagttaaaggactttacatattaatgaagaaagggaacatacaaatcattatgtcctttttgccatagattgctgtcccctcccatagaaattatcttattatattttattacaacagtgtatgtaaaatatatacttataaaagtaataaatggtctttgaaaaattctaataacaggagtgtagagattataaactgattttatcctaaaattgtacatcctaggagataaccattgtgagcaatttgatttatatccttttttggactttacaaatgcttgtgtaaatcgcgtgtgtgttgtatgtatatatgtttgagtgtacatacaagaggaatcatatacagcttccctgttttttcctccccatttatacaccatgttgtggacatttttgtgtcagtgcctgtgtgtgggtatgtgtgtgcataaagacatagcacgggtatgccataaaaagttttcagccaatcccttattggttgtcgtcatattttgctcttacaataagtgatgcacttaacatctccagttatgttctaggacagaagtgcttgtcagagtgtaaatatttgacatatgcccttagaaatgttgtaccaggccaggtgcagtggccactcctgtaattccagcagtttgaaaggtctgggcagaaggatcacttgagcccaggagttcaagaccagcctgggcaacatagggagacctggctttacacaaaataaacaaaattagctgggcatggttgtgcgttcctgtggtcccagctgctcgggaagctaaggtgggaggatcacttgagcccaggaagtcgaggctgcagtgagctgtgatcgtgcgagtgcaccccagcctgtgcaacagagtaagtccgtgtctcaaaaaaaagaaaagaaaagaaatgttgtagaataccaatttggactctcattagctaaaagtgagagcatccatttccccaaacccttaccaatggtaagtgttgtcagtcttttaaatcctttctcagcccaacaggtagaagactcagatctccttttaatttacatttctttgtatattcctgcaatttagcatggtttgaccatttatgctatttttttggatatgttactttttataatagtcttcagtctttttttctagtaggttcttcgttctttttctttctgatttctgtttttcttttaaaagaagtatgtataatatttctccctttagtcatctgtatttcagtcttagttttcttaactcattatgtcctcatgccaatcctatgagtcatgctcccaaactctgaatctttttggccttgatggcatgtgtacttggtctttcccacaccagtaattaagtattctccctagattttcttctttgttttgaatttttatccttagatgtttaatatagctgaactttttttatatgtgaatgggatgagttagagctctaatttcatttttctccaaataagatggttattattgagtcattgatcattttctactgatttgagatgttgccattaccatgtgctaagtttccacaaatatgtggttttttacctgaactccttgttcattgatctgtttattctgtgcctacaaaattaccacattgttttttctttccttatacactgatttagtttttgtcattctaacatattgtaaagaggaaagtattgctcctattctgttcttaaaggtctatcagggccgggcgcaatgactcacacccgtaatctcagcactttgggaagtcgaggtgggcggattacttggaggtcaggagttcaagaccagcctggccaacatggtgaaaccccatctctactaaaaatacaaaaaattagcctggcgtggtggtgcatgcctgtaatcccagctacttgggaggctgaggtgggagaactgcttgaacccgggaggcagaagttgtagtgaccccagattgtgtcattgccctccagcctgggtgacagagtgagactccatctcaaaaaaacaaaacaaaaaaaccaaaaaactgtcagaagtggagtgtgacttacttttttttttttttttttgggtcagagtcttgccctgtcacccaggctggagtgcagtggtgtaatctcaactcactgcaacctccacctcccgggttcaagtgattctcgtggctcagcctcccaagtagcaggcacatgccaccacgcccggctaatttttgtgttgttggtagagatggggtttcacctcgttgtccaggctgttcttgaactcctgacctcaagcgatccgcccgccttggcctcccaaagttctgggattacaggcatgagccactgcgcctggccatggagtgtgactttacagtagagattcatttgtctaacatctctgttactggtttcagtaagatcacatcatcttttttgtcctttggcagcagaagttgtaggttaacgaaaactaaagcaacttttcttgtcactgagatggaattgaaatgatctctaacccatacttcttcagccatgacttctcacatcttagaacacattaaaaataagaatatttgtaggacgtactggagaatgaatgagtatccttgaggtcagaaaccactggtcaggggttagcgtggcttagttcccctcacaaggcacgtgtaacccatttacattgaactgcatgtcagtagggaagtgtttaggaagtgctgctgtaggctaatgttcttcaactttaaaattttctcatgacacgtcattgtagcttgatatggattggccaaactgctttaaaaaatttttaattgtggtaaaatatacatatataaaatttgttgtcttaaccatttaaacattcacattgctgtgcaaccatcagcaccatccatctccagaactcttctcatcttgtaaaaccgaaactctgtacccagtcaacagtaactccccattctccctacccctcgcccccggcaaccacccttttactgtctgtctgtatgaatttgactattctaagtacctcataaagtgaagtcatatagtatttgtcttttttttttttttttgagacggagtcttactctgtcacccaggctggagtgcagtggtgcaatcttggctcactgcaacccctgcctcccgggttcaagctattctcctgcctcagcctcctgagtagctgggattacaggcttctgccacaatgcctggctactttttatatttttagtagagacaggatttcaccatgttggccatggttggccaggctggtctcaaactcctgacttcaggtgttccacctgcctcggcctcccaaagtgctaggattgcaggcgtgagccaccacgcccagcctagtatttgtctttttttgtgactggtctatttcatttagccttatatcatcaaggttcgtccatgttggagcatgtgttagcctttcctgccctttaaaggctgaattcgttatgtgcacaccacattttgttgatttgttcatccatccatgggtgcatgggttgtttcagcctttgggtattttgaataatgccatgaacataggtgtaaaatctgagagccagacgtcttgaaagagttttgttttttttctttcattttttaactattccaatttgaatttagcttccattattccgccaaaccttctttcttagatcactattaagtagaaggaacatttttcctttttaatgatttttcagacatactcacccactttggctgtgccatcctcccttggctcttgggatggtgcatgccccctgtttctctcccacttaggagatttcctttgtgaccctcctctcgcatcatttaaaggtggaatttccccagagcttgaccctgggccttctgtctgtgaccattaaatgtgggtatttctcagcaattagagcgaggctcttttcttttcccttgttttggaaagaagagagtcaaaaaagcttaatcaaataatctcatcttttacccaaaaaagataactattttcttcgggaaaaaaggtgacaagaatataaatcatcagaattacactaatttgtttctgaaggaaatgataaactttcccccagctttgttgaggtataattgacaagtaaaaggtgtatatgttcaaagtatacaatgtaatttgatgtgtgtgtacattgtgtaatgattagcacaatcaaccagcacgtccctcactatacggtgttttactgtgtgtgtatggtggaggagaggagtgaggacacttaagatctgcttattaatttgcttagcaaatttcaaataaacaatacagtattattagctgtagtcaccgtgctgtacattacagccccagaaaatattcatcttataaccaaaagtttataccctttgaccaccatctccccattccctccccaacccctgtgagttcaggcccttctctatattccttcttattctaggtgacccccatctgcttacagagatccaatctgctgatggctcctaggtttgtttcatgaggtcagagctctttgctgagccccactccagagctgcctccttgctgtctatgctgagtgtctgatgggtgctccagcctcatgtctgagatagagcttcatgattttcctcccacgtccccttccgtgttctcagtgaagggtacttgagcctcccaggcgatcaagtcaaatttcagggatcagttttaaagtaaactttttaatttaggatagtttcagagttatagaaatgtctgaagaatattaaggagagttcctgtgcactccacacctgtttcccctgctaacattactgtggtacatgtttcacaccagtgaaccagtaccaacacattatttacactgaactctacacttcattcagatttccttaattttcccctaaagtcttgttctttttcagaatcccattcaggatgccacgttacatctagttgtcatatatcttcttaggctccattagactgacagtttgttagatttcttcttgtttttgttgaccttgacagactaagtattttatacagtgttcttcaatttggatttgtctactgtttttctcgtgattagacttggataatgggttttggggaaggaagaccacagcggcaaagtaccattctcatcacatcatatcaagggtacctgctctcaacatgatttactactgatgatattaaccttgatcacctggctgaggtagtgtttgttagatttcttcactgtaaaattactgacatttttgacactttcctcttctttttatctgttttgaatccaaaacaattcctgctggttctttttcccaaataaatttccattctgtccaagtcactctttgcagccactgctgcagtccaagccacaattgcctgtgcgcagacggtattgagcgatcttctgactcatgccctgcttgtgcccttgccttctccagcccagtctccacccagatgccaatgtggtccttttcaaatgccagttggtcagtggtactcttgttcccaagcctttgagcggcttcttgttgtacttgagataccaccccaccttctagacacagtctgccaggcctgcttaagctcgtctcttgtcacctctctcatctcctgccaagcccctctcgccttgtcctctgttccagccaccggtttcttgcccgagtcccttcaacactctcagctcccttagacatgtcgttgcctctgcttagaatgatggtcgccctccaccttggttcccttgggaccccagcttacatgccatttacatgttgtttcttcaggggacatttcccatccacttgcagggtccatggggcactcttgctgggtgtttctggagcatgccacactgtacccctgatgctgggagttacttgttctatgtcggaattgttcctcagtgctggggtggacaaggctgagacgtgcctcggcatgtcactgtgtgtccctgttacctgtactgagcctgtgccagagtggatgcttgataagtatttgttgactgggtgaaattttttaaaaattaaaacatttttaatagaaatggggtctcactatgtggcccaggctggtctgaaacttctgggctcaagcagtcttccctccttggcctcccaaagtgctagaattacaggtgtgagccaccgtgcccagcctgaatgggtggattttatcttttgaatggaaaacactcttcatttttagcatgccagtatgcaaaaaagtacttgaatttatttttcttagtccattgatttaaatcccacatgtattcttttaaatctgtcacataaggtgctgtggtgggtacagtagtggatctagaaagtgtgttcagcctctgccactcctgagggcccattcattcattctctcattcaccagacagttactgggaacctgggtctgccaggcctagtgcagagtgtggggttatgagggcttgtgagtgagcctgttgagggagagggagaaacttatagatccttcagcatttccagttgtggttaggatagatttgggcggatttagtttgaattctggctctaccatttttaagatctgcactcttgagcttaacctctacccgtctgcaaaaatgtgggcagcattgtctcccttgtaagttgtggaaagaatcagctaagaaaaggaatgtaagaggatcagtataatcatagtaatcacagaactaatggtttttgcctttgaggtcctgagtactagcctaagtagttacattaattatttttgtttattctcacagcaactctgtgaggtagggatgttactgttctcatgttgtaaatgaagaaagtgagaccttagttgaaaaattaaatactttgtccaaggcacagaagtagtaagtgggagagctataacctgaacccaggttcaaggacggcgtgattttaaagcccagaaaggactccttacattctgtgtagctaccccatcttccagtgtggctttattctttaaagttgtaaagactttttaggtatcttggcatttaaaaaaatgtaatagtctttagagggacgattaccttaagctattatcaacttgaatttgtttctttattcacattttagcagctttgacatctgtgacttggtgcctgtgttgaggagagagggtatatgttgggactggaggatgaagtttgaagttagacccatctgggcagtatttatcttaaagtgagaattgtgaacttgtaatcagactcacctggaagatttatcaaaaacgtaaattccttaaccacttctttggtaccccacattataatctcttaggggtaggacttagaaaacatttttgcaagtgatgttatttagatagtggattctttttcattctgaagtttgagaatcagtgaatagagggaatgggaaatgtcaactccttgatgatccagactgccctacaggaagccagtggaaagatgaaagtgaaccctggtatgcctggctagtaagtttaaaaacaagtaatgtggaaataaaatcaacagtcggtgaatttgtctccctgttgttttactttttatattatttgtgtttgggaggaatttgatttgtattttatgatcatttttccctagtgggtagtggggtagcacgagaaatgagtgggtctagactatgatagagttggtgcaatgcagcaggccaatcggaagaaaaaaatttaagcatattttgtggattagcatgtcagttgcaaaaataggagtatatctaaagctgatttcagatagtctctttttagcgaaactatgtcagactgtgcccggacttttgctttggaaaatatggtaatttcaggtttgtggctaatttgaaaattagtaatcaatactaagggttttaaatatgtagcatttatgtgtttattatgtatttctatattcataaacattgaggattcttttattgtctcatgtaacaagaagacaagcagctcagggatggcggctcccgtgtgcttctccatgatctctcagcttcctttgtgtggatggccacagcatggctgcgtgcctaaagcacgcggagagggcagcattcttgtctcaggctccccacccaccattcttaagcagctttgttgaggtataattggcatactaagttgtgcattgtcttgtacattttgcaagtgtgcatctgtatacaccgcacaaccattaccatactatgataatgagcatgttatcactctccaaagtttcctggtgccttttgcgattccttctgcccacccttctcctccttttgtgaaagctttgatgtttttagggaaaaaaaaagttacattattgaggataaaatactaggtagaaagatatttaacttgtagttttcgctttttttttctttttgaggagtattgtggaaataatatgattgtaggtataggttgctgtaatatttatagaaagttttgagaaacagattctctgaacagaccatcttggaagagtttgacaggaaatatattttcggaaaggctggaatagaggtggagatggtgcctgctggcaggagagggagagaaagggaggacagcacctgccggccacttgcgggtgagctacagacatgaaagccaaaggctgcgcttttctttggtttttcaatagatggcatttttatcatgctagaaagactaacatgaattctaacatgaaatggtaataaaaatgtaatccccactaactgtagtgtatacatagctcaagtgcatttttttgttgttgaatggcatgctggtgattgatttatttatatttatagattaaaaataataaactttgctctcattgtaatcacctctttttttttcttttttttccctcccccagagactgggtcttgctctgtcacccaggctggaatgcagcgagtggcacagtctcagctcactgctgcctccacctcctgggcttgtgttccttctgcctcagcctcctaagtagctgggactgcaggcatgtaccaccacacccagctaatgttaattttttgtggagatgggatctccctatattgcccggctagtctcaaacttctgggctcaagtgatcctcctgcctttgctttccaaagtggtgggattataggcgtgagccacagaagcgtgcctggcctgggtagttctttttaattgttgaatatacttgctgaggttagtttctgctgcagaaagcattatataatgttgagttaacagcgatcttgtaaagagttagtagaatgtgtaaagttttacctgggaggcggaggcagcagtgagccaagatcttgctactgcactctagcctgggtgacagagcgagactcttttttttttttttttaaaaacaaaacaaaacaaaacaaaacaaaacaaaaaacgactgtatagggttaaaaaacgactgtatagggttttattttaatgggtttcttcagctgtctccttttagcttctatgactctgcattttcttggctctttgtttttcatttctttacagttcttccatgtattttgttttgaaagtaatatgcctgaggtgaaaatggcggcatttctgtcatgatttaaccttactagaaatgacattctttgttctttgtctgtttagttgagaagtgaaccaattccctgtgcttaaagtactactccttggtgtggggcagggagggaggggggaagatttttaacatagaatacaaattgagtttgttggaaaaggtatccctataaaatgttgtccaggtagttagagcttaatatgggtgataatttccctagaagaatattctttgctgtaacactgatgacttgatggacttgtgaaagtgaaacttggtgtgtttcttctttcagcctccatgtaactcacagatagggcagtgtagagtagatttccagttttagattaaggatagcttgtatcctatgcaaggttttgggggttggttagggtctttgagtatttcctgtctaattcacttactagttacaaagagacaagctgtaatgtaaaaagtcttccttgagctagactagctttctgtactctttgatttaaaaatacctggtagttctgccagttggggatttgtttggggtgaatgaaaacccctcaggctcagtctgttcatgcactggtgtgtattaattcagtccattcatagtcatgagctgactgtgccttattgaagaaagggaggcttctggaagagagaggaagatggataatcttggatcctgaagcactgctgctggcgcctgggagtggggcaggaagacaggaggttctgaagagagggctttgtatccaaagttaagacttaggccagcccttgatggggagagaagctactcaggcccaataacctcaaatagttcaggttaaatcgacagttgtcaagtctaattcctctttacagcattatttctgtgggaaaatgtgtgtggcttatatacttgcctcagcaaacagaccggactcagaatcagctctttgttgtcataatttaagtggaattagttactccctagggttgcattgccccttggatggcttctagccttctttttacttattaaattatattccaggttccttgactgtgagggacatagtaaactcctagtagcctttaccttcccctccctaaatagcaaactcatgtagaaaacattagctaaaatcctttgcagatttttttgaaatcacctaaaatgttgttattggcaccatttcatttggagccattttgtcagaaccactaagtatttaggtgaggcgattgatttcattcccacgtgggaatttggttggttgtaatattcaggcactcagagcaattcctgcctggacgtcacgttcaggtagtctggtgtctgaaacttttggcagagattaagctgatagaagatttgggctaacattttttagtgtgtgagttggtgaattttcaagatgatttagaagactttaaaaaagcatctgtgaatactgcatcatcttgatgtcaagaagagattgttatttaatacatacatgttttagtaatgaaggaggtacatagagataattgatttgaaccggtttactttttcccctttttaatgcaaaatatttttgggaaacagaacttgactcgtgttacactactcgcttcttgttttttgttacaaacatgctgaaatggtctaaataatgatgctactaaaacaacgtatgcattgttttcatggggtgttgattccttctgcagtgttcaaaattacttgcatgcctccgagcaacaaacacatatgtgacagactttatgtgagatgagcattccagagaaatgaaatgcaagtttacttttcagtagctatgcaacttaaaaaaaaaacattgtgttttttgaaacatggctttagggcactaacactcggaccgagtgcatgagctctgcaagttattttaacaaaacctaatcacaggaacaaacatctggcatttatagagtttgtttatttattgattgccgtaagcctctagaaagaatattctgtttcttttaataaaatccttttggaagttgtctatattttaatatctaagtgtttttggaatttagttttaacaaggttaactcaaatgttaaatttattgtgggctacagctgaagtaggagaatgtaagaagaaatggcaagtgggaactcttgtaaaaagaatggtaactaagttctttttcctggttatgctcctgccatttactcttctgtatggcaggccatcatttacactgctttgtagaatctgctgtctagtaagcactaaggaatttggatccctaaaccagggagcatatagcctgctaaagcttaatttttagacaggagacactaaagatgattgtgttatgatactgttcattttatatactagtgaaatgaatactgaaattatttagtataaccattaattatagtgcttaccattactgcaaagtttgtcatgatttgggtggtagcttcatgtttcaaaacaaaaccataggtctatccttttaaaaaacataaactgctttagtttgttaatgggaaaagtgagtaaataataacacttattgatgaaatgaagcctgtcagatacaggaaaaacaaaacaaaaaacccttgtagatattcctcgtgtcaagcccctattaattctgtgtaattccagtagaactagcaagttattttgcttaaaatgtcttttttttcccctgtgcagtgaaagttgaatgtgagaccacatcttaatagatatagttacacggtttattttatcatgtatcactttattgctgtcttctagaacattgttatactaaatgttccaataatggaaattttatgcagctacttcaaatgaaacaaatttgcaaaaactcaattttggaactcattccttgaggagaggaaaaactcaccatgctgtgaccacattagatttctgatatgttggcaacttatcaaacactgtcatttccagaaaacaggttatggggtcaaattgaaatatcagcacttttggtcactttcagttgaagatattttaggttttaatgattgaatggttaaattaaaaaaaaattgttggtaacaggtaatgaaagtgtggttttgtatgtaaataaaaatggctctacacgacatcaggaatgatggggttcagttacagtggaatcttttcaagagcttgattttaaattctcagagatactagttttacttactggagctcctttgttttgcagagatcatgatgcagccgtccttttggatttctttttaataatgtgtgacccttcacctttgatcccctgacctgcattaccttggtaaccatttcattttttaatttaatttcattttttaattttggtgtacaagctgtaacatttcatctttcaaagtgtaacacgctgatttcctcaaatagagatacccctttgagtgataaatttgcaaaatgctgtcttcattttctgtattaaaattcatttcagttttaaaataaagtgtaatctgtgttttcatccttttaa

SEQ ID NO: 763 - DNA, 102879 bp, Homo sapiens
ggacgctcctcccggagagtagtgagacccctggtgcggggcgattggcggcgggagcgatgagtggcagccgcacggcccaacgggagctgtgcgtgggccgcggggcggggccagggcgggtgcgcggcggcggcggggtggctgggccggcggcggcggcggtacgaggcgcgcgctcggggtcccggtcgcgaggaggaggaggatgtggcgcgcggaggggaaatggctgccgaaaacaagccggaaggtaagagccggagcgcgaggggctggggggcggcgcggcgggcggcgggacccggccccgccggacatcccgggcatcggcggcgccgggcgggagcgcgggggcgcggcgggcgggcgggcgggcgacccggccggggagggggccggcggggtgggggggcggagcgcggccgagtcctgaggtgactcgcggggccggcggagcgcggcgccccacaccccacccccgggggcgggctggggccggagggggcggggggctcgcggggcggggaccgggcccagcgaggaggaggagccggcggagggccggcgcctcccccacccggaccgggcatccccgccgctcccgagcccgctgcgcggcccccgcacccccggcgctgggtccacggtgggggccgcggggcggaaagtttatccgcctcgggtcctcctggccccgcgccccactgctccgggccggtccccgtcgggcggcagcggccggcgctcagccctcgccggccccctgctctccggcgggcagggccagatgtactctctccggcaccctcttcagccccgtggacacctccctgagcgggcggggggtccccgagcttctccccgccagggggaccccgtcctgccgagcgtccctcggccgaagggcctcgtgtgacccctcccccttcgcttcccgggaagggaagggggcctgcgcagcatccccgcccctcgcagtcgttcacatcctactcttgcccttgcaccctcacagccaggagggtggggtctccgtttctatggcaagtgaggatctccacactcccttgccctttaccttccgtgaccccgatccttccttggcacaggggtccgtctgatctgctcatcttctttggattcttttggggcctctgcacactctccgttgaccctttttgccaggacaaggggactcaggctgcccatgttcttctttcctcacccagtggatagtgggggcttgtgcagctctgaagtcatttctaaataggaaagcagacacttcttccagatcatgcatactcttacactttgctgggttagggcgagctcatttcctaaataccctttgagttgccctccttttcttatggagacaactggacgttcaccgtgctcctttcgccatttgtgtgtctacactgacttgttctctcttctcggagttccttgtctgggtgagagtgggcgccccaataagatgtagggcagggcttccattgtgcctagtgcttgagtgaaaaggggccacactagttgctcctgtgtctgaggaagaccggggtatatttttgcctccacttgactcttgtgtctcaggagggggcaaccttcatcagttgacactacctcactgggaaaagggtcatgtggccttgttttttgatgttttgattactgtcttctgtgcagtgagaaccagactttgtccgtcccacactcaagagtccttgaacctttcctggatataaacttcccgattgttttttgagagaactcatatcctcctctgtggcttctgcttcgcagtcagccatatttagtgagcctgttactttgactttttctaattttctcaaattgtattcatgttggctgggtaaggagaagccatatgcctttccattcagaaaagggagtgtagacacccgtgtcgcccacatgccatcctggaagaggttgcttgtgtgctccttgttgtactagaaccttcctttggctctggtgttgtctcttgtgggatccagacatttctttagatcttgtagctttcagaagggggaatttgaatgctttctgttttttgctgttccggttctgctttggagaaccagatcatgatgctatattcatttgtttacatatacatacatgtaggtatacacagatgaaatcacattcattacatatacagtgcacaggaagttggaagggtcagatgactagctctacattttgggtgcatatggggacctttatgtgtaatgatacagatagatattaacgttgttggtaactcttcaggcttagaagcagcagcagaagaatcacggataaatggccaattctgactattctttggtttgtaatgtgtactgtactgaataagcagaacgacatcctgcgtgttcaccaagtccctgaatgtgcgaagcgtacagtgcctgcccatacgcatcgcaactttggcggtctgaatttaggggtggtattcgttgcttgattctgcatagagtgaaaagttcttgatttctttactgcagtgtaggggaaagagatttcgtgtgtttggacaaacgacaggagatgggtgagaagaatatgttttcctgtgacagaactaggaacgaatgaccgtaaatatgtcccttttgtattttggccatttaaataattgagagaggttgtgaaattagcaaaatgtacctgtggaaaggccctcgacgcttcatgagaggatggggaacgttattcttcaagttcttttctcttggacaggggaatgatttgagccctgtcggctctagtcaggtgctttgcctcctcaggtctccctccctccctccctccctccctttctccctctttcacgaaattcagaatggctgctagccgctgtcactcagcagggaagtcttactctttgacaggcttagtgtggagactcatcctccccaacaagttccgttgggctctggggctttggcctttaaaactgttctagctcagaggctcgctttgcctcagtttactgtgtaaggagaagtggctcatcggagattgggtcagcgctagttctgtgacttctggactttgcctttcagttagcattgagtcgtccagtgggcctgattcccaatgtcagaaagtagagcttttgagctcattttcttgtttttggttttaaatgtttttatgctgttcgtattctgtgtctgtagtcagcttgatgggattgtgtatttttagggggtgttattagggaacttcggaaaaacgaagagtcgaatacctgctgtagatggtgtagactcagcggagtcatcccgtttccagtggtggttcttcctaccgtttcctccatggccccatggagactttgggagttttccctggtaagcagggggctccgtgcaaggcgcagtggaaggaaaagtggtaaagattggttggaagaagacacttgaggttattgtctgaagctgggccctttttcttgagtttgatgtggttgtgtttctgtgtcactggtcgccacagatgattggaaattagctttttccttttaccttgtagtgcagaatgctctgttgcagttgggcagactagacgggttctctgaaccacatagtttaatctttctgttcgactttctgttaggacatgactctttcctctccttcaccccttacctccagtttttgggactaggttgggtgacctcttcctcctttgtcttcttggaaaccttacttatcctgcttctgcaaatgttgggtttctccatctcatcattgagtggattcaaagtgttgacatacacagagcaacctctactcaaggtcagattgggtcagcttttccttttcaaaagagtagtgttgctcttacttgctctttgagacatatttatgcatcctgctcagctgtgttttctgtttccttagtttttaggctctggcgattttaggctttcccccagaaatagcctattctttagagagtagtgtttagtttagtctcctgtttatgctggatgtccgcccatgtgtcctgctcggtttttaattctttgtgactgattttgaggtagcccatctcaaaatcttaacgtttttttccccactgtttcattactttgagccattcttcctttcctgtttgggggaaatacccctttgtgtgcagttgtacttctttctcctttccttatggaaaaagcagtagaaggtgattctcttattttcttctgttcccctcatagttgtgtcagttgactcttttgtggaacctttgaatttgcccttctggggagaagtcgtttttgtatttatactcccatgactggagtcattcattcaggagacctttaccgagcttctgttatgtacaaggagctgtagggggtgatgtgactttgcttgagaccatattggatcttgttagccttttatattaatgacattttagtgtatcttttttttttttttttttttttttgagacagagtctcactctattgcccaggctggagtgcagtggcacgatctcggttcgtgcaacctctgccttccaggttcaagcaattctcttgcctcagcctcccaagtagctgggattacaggcgtgcaccaccatgtccggctaatttttttttgcatttttaatagagacggggtttcaccatgttggtcaggttggtcttgaattcctggcctaaagtgatccgcctacctcagcctcccttgcctcagcctcccaaagtgctgggattacaggcgcaagctgccacgcctggccttcggtgtggtgcttgtcttaatgcttgtcttttatatagtcttgcaaggaattttttttttctgatttttaagtttttggattgttaacttacaaagatatagtgtaatagtgtgctatcttgttgaaccttttttcctcctcagcaggagtgggggtggtgaagagggtgggagggtggactgggagaggcatttagcagctttcccccagactgtgtgcagagtgtgagagagagagagagagagtgtgtgtgtgtgtgtgtgtgtgtgtgtgtgtgtagacaaaagtaaagtcagccttcttaatctgattgtgtaggcataacttttaggttgtttagatacatgattggttggaatgcttatttaatatttgaacggcagcatcgcactaggcattctatagaacatagagtcaaatgtattttttatataaggaagtggtagaaaaatatttttttcttcggattaactggtatggttcatagtagatagtgagaactgtatgagctgctgttacattttcactgccatgaagaattatatccaaatttaatacctaattgatgctcattcttaggctaggcatctgatataattatcacttttattatatgacttttaatttatgctttttaatggtattattatttttgtaaattgcctcaaattctttgtgggtacaggttaggtataaataatgataataataaaaattactaacaatttgaaataccccttttcttttttcctctattaaattagatttaccatctccacaacgtatatagaaaccaattctgctactatttcactcttgtgaaaactcctgtgtgaggtttgtaatatgtggtttggcagtatgagtatgtgactgagtgtattttgtgttgacaagtgatgtgtgtgtttcttttgcatttccattatacagatcttttcctaaggtggtgtgtatcttctagaatcatgtaccctgtcctttttttttttttttttttaaatgttctaggtgacttaaatccgacctccctttcttttcttcggcctttccttttattttttgtcctttcccacatagagaggtttcttcactgacctgtcattattataaaaaagtgtttgttagatgtactgtatttgtagccttttagtaagaaggggatgcccaccatccctttgtcctgtagcacaaggcattgcttcttgtttccctaagaataggtagatggaatgagatttaagccagaaggccgctggtaatagtatttgtaactagatagcatctctagataaaacactgggtcctttctgctctgggcctccccatgtaggattttggaaatttttttttgctgcatttagccagcttctttctgtctctttggcttgatacaataaatttctttaagcacagccaagtatattatttcatttggagccttcatttacaaggaagtatgggggcctctcctaatgttcctttgcctgttatatatagtactgcctttagtttttggtgtgtttgagagtgagagtgagaagcattcttgctctgctactttgtctgtgtaacttgaataagagtgtacggtcattcactctattttccagatagtgtataatctttctttttatttttcttgaatacctaatcaggttcgagctagaggttgatccgactatcatatccttttattttgtgccatccctggatatagtgtcccttagtcctgtgattaagccatgttcctattttgtcattagagagagggacttacaaacatatagatggtctcccatgataattgtcatgcatttataaggaaagtgtttcttttctttttttttttttgaggctgagtcttgctttgttgcccaggcacgatctccgctccctgcaacctccgccttccaggttcaagcgattgtcctgcttcagcctccaaagtagctgggattacaggcgtgcaccaccatgcccggctaattttttttcgtatttttagtagagacggggtttcaccatgttggccaggttggtcttgaattcctggcctcaagtgatccgcccacctaggcctcccaaagtgctgagattacaggcatgagccaatgtgcctggccggaagtgtttccttgtataaattgacaatggagagcagttcacgtgatgggacaaagtaaagggtgagtaaagggtggttttgggtttttttttttttttgccatcagtatgctagctgtatatttctaaggttgtattgcatccttctgctttgaacaccattgcttgtagaaggtcatgggcctcctgtgtaaagattggtactgtttcctgagcatttttttttttacctcattaccctggacttacagagaaatattatgtaccccattgcaaagagaggccaagggtcagccacattatttccccttttgctctttttctggaggattgttcatttacttcgaactgattgacatggcataagatggaatgactagagatttttttttttaaaggttcctccatattcaacctcagtgtttggctctatcctgacatggttgcttgttctcctgtacatgaatccttttgcagttactttcttgtttttgtttttcaaatttagccagggctttcaagtcacgtaacatatcctttcctgagactgtgagccgaaggtaacttcaaggaagatatgcttgtttggggctgtattcatcactctgctctctacggttttgtagttttcatgtgtacaaagtgacatttcttgaaagaaacgtttggggctgtgttcttaatagttttaaacatgttattatgtggagactaagtggcaaaggtctcaccccaacttcatttcttcataccactcatatatatcttatatatatataccccactcttatatatatatataccccactcttatatatatcttatatatatctcccctacctgcaaatcccaaaacaatagtcatagcaacagaaaagcaaaaccttgtgaagcccagctctgattggttctgctgtgcagttcagtcgctagttttggacaggtgcataagcagataatttttggatgtgtaatattctcagtggggctgatgtgtgacttttgggacatagagcattcattcgttcagcagaccatgcagtatctcttccatttttttccccttatcagttaccacaaggtaagattatgtattcagtcacttaaaaacacttgcaaagtggatttttccccatttattcctatctaaccattggaataaatgttgacagtagtaaattaccatgtccctatttttgtgttcaacatgtctaagagaatggggagctaacttccagtaagggcagtacagtcagtcatgactctttctccatgtagcctgtgcattgtgcagtgatgatttatactttcagctaaatttagtgtctatgataagggatacatcagatgtttaagttcacttaatctcttttacagtgtgcattcaacaaggtgtatttgtgtcttatattagaatgaaatgcagatacaaccagaggtattctttcaacgtagagagagagagaaagcctttctttttacaagttttgaaaaaaagttattgtctatttttccttcatggtgcttgatttagattgccaggagtcatttctgaaggtatattaatacaatcaagaattaatgttcttaaaacttaaatttgttttttaatccttttctgaaaagtcatttctgaggatatatgtgccctgttggttttctgggcacttggatatcaaatcatttgggagtgataataagaaattggtacaaagtgtgaaattatcagatagaaagaaaaaagatgttatagtggaaaaaattactcatttatgattaaaaataatctcaaagtgatgactggaagtataaattcagatatttgaagaagaaatggaatgttgatagggttattgtattgaatcaacacatgcacacgtataaagaatgctccccaaaatggggacgcttagaggacaaataagttgattggattggttttaagaaaaatattgtttgtctttttaaaaagtaattgaaataacccttcttagtgaagaaaatgaaaactttgatggaagttcagcagaatggaatatttaaaaagattcaagagaaggatttttttattgcgaatccacaagggggtagtgatgttctttcaaagatatttgtggtggcaacaatgtgagatgatctcttcacattttagatttacagataaaactggcatgtttgcattttaacttaataagatcttctttttaaaatgtttattggcaaaattgtttattgcttaaattaaaaaaaatccattttgggtgaatggctactttaagccatatgaatggtaaagaagagagaatgtccttacagttttgtgctttggagaggtcaccaaggatgtgagggtcactgttattttctaagaatgtaataatcttaaattccctgggaaacattagacatctaggaatcagttacttaagtgtcctgaataaaaggattttagtaaattgtgtctaaactttacagaagtttgtattactagttgtattttcagtgctgccgagagatgaaaaatatgaacaatccatgccactagccacttttaatagttctaagtaaatcaaatttttataatcttttttattagtttatattacatcattagataaaggctttttttttgttttttttgtttttttgtttttttgttttttcttccctcacataaaaattcaggagctttcttctggtcactgagttccaccccatattattcagaattacttaaaatcaggtgtggtaggcctgtgctgggtcattttcagtggaggactgcctagctgtattatgcactcatttttgaaagttatgccgtgtggtgggagaaagatttaaagttggggggcggctgtgtcctacttatttagagacacaactagtcatcacctgtaacaaatgtgacttcttttaaaacttattttatcttacttttttttagagacagggtctcgctctgttgcccagactagagtgcagtagtgcaatccatagctcactgaagccttggcctcctgtgctgaaatgatcctcctgcctcagccccctgagtgactgggactacaggtgtgtgtcaccatggctgcttaggttttttttttctctttttcgtagaggtggggtcttgctgtattgcccaggctggtcttgaactcctggtctcaagcagtccgtctgcctcagcctcccgaagtgctgggatttacaagtgtgagctaccatgccctgcctaaaaaatattatttctaacaataacacaaaataattatgtggtttagaagttatgatagtttgtgccatatacattgtatatttttcatttttggtttgtggaaaaggttgttaattgagcttttctctttttttctccattccctcattctgagcaaggaatgactttttcttttatttcctttacgaaatgactttggtgttttaacattccagaagatacactgttttttatatgctactctaaactctgctgggaactgaactatgacgtcagcattttcattcatgaatctgattcttctaaatttttttcctgttttgtattcctgagctgacttctggcacatgcacaaatcagtttaccattagtcagcccataaatcactgataaaaggtaaaacaaaagataagatactggagttattttgatagtgctatagttctcatgctgatttgcatcagtacagtttggataaggtttctggctaaacagattgaaacctaaaaagtcaatttaattatctcatgattttgtgacttgaactgtgttgtgaacatattgacacaatatttttgttcttacaggaagttgagagtgctatgctatggctcctttgttataaaatagcatttcttttttttttttttttttttttttttggagacggtctcactgtgtcactcagtctggagtgcagtggcatgatctctctcggcttactgcagcctcgacttcttgggctcaggtgatccctcagcctcacaagtagctgggactacaggcacgcgccaccatgcctggctaatttttgtattttttgcggagatggagtttcgccgtgttgcccaggctggtctccaacttgtgaatgcaagtgatccacccactttggcctcccagagtgctgggattacaggcgtgagccactgagctggcctaaagtagcatttcttgtataatttgactaagttggaagattatataatgctttatttcagagaggttaggcctagagattaaatgatgttttattcaaattacctttgtaatggatttagatttttttttggagcattttcttgcctttgacatattttaaataacttcattgtttgatacttttattttaagatattattattgtggtggaactagcctagtattccttgtattggacttagggtgcatctaccctggattgtgcactcgtgtagctgttgactccggtttctcctctagggaggtcactgcttgcagttcagtactacgttagaacagttcttgaagaaatcttatttggagttttcttctgcaggccaaatttcaggctaagcctccggcccatagtatctttcaagcctgctgtagctgatgaatggtgagccgtaaaaaagtttattttctctactttcgtgggggatttgctgactttctggatactcaattgccaagaaacatttagaaataaaacgtgttatatttaggaatcatcattttagctaaataataatgcatgattagaattgatgattcaagctgcaaccactttgattgatacccagtcttactcttgagatcacttttttttctgagacagtcttgctttgtcacccagactggagtgtagtggcgtgatcttgtgtcactgcagcctccacttctcgggcctaagcagtcctcctgcctcagtcccccaagtgactgaggctataggtgcgtgccaccatgccaggctaatttttgtagagacggggttttgccctgttgtccaggctggtctcatactacagggctcaagtgatcctcctgcatcggcctcccaaagtgctgggatgacaagcatgaaccaccacgttcggctgagatgactttttattttttatttactgggtttttttttttttgagatggaatctagctctgtcacccaggctggagtgcagtggcatgatcttggctcaccgcaacctctgcctcctgtgttcaagcaattctcccacctcagcctcctgagtagctgggattacatgcatgcaccaccacgcctagctaatttttgttttttttagcagagacggggttttaccatgttggccaggctggtctcaaactcccgacctcagctgatctgcctgcctctgcctcccaaagtgctgggattacagacgtgagccaccgcgcctgtcttgagatgactttttaaatgccataacaactcacagatcctgtgtcctcccattcttaaatgaaactagagctttgtgttcctttaggttaaactaaattatctaataggtaacagaagagtggtctgttagctggctttctcctttcagtagatttgctaagagaaaggaaataaaagcaagtagactgtgaataaacattgaagatgacttaaatgacattgttttccctaataatgaaataatttatatattatttaaatataatttctataaaagaatctatttgcaagtgataatgaagaaaggaatttttttttttttttttgagacaaagtcttgctcttgtcccccaggctgcagtgcgatggcgcgatcttggttcattgcaacctccgccgccttggttcaagcgattctcctgcctcgccccccaagtagctaggattacaggtgctgaacaccacgctgggctaatttttgtatttttagttgagacaccatgttggccaggctggtcttgaactcctgacctcaggtgattcacccacctcggcctcccaaagtgctgggattacaggtgtgagctaccgcacccagcctaaaaaaggaatatttaatggtagagggctctgtaaaaaccccctaattttcaaagccatgtgccactgtagaatttatgaaaagttatgggctattattattaggtttcaaaaagtctggaatactggcggtagcatcagaattatttatttatttatcttttgagacagagtctatctctgtcgcccaggctagagtgcagtgatgcaagctccacttctcgagttcacgccattctcctgcctcagcctcttgggtagctgggaccacaggcgcccaccaccacacctggctaatttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctctatctcctgacctcatgatccgtccgcctctgcctcccaaagtgctcggattacagacgttagcctccacctccacgcctggctaaagcgttatcatttttatctaaccctgaaccaatcagtgattggttagttctctagctgtgaaggctttgcacttcctagacagcttgtagaacaagcccacttggattcccagctcaaactctttcctttttactatttatttattatttatttattcgttacttattattaattaaaaaaattttttagagacaagagtcttgatctgtcacccaggctagagtgccatcacagctcactgcaaccttgaactcttgggttcaagtgatcctcctgcctcagcctcctgagtagtgaggactacgggcgtgtgccaccacacccggctaattcttttttaattttatggagaaagggtcttgctatgttgcgcaggcttgtcttgtactcctggcctcaagcagtcatcctgtctcagcctcccaaagtgccaggcttacaggcatgagccgctgtgcctggcttgtactctttcactagctgggaatgctggtgagcaggactcaaggatcccagcagagctgcatcctgtgctgtctttgctgccacttaggtggaccaggagctagaagcctttctctccatggcctccataccttcttttaccagatggtatttctgcatttatcactcttgattccagcacagcttttcctcatcttgcttttctcagacctcagctcttatgtaatgagatagttggtagtcattttgaggggattcatgtgttgggtaaagggttttcctagcgatgacctcgaaagttccttcccattaataataattactattaataattaatagcaataactaatgataaaacagaacagttgcagcaatatactgtaataaaagttgtgtgaatgtggtctctctctctctctgattatcttattgtaccatactcacctatttttggaccttagttgaccgcttgtaactgaaaccatggataagagggggactattgtgtaaggaaatgaagtcggagatatggaatttcatttcagggcttgctttcctgatattcagctattctgtataactgtatcttttccttttgaggtccttgctccaggacaagaataatatgttgactcaagctgtatggggggatttgaactacagacactcagatatctcctttctgaggtacatagagggcttaattttttaggtctgtctgtttaatatactatatttactttaaaaaacgtaggccgggtgctgtggctcggtgcctataatctaagcactttgggaggccgagacgggaggattgctttagccctggagttcgagaccagcctgggcaacatagtgagaccttgtctctactaaaaatagaaaaaattagccagatgtgttggtgtgcgcctgtgatcccaggtacctgggaggctgaggttggaggattacttgagcccttgaggtcaaggctgcagtgagctacgatcacgccactgcactccagtctggatgacagagtgagatcctgtctcaaaacaaacaaaatgtaaaaaaatttaaatttattaaaaaagatgtacaacaccaaaatgttcatagttattctgtatgacagatctgaggtctttgttcagacatagatgagggttcatagttttggaaaatagacttaaataatatatgattacagatgaaaaatatttgctaacctcagactttttatgtttaaggtagtatttatattcatttagttgtactttctggagttgattaatataactgttattaaaatctatcgattcccagtaattcagtaaatgaagactcttcctatttagaaactcgtgtggattggggagttgctgtgggcccactgtcattgatcatatcacatcttcacttgaacctgctccctgggcctcctataggcctcgcgtttggagaggccgtgaacataatttatttttggaagtttctttcatttttaaagatactgagaggcaagttgaagttcctggtgttcgtgtaaacattccctgccttatcctttccatctcagccattatgaaatgttctggctgaatcatttgctttcacaaagctttgatgaaagtttcttcctcatttggttttcttgatagaggctgttgtgctaaaaagaaagctataacaagttagaagggtggagagtgggcacttaacatttttgaagtacttgtctttcttcctaggggtcctccagaaattgatcatagataacttgaccaaattcaaggcccagagatttcttccaggcattctgggagggaaggaacatcaggctttctgtactgaatctaattattctaaatatttcccactgcagcttgtatgagtgttttctgatgcaaatatggtgatagtggcgacctctctaactgggctaaatatccttgacagctttttatctgtcctctccaagtatttttagtctctttagcttctgtggccatgtctggaggaactgaggatggatttagctgctctggtgctgctccaagttgttgtgggtgctctttgctaccttcgtcactgtcctgccacagtcctgccactgatgaggctcctggcccttgtcatttgatgagggaacataaacacttgtttaataaaaataaaaaagtcatgattttcagaatgctttgaaaataagctatggctaatggtgatacacaataggaatgtccctaatttcactaaattgtatgctcaaaaagggttaaagtggtaaattttatgttatgcatattttgccacaattaaaaaaataaaaacttcaaatggatttgaagcttaatgagaaaactagttataatgtcctaacagtaaatatatggccaatattttcatgaccccaaggtgggaggctgtgccttaaataaactgtcagaatcacacattaaaaaaaaaaaaaagtgatggtaatcaggccctgaggttcatttatacagaaagtgatttttaggtgagattttaatatttgcaatatttatatttgtaaagaggattggctagctcattcagaaaagtctgaggttcttaataaacactaggaaacagatggtttggggttgatgtcagggaaggtaagcaggccgtgctttagattagagcacttttgattgcaagtcccatgagccacacagtttaggccaagtgaaagcagttttagtctaagaagagcagaagcaatcgtagcctctcgggacagaaactgaagtgcagctgggcagtgggaactggatctggagagtctggagtacatgtcttctctggagctgggctttttccattcacatgtagcttccttgcttgagttacatgtagtggccttagtcatggctcctgcatgtcctgactctagttccagtactcatcatcatctgactcccatttctatggctcagtacaaaaatattcaagactgggtattggactgactcctctcagccatttgctttgtttccataggccaggtgatcatctcactctggtcgactatgaaagaaggttggttagatccagcagcctgctgatcatttagagggtcttagagtgagaggagattgtgtgagaagctggttatcatagcagggggtcctggcacctcaaactctgtccccatcaaacagtgtaaaagaaaagatattgactcctaaaggagtgtcttatgttcagatgctatagagttttgcagagaaagtgttcagtgtagctacagatagaaggccaagtgtccttggtcagccagcctgggtgtgtgtggagtaagttagtggtaggtgtagtaactgtctcaaagctttttctttgtctctctctctctcttttttttttttgagacaaggtcttattctgtcgcccaggctggagtgcagtagcacaatttcagctcactgaagcctcgacagcctgggctcaagtgatcctcccacctcagccccccaagctgaggacttagctggaaaacacaggcatatgccacaacgcccggctgatttttatgtttttagtagagacaggggtttcattatgttgcctaggctggtcttgaactcttggccagctcaagcaatccacctgcctcagtctctcaaagggctgggattacaggcgtgagccaccgtgcccggccccagaactttttctttgaatagtggagaagcagaacaccttggaatgctatggtctgtgcggtctttgccctgtgggtgttctcaggtggaatcaggcagtttgggtgatgtcagtatcatttgaggtcttccacagttcagctatttgggtgggcttccccacttttccccttgttttgggtcggtaaacataaaaggatggagatgtgtatccttagtaagaatgggagacgttgccttcagaatgggtagaaagcagaaaacaagcggggaagaaaacagaaaacagcctctctttaagtgtatgtggctgcctgtgtgcacagtccttcaccttttccttagtatatccctcctgcctctgatctcttgttgttcttgatttttcatggtagaaggaggaaacaaaattatagaagacaggtggaatactgtgaaagaatagtagtttggagataactatgtaaagggctactagcctgcgcaccgttgaattctctgaatttacagctgtttagtcattgatgtttcatagtgttgaccttgagtaaattcagaaaagcaatactgagtatgttctgctaaacaaaagaggaaagtgtatgtttttaaagaaacaaccttcacagtggtttcagtagttacagggatttggttcttttttaaattattttatttctttttaaagatggtctcactctgtcatccaggctggagtgcagaggtgtgatcgtagctcactggcaccttgaattcctggactcaagtgatcctcctgcctcagactcccaagtggttaggagtacaggcatgtatcaccatgcctagctgattaaaatttttttttttttggccaggcatggtggctcacgcctgtaatcccagcactttgggaggctgaggcgggtggatctcctgaggtcaggagttccagaccagcttggccaacatgggtgaaaccccttctctactaaaaaaaatacaaaaagctgggcatggtggcgggtgccagtaatcctagctacttgggaggctgaggcaggagaatcagttgaacccgggaggcagaggttgcagtgtgtcgagattgtgccatcgcactccagcctgggaaacgagcgaaactctttttttttttttttttttttggtaaagacagggtctcaatatgttgcccaggctgatcttaaactcctggcctcaagtgatcctccagccttggcctcccgaagtgctgggattgcaggtataagccactgtgcccagcctgatttgttttttaataatagcttaagatgtaattcatatattataaaattaacccttttaaaatatataattgagtgggttttcttttgtatatttacatgtttcgtgcaactgtccccactctctaattccacattttcatcactccaaaaagaaaatctgtacccattagcagccactccctgttgcctcctcctcccggccctagtcaattactaatctgctttatttctttatgcatatttatgcctagtgtgaacatttcatataaatagaatcatgtagtgtttgtccttttgtgacttgactggcttatttcccttagcataatgttttcaaggtttttatctatgttgtatgtagcatgtactgttacttcatcccttttttaaaattaaaaaattttaaatttaatataatagagatgggggtctcgccatgttgccaggctggtcttgaactcctgggctcaagtgatccttctgcctcggactcccaagtgctgggattacaggtgtaaaccactacacctggccacttcactccttttatttttgaataatcctctgttgtgtggatatataccacattttgtttatccattcaccagttaatagacatttgagttattccactttttggctattaagaaaaatgctgctgtgaacatttgtgtacaagcttttatatggacatatgttttcatttctgttggaaagatacctaggagtggaattgtggtgtcgtagttaactctgtttaactttttgaggaactgttttccaaacttttccaaagtggttagatcatattacattcccaccagcaagtatgagagttgtaatttctccacattcttgcaaacacttgttattgtccatctttttgattatagccattgttgtagatgggaagtggtatattattgtggttttgatttgcatttccctagtgactaatgatgttgagcatctgttcatgagcttattagccatttgtatgtctgctttgacaaatgtctattcaaatcctcttccatttttgaattgagtcaattgaatttttgctgttcagttgtaggaattctttatatgtgttctagatatcagtcccttatcagatatgtgatttcaaatgtatgattgacatgtgatatgtgatttttctctgattctgtgtgggttgtcttttcgcttttgttttttgagagagggtctcattctgtcacccaggcaggagtgtagtgatgcagtcatgtctccctgcagtcttgcctgcctgggcttaagcggtcctcccaccttagtctcctgagcagctgggacttcaggggggcaccactggtctggctaatttagaaattttttaatagaaacggagtctctatattatattatgcccaggctggtcttgaactcctgggctcaagtgatcctcctgccttggcctcccaaaatgctgggattacaagtatgagctgctgtgctggcctttactttcttgatagtgtcctttgaagaacagaagttttaaatttgattgtgtcccatttatctgtttttttgtttttttttttggtcacttatgcttttggtatcataataagaaaccattgtcatatccaaggtcgtgaaggtttacacctgtgtttttttgttagagttctgtagttttagctctgacatttagttctctgatagatcttcagttaatttttgtacacagtgtgaggtaggcttccagcttcatttttttgcatgtggatattcagttgtcctagcccatttgttgaaaagaccattctttcctcactgaagtgtcttggcacccttgttgaaaatcaactgactataaatctgtgggtttatttttagagtcttgattctattccattgatctatatgtctatctttgtgccattaccacaatgtcttgattctgtagctttgtagtaagttttgaaatcaggaactgtcagtcctttaactctgttcttctttttcaagattgttttggctgtgctagctcccttgtatttccgtatgaatattaggatcagcttgttagtttccacagaagagacaactgagatataatggggattatattcaatctgaggatctatttggggagtttaaattcattttatggatttgctgtatgcttaggaagtcctggctaactcagacacccaagcatcttgccttaaaaacacaaaattttgttttaatttattgatgtagtaggctgccttggtgaaacactgtaattcactgttagactggaattggacttttcaggttctaagagagcaaacagctcttccacgtagcgtgtaggttgacttcctgtagtaaatgtttttttgatgtgaaagtttgctgataccttgcatgttttaaaaaaaatgtggtattctggttaatatacattctggttaatagagaactagcagattatatatatgaatatttatcaaagagttaggacatgttacaataaaattgtgacattaaaatttatataattgttattattactggaggaatcagaagatattttaggaccttgtagtcccgcaggggccacgtgaacattggttattgttatacttttaagtcacttcatttactcaacaaataacaaagtgcctatctgtgccaggcacaaggaaggacagacccagtctctgtccttatggagctaagggggagacggacattaatcaagatgccatatgaaatttcagctgggactcagtgctgtgaaggtgcgtgcaatatgtcataaagggatttgactaatctgcaaggttgggggaggcttcttgagagctctggaggaaaatgggaattaattgtgggaagaattaaggagaaaagttccaggtaattgggtgagtttgttagtgagttgtgtggagatactctggttatatcctgtttatcacttttgggaaagagtatctgaatacttggctctggcctttactctgtcccttaaatgccttgtggctgagcaggtactctttctgagcttgttcacatactgttttttaaatttctgtagccatttttatttacagatacttacatgaaaacatacagaaatctaggcttttggttgattgttttcatataattaaaaaatcattcactttgggaggccgaggcgggtggatcatgaggtcaggagatcgagaccatcctggctaacatggtgaaaccccgtctctactaaaaatacaaaaaattagctgagcgtggtggcacgtgcctgtagtctcagctacttgggaggctgaggcaggagaatcgcttgaatccaggaggcggaggttgcagtgagctgagatcgtgccactgcacttcagcctggaggacagagcaagacttcatctcaaaaaaaaaaaaaaaaaattatttctttgtgaccttccatggttagctatttagaactgctttagtggtaaattgaatacttttctgaacatttttcctagactttgaaattaggagtcatttctgtttacacatacttcagaagcctgtcagggacagagtctgtagtgacagaagtctgtagggaagcagatatggatgtaagtgattcaagacaagtcataatgctttaataaggctctggaagggaagatggaaagacttccgggaggaggtggaatttgacctgaaatcattgacgggcaaacatggtagttggaggagaaattccaagcagaggaaatggaacagaggcatagagccaagagagtacagggagtgggtggaattcatgtgcatatgggtaggtaagcctcggaaagtaggtaggggtcatgttgttaggggcctgaaagtcagaccgaagaatctggatttaattctctgctcaggagaggcttttagaagttttttttttttagtagaggaatggaattgattggataaagtcgattctcctgaaacaggtgctaataagggccacctagttacttctccagcttcctctctacagtcacgtcacattttttagactctgattgttccaaggtcccacagtgtctggtggttttaggcctcccacattgctgttgccttgatttagaagttgcacctgcctcaggaacacaggcacacacgctcacccatgctcttgctgactttctgtgtcttctgtgtttcagcttaaatgaaacttccaataggagaagccttcttgaccttgcccctcttttcagattggatcggatgcccttcctgtgtgcaccatagcactacgtggttttcctagtcatggcacattttagtttgcattggagttgcttgtttacttctctttctctctcaattagatgtgcatttctggaggtaagaggcttgagtacctagacttagtaaatgcttgttggctgaatgaatgaatgaatgaatgagcaaataggaaggactagagtcgggagaaaatcacttctggcaagagttgtctgtagaattggggtgaggaaagagctcgcatggctgaggagtgtgtgtgtcacacacacatgcaattttgtgactgactgaatgtgggccttgagggaaggtgactcctaggttttgaaccataactggggatttagtgaggccagactgagatagggaagacaaggcaggtatatttggggagaatggctgcaaaggtaccactgtttttcttcttcttctttttcttttttttttttttgagatggagtttcactcttgtcgcccaggctgcagtgcaatggcatggtctcagctcactgcaacatccacctctcaggttcaagcaattctcctgcctcagcctcccgagtagctgggattacaggcacccaccaccatgcctggctaattttcgtatttttagtagagacggggtttcaccatgttggccaggctggtcttgaactcctgacctcaggtgatccgctcaccttgacctcccaaagtgctaggattacagacgtgagccaccgcgcctggccggtatcgctgtttttaaggcgtcattgggtagctttagaatgtgtatatacagcgtgacattggagatgtgggtcaaagatcagggagtccttcatatcaccctgctttttttcttcattgttcttccagagggcaagggagggagccttggtgctggagtccttagaggtcagccccctgggcttggggcagggagagaagggctgtgaggaggtctggaggggcagatgcagtggcagcagcacagcacaaaaggtacagacagtacctttgcaaccaatgaatgaatcagttcaaaacaattagaagtcacagttgtgagtgagattggaaggggagcagagaaggggcctgagggcagaaatgtgatgaatgcttacattttaatgccaccagaggggagagaaccagtagaggctgagaaagaatggtcggagaggtaagggaacaagcagaatatgaattcagggttgctgagtgtggagggttgaaaggaggttgtcagtcgtaatgctgcagagttgagtagactgaagactaaggaagggtattggttttgtcaattcgataatgagagaataaaggagtagagatagggtggatgattatttcagaaccgtggtggcatatacagagtactggtagaaatgatggtgaaatgattgatccagtccaagatgagaaaagaaaccactgtggcctgatgggctgtgagtgtattagttatctatagctgctgtaaccaatcatcacaaacccagtggcttcaaacagcccagggtggaatctcctggttcccatgggtcaggcatttgggcagggcagggctgggtctgctggattgggactgctgaactgtggtcgaggtgctggccaggactgggctcaccttggaaacctctggtaggggaggatccacttccaggctcccttggccatttgaaggactcctttctttgggctgttgggctgagggctcagcttttcgccagctgttggcccgaggctaccctcaattcctgccccaggggcctctgcaacaccatagcttgcttcatcagagccaggagggacagtctctagcaagacagaagtcacagtctgcccattacctttgccatgttctgctggttagaagcaacttgctaggtccagcccacactccgggggagggggttacacaaagctgttaacagtggctgggcgcggtggctcatgcctgtaatcccagcagtttgggaggctgaggcaggcagatcacgaggtcaggagatcgagaccatctggctaacacggtgaaatcccgtctctactaaaaatacaaaaatttagccgggcgtggtggcggacacctgcagtcccagctactccggaggctgaggcaggagaatggcatgaacccggaggcggagcttgcagtgagctgagatcgtgccactgtactccagtctgggtgacagagcgagactccgtttcaaaaaaaaaagctgttaacatcaagaggtggggatcataggaggtccatcataaagtttgtcctccaccgtagaggggtggtgacgggattagaaggcattataacagttcttcaggtgaggccttggaggatgcagatggaaaaacgggagctttcagaggcggaagttttggaagtgcagttccagttgaaagttgggatagtcaggtggtgacgcttctcaggaggccttctgtgccctttgtcttcatgtgccttctatgtgctctctcctgttagacaaatgaacattctgtgttacagttgccaccgataaatccatctgtctggctaaaatggaattatttaccagccaattcctggccagtggaggtatctgccctcttgccttatggttttgttgaggatcaaatgaggtaattcatatgaagtgttttatagactacaaagtaatatgcaaacaaaaggtattaaacggtgctacctttttctctatgttaagtagaacccatggaatttaacttacattttccttaataacttgggttcattatgttgtatgtagcttattaaactgggctttatttaacactgtgatttgggtttttggagtagagagtttacttttatgataaatgaccccaaactgctatacctttcaaatccttgtgtcccatttttattgtttaaaaaaacaatctcaccttgccgttgcctgtcactcttttgcttctgtgtgtcagttttgagctacattttttcccctccgatttgttgcttctgatctctgggcttggcaacctgataatgaagcatattagagctgtgagtagttttatagtaatcaagctacgaatgtgggtcggagaaactcttctcacagtggagtacataagcttttgtgcatggacttcgtaaaattcacttttggccttcagagtgttcttggcttccttcctagttctggctgtgttcggattaagggaggttcccagatagccgacctccattccggggctgtggctgccattttcttggcgtccacctcattgctctgttacgagaaacagtgtcattctcttctttagttttgatgaggttttagttctttgggcagtagcaagtagtgataggtgatggtggtctgtggttcatggaccaaaaaatgtttgagaggcatggaggatctttagacaagatcaccttctaggtgtatgtggtagcattctgttccaccgctctcttctccttcaggatgtctccctcccagctaacctgctcggtgttcctcagtgggagcgtttgccttagctttctctcagagcatcgtacttactttttctgcccgcatttttgcattgctgctttgtggagaagcgttgctgcattattagggagagaaccgtgttttcttgtggaaatcacacagtagtatgggagaactggtctggttctaattctgccccgtcctagcttgtggcctttgcccagtgccttgttacccatgtcttggtgtctccatttctagaataggcttaatgtgtgctttgctaccttttaggatcgaaataagattttatatatgaaaatgcttgttatacgtacataatattgaatagaatgcctagtttgttgggttgattttgttgatattttacaatgctctctctgaggagttaaacaaaattatcattagtatgggtaacaataagtactactgaaacaatatcattttaaatgttatacagttttttttactgaatgtattctagttgaatctatttgtacaaatgtggacatttagtaagtgctctttgattattttcagactttgagtatactggcttccaagccaaattaaatttatgaaaattctaatgatactgtgattcatatctagaaagaataatttaaaaaaaactgtaaaatcactttaaacatgctttacgtgcatctctggtaatagagaatcaattaatctgatttctcaggccataaatctggcttgatatattgtaatattagttcctgtgtcagcctcttagaacttgaactgttttgtagtctgttccagctacttgtttgcttttgaactcaattctaggtgttgaactcaatttgagagcctaaaatggtttgtgccccaattaccttagaggttactgtttcatttttttatttagcctgccccaggagtaggaagtcggctacctaccagactttttccttttaacttgactgtatactttaatttttgtctctatcccatgggggagttgtgagggttattatagtatagtagcacttaatggcatattttaaacttcttgaaaagtggtaatatgtgagcacataatatttttgtactgtagcacataattttttcccacactaaccttttgtggttcagaaaaagaataaagttacttgggcttggggtacatgttgaattgcccatctcataaaatcgttaacctgattttagggagtgtctctgaaacatgtcttttgacagaccttgtgctgtttcttatttattattaataaattgatatttcatttattattcataaattaatactaattaaataattaattgtgctctagcccccagttttagtttggttttcttggtatctctgaaaactgttgagtattccccctactccttttaagtttttttttttttttaagcaggtttaaagtagcttttatcatattccttgatttctcaaatgaatagagggataaggttcctttctttaaaaatatctgcaacattgctggactgagaggtcgtatttacagttttttctttttaaaaattttttttagagatggggtcctgctctgttgtccaggctggagtgcagtggcacagctcacagctcactgcagccttgaactcctgggctcaaacagtcctcccgcctcagcctcccaggtagctgggactacaggttcgagccactgcttgttcagtctcttgcttttgtctcagtggcacagtaccaagacatagcaaatcaaagtgaccaagaggatgagtggcaattcggtggccttataggaagagatgtgcttgaaaacgacagaaggcttttagtaaattccaccaccatcaccaggacgagagacgggaccatttttcctttccataaacttaggggctggttattaatttatgaattctataagtaatttgagcttgtgttatgtaccagacattgtattaagtattaccagagatactgggaagaacaagccagacatcctttcaaggatgcatttgataaaatctcattttgagtatgttaggaaaatatttattggagaaggaaacctcctagattggttttagatcccgaatggccttagggattgaaaatggagttgtaggttagcagaggacatttctgaaaggagtaactattttgtaattaaaaagcagtttacagaagatactgtggcagagactgctagttgatcatgaaacccatctccttctcttcctcctcttcctgggcattttccagtcccccttggaatcgtgaccaaattctagccagtggggtgagagcaacgaagtgtgccacttccagacttggcccctgaaactcttgaggcatgggtatcatgccttttccttatctggcttgatgcagagggcctagtgacctagaaagtcttctgccacaaggtagaaggagcacaggcagcagagccactgctgtgagaacagtctgcccaccaggagcacctgttttggactttacctgagcaagaagtgaacatttttggtatttgagccattatacagttagcctccctaactatctaggcacgatgcctaggatgctaagcaaaactggactgagaggtcgtatctacagttttttctttttaaaaaatagtaaaggtgctaagtagtaaaggtgctaagattcaggcgcggctttaattctgtggagacctaaatattctttgtctttatttcaaagaacggtaaatacacttttcattatgctgtttctctgttccaaagcctgtaatcacttcttactatatagcatcttgtttcattaatccatcttccaaaaactctaatatatgtatatattatccatatacaatgaatgtgcctgtgtgtaacatcctgatctaggttctctgagtggagacaaaatgaataaaacatagtccatggcttcaaagagtttctgcttgatagccaggtagttactgaatttccatactgctatcatctgtcccttgttttaacctttaagtcatatattattttttcattacctttttttaaaagtattgtttcaattagatagtatactttttgaaaacagggaatatatattatagagctctgcatctctcctcttgggtatttcttttttttttttgagacggggtctcactctgttgcctaggctatagtgcagtagtgctgtcatggctcactgcaacctcgatctcccaggctcaagcaatccgcctgcctcagccttccatttagctgggactgcaggcacacagtaccacacctggctaatattttaatatttgtagagacagagtcttgccatgttgcccaggctggtattgaactcctgggcttaagcagtcctctcgccttggccttccaaagtgctgggattacaggtgtgagccaccatgcccagccttcttgggtacttccagcagaaactgggcactatacttgagtaaccatccctagagtttctactaattatcttgtgtggatattctggtatagttttgtattatgtactaacagatgaaagtactttttaaatcttctaggaattagtggaattatgctgttgaggaatgttaggattggaaggatcttttatagatcatttatctaattcctgatcttttagtttgatcatctggtttctgatactcaaggtgtggccattaattgcagcatgggcatcacctgggggcttgttagaggcagaatctcaggttctccctcagacctgtgaatcagaacttgcattgaaagaagatcctaagataacccgcatgcacattacatttggagaagttctgctcaaggtcaactactcatttgactcttgagaaaactggggaagtcagagagttgcccagtcatacaactgtttatttcagtggttctcaaccttggatacatcttgggatcacttggggacctttaaaaaaatactgaggcctgggtcccatccccagacattctgacgtaattggtttgggcatcagagttttggagatttcactagatgactggctaaggctgagaaccattgatttgattaatgatggaatccaggtttcttcatgctctaatcaagtattccttccactccaccatggctgtacattcagaaacaatgaaaaacatcctatcaaatttttacagtaatgcatcactccatttcatttcctttataggaatttacccctattggatagtgtcccatttaccatctgtcttccccccactagaatgtatctccaagaggacaggacccttgtctgtcttgttcagtgctgtgtcccagcttgcgaacagtgtctggtacatgttaggtgctcctttaatagttgtagaacaaatggaaggagctaccataaagaaggatgtgttctgtgagaggaaaacacaggctactctaaaggtaccctgtgggcgagaggcttcctgaagggtgaggggtctgagttgaagtgcagaatcagcgggggaggtgcttgaagacctgcttctgaggaaggacttgaacccagatctgacttgaaagcttgtgcttttccattccactgtgttgtcctgtggacacagtggctcactgatttgcccggacttcttagtagtgagtggtggactggaacacaccaccgcggctctgcaggtgcttaaggccagcccgcctccctctatggcagagccgccccagtattgcagacaggcgcctagagggagatcaaaacacgaagttgtcctgtgaaagttcctggcccagtgtttggcacaggggtatctagtacaaggtagccctttcttatcatggaagtttttttgtgctttggcttgttttgagaacctatggttttcaaagatagaatgacttgatttcagttttaactttggtttctttcctagttaactatggagacttcattatgcagtgctgtggagagagtgtgattggtttttgtctatgatatttctgtgtcatatgttattttagtgccaagttcttcctgttatttcagatattctgtcactgatttacttattgttagactttgaagttgggtataaaaatccttttttatgaagctattcattagtgtgtcccactgaaccaaagtgatttttaaaaacttttcacctaagaccattgttaagatatctcaaatggtaatcttataccgtcagtttttgataataggaagccaggaaatgttaagccttgaatgtaagacattatttttaacatcgtaaaatttcaagttttaattcagaaactaaattaaaatgaggtattacattcatgtgattagtgggctgttactggtgactcttaaagatgttacaagaagtcagcgtgctgctgacttttcccctattggagatcttcccatgaaccacttttcctaaggtatgatgattccatgctcacagtcatgggtagaaagtaatgttggattttccaaaggatacatgaattccgagccttgtctagtctatagggtgaatccttggacatgactgttaccacagatgttatcatagttaactactttttttgtttttgtgtcagggtctcattctgtcacccaagctagagtgcaatagcatggtcatggttcactttaggctcaaattcctggctcaagtgatcctcccacctcagtctcctgagtagctggggttacaggcgtgagccactgtgcctagctcagtatactactattggttaaattggagagggaaacagtcctagaacaagagttttacagaaatagaaaagaaagaattaaggagctcatggttatcctggtagctaggagtcacattatagagaaagactttatttatatggaccctgaaaacaatttgacttctgaagcacttgatcatgggcataagggagaggaaaattaataattcttggaagtcaactttagtcagattgcaacattttttggcataaaaaactcaggcgcggtgggtcatgcctgtaattccagcattttgggaggccgaggctggcagatcatttgaggtcaggagttcgagaccagcctggccaatatggtgaaaccccatctctactaaaaatacacaaattagccaggcatggtggcggacacctgtgatcccagctactcaggaggctgaggcaggagaatcacttgaacctgggaggcagaggttgcactgagctgagatcccaccactacactccagtctgggcaacagagtgagactccgtctcaaaacaaacaaacaaacaaataacaacaaataaataactcaggcaatcctgtttgttcttagaaaatgttaacattgttaaagctcaccctcattaactatggtaacaatagtgttttgtatttgggtggtacctttgaattgaaagcacttgggtatgtattacctaatcctcctcctgcctcagagagaaggagagagaagtatccacccgccctttttggatgaggtagtacagagaggttgaattactttcctaaggacagctagtaaatgttagaactgaactctttatattttattttaattaattaattttttgagacagggtttcactctgtcatccaggcgggagtgcagtggtgtgatcatggctcactgcagcctcaacttcccggattccagcaatcctcctacctcagtccccccaggtatctgggaccataggtgtgttgccaccatgcctggctaatttttgtatctttggtagaggtgaggttttgccatgttatccaggctggtctttaactcctaagctcaaataatccacccgcattggctccgcaaagtgttgggattacaggcatgagccaccacatttatttatttatttattattattatttttaaagatgaggccttgttctgttgcccaggctggagcaggagtgtagtggtgttatcatggttcactgcagccttaaaagtcctgggctcaagcgatcttcctaccacagcctcctgagtagctgagactacaggcacaagccaccatgcctggtagcttttaaatataaaatgttgagggtggttgttgaacttgtaaactatctttggttttctaagtgtataaatatgtggtttataatgtaggatgaataatctaaaattttatttaatactgcagccaaacaaaaaagatatttttaggactgaaaataattggccgtcaatattcaaaaaattttctttttttttaaaaagttaccgttgtgtaggttttaggtgaaatctttaattttatctgagtgaagcagcctgacagccagagaccttgtttctttcctgttaacggaattccccttgatttacttgccatgccataatactagttggcgctctgcacattttttgggtgagtcgggtgttgggtttattgttgggaaatggttaaaaatgttgttggtgttgactgagcttcaaaatgaatatgacattggttcttagcaaaaatttcctctatgtacagcacacatacttcccatttaaacaaattacacaagttatgcatgttcatcagcacagaccttttctcacatatgtatctaaaattttgaagcagccttaagcttgcagtgcaaagaacggtttccccctgagccatttgaggataaattgctgataagttccatcactctcaaatacttgatcatgtacttcctacaaacaagaacattctcctccataaccacaagaacagtaatcacaaccaggaagttaacactgagacattcctactctccagtcctaaagtcctgttgctgtttgccagttgatccagcaatggcctttgtagaaaaatatctaatcagaaccttgggtcataactggttgtctcttcaatctcttaatacagaagagttttcagtccttttagactttcatgaccttgacactcttgaggattgcaggccagtcattttgtggaatgttccttgatttggatttgtctgatgtttcctcatgattagattcaggttttgcatcttggcaggaatatcacagaagagccagattatatctttttgaaagattagttttacattttattttctgtttccttagagcgtttcccaaagtgtattctgcggaactagcacctactgtgttctcaacaccgtgccacctatagaaggtaggatttgaaaaagcttttgacttacaggaaggggtgggcttggcagtggcagtaattatcatctagtacagtggaaacagccttcagcccggactcagaagacctgggttctgcacttaactgctgtgtgatcttagatgagttacttaatccttctggggtagcaaaaagaatgctctcctcataaagtttctgtggagatgaaaaaaggcaaaagatttaatcacacggagaaatcaaagcacttaacaaatgtttgatactaatacaacacttctgtaattctagtgtccaataccaggtgacttagagtaggagcagtgtggtattttgggaaaagccacaggtcatgtttgaatcccagctgagccactcagcagctgtggatcttgggcaaattaatctgagcctcatgttcctcctctgtaaaatgggagtaattaagcccttgtgttttatcgtgaggattaaatgaaagagtgcaatgtaagatcctttctgggtgcctgatacacagtagagtcccacaagtgcttactccctaataaataatggaaaatagatttacttaatcacatgtacctccagttggaattgaatgaagtagaggaggagagaatgtcccaaaacccaaattgaagtgatggcttacagggctgctgtgccctcactttatctgttccctcatacatatttttagattgaaaatgtaaatgtagataaacagtgagaagtttattgaacctgagttatgatttgacctaagcctggacccgagattttgtaatatgatcaacaggaaaaaggtaaatctgggctacctaaaaatagaagcggtaagttgatcatcacacaactctaagaacaagaaggggattgttaaatagcaaaactaattatatttttctacttaaaaagctgttagtttctgtttctttaaccttttaaaaatcttttgtagaattactactgggtttaattcactttggagactttggaaaagaataatgcaaaatcagatcagtgtttggcacatagtgcttaattaatatgtattttggatatatggtgatttgaaggccttaggttagtaatggctgtatttgctgctgtgagcattatgctgacttgaatataacaatatatgtttatgttttcagttcctatcctactaattaaatctaagcacataataattagagctaaacagaaaattgtagagcttccttttgattttactactccatgttgttgatcaaagatattcccaataagatttagcaatttgatacactgttataccaaactgtttgaacagtttggtctagagtttgaaagattaatcgtaatcaacttgaatgaataacagtgttcatcattattcatagaaccaacattattttttattatgaatcaaagtaaaatgaatgtatcatttctagattagttaatatagttataatttaccttggcagaagtcacagaattttcgaaggaaaaggtcaaatacatttctttggatttaagtaaaggatttggcaatgtgaatctcatttttttgaaacaaaacatgaaaacagtaattctgctttttgtctaagtgaatgagcatttttttgcatattggaaagttatattatactacaccttgtaggttgactagaaaggatggttcgttctttagaattagagttgtcagtcaagcaaatcatctgtcattttcaagagcctcactagttatttttttattgtgaagtaggttagaaaattattttgtaaagtctaataccatacacatatattttgttagataatgataatgaagtgttttactgtcatttggttgacactcccacttttcagtgtcaaagttcaactatttgtattgaatactgaataatgcagtggaaaccagtatatgccttaattttactgttcactcaagatactattattaggatttgaaaactggtgcatgtgtttagttattttatcattcttagttatcccaaaacattaaaaagcagattttaatttaaaaacagatttttatgcagtatagccatgtaaagttcttttccagtgtaaaatcaaagtttctctgtatcccacttcacctgtagaaacactgaaatttaaaaatatgagttttaacattttgcctatttgaaattccagtaattcttttctcagtattaaactcgcaatccttataatgtagtaggaaaatttacccattgttatgtttcttaaaaacatccagtttatattcagcgtgaacctaaaattctggaaatggtacactttaaaaactgatcaaggggaacccactggccagtcatattcctgttccttttgactctgtggccacacctccgtgtaaagtgtaatgtttagaaactagattgagagagtgcttacacagccctgccctttggtcacatttaccactgcctgatttggtatcagagtggaagactgaagccttttctatagcagttaattgtgctgttgagaagagtacctttattacataaataccacacacacacacacacacacacacacacacaaacacacacacacgcacactctttatataccgcacagtagctgggttcctcgaagaggctaaaagaacagaaaattaacatcagattgtgatcacaaacatagaagctggggtttaaaactctgctcgtaagtgttcagaattgtacttcaaactgatagctttctcagagatatggctattcatatacaattcagagcaagcccatccattgagcaaccagtatagtgccgttttcataaaaggtacctgtaaatgttgaatatttgaattgagtatagattttagaatttcacctctattttcagaattgtacatatcatgggggattttaaaaaatggaaataaaagtactttaggggaagagagaagggaggtaaaggctcacgtgatctggtattctctgctttaaagttttatggcccgtggaacctccctcgggaggatgaagtgcagggagcataagcacataagattaccgaggttttatagtgtgtaattcatacagaactttctatgaactttcttttagttgaacagtttccttttggtttcacaggaagattttttgaaaggtttaatcttattttcctattaaattaaaatttgaaattcttgaaagcagtcagtttttaggtttttaaagtttttatactgcttatagaaatagaggatgggtattataattcaattggttatgtagttcatggaccaaaaaagatttagtatgccaaaactctcttaagttcatctccataaaatctttctatatgatgtagtaaattttttagactttatttctatgcccaatattttccttttaagatcttttccttgagaagaagtgtgttaatcagatgaaaaatgtttggagaggattttgtgaccttagaaaatattttttgttctttgatgtttttcatctgttcaaaaaaatagactgtactgaacaaagccgtagtaaataactggaaaaagatattgttgtatttcacttttaagattattaaccaatgcctgtatacttatgtaaggttgcttaattgtaaggcctattaagttatttaatgacagtaaattttatagggatttgtgtctggagaagaattagagataatctaatcttgttgatttgggaaaactgaaactattaagtaacttacccaaggtcacacaattagaaagtagcagaactgggccagatcttggactcttgactctgagttcagtgttataaaaccttattatatcatgaaaagttgtttcaactgtgacttactggagcaaattaagtctttgatgttttaatgtgcagctccttagtacctagttatgtgtaccctttgtatattggggatcttatgtagcataaaaagcctgggatgaataatttgtaactttgacctaaatgtgccaaagcttgtgagaaattttgagtcaggcaaagaaactttgttataggagtgaaaaaataaatgatatgtaagcaaacaaatgagtgaaataaatgttatataaaggaaatgatctcttctagaaatcatcaggtagactgattattaggtagtcagacataccatctagtctgaaagtaattattttttctctaactcatttagaagagttacattttgatgaaatacattaattatgtagatatgtatatgtaaatcaagttaattaaaatgatgattttatgttcagacctagaaaggccagcttctgtattacctgagtagctaactgcaggcttaaatcccttatatttataagatttgtgatttgcttttgaaaggataaatctcttttatagtctaggggatgaagtagtatttacgaacaaaatagtcatatattactataattcttcttacctaagaaacttaacattttttcaactgcttaataaaagatttttgggctttgtgaggttaattttataatttttatgtgcttcatcaaaacatggggaaagaaccttttaaaataactttcggttatgggcagctgcggggattttccctgttcactcacatgtcagggagcacaagcccgatcctgttttaaatcctcttgaccagattcctgctgccatcaatctgataaatgggtaaatgagtattattaactaagaggaatagtggggcctctgatgctcttggtctcacattgactaaactgagctgctatttctgactttgtcagtgtactttaaaggagattttatctattattttctctaaatttattgttttcttctttgtagatgatcatgggaacagcaatagtagtcatgtaaaaatctttttaccgaaaaagctgcttgaatgtctgccgaaatgttcaagtttaccaaaagagaggcaccgctggaacactaatgaggtagataagtttctttttttaagggtataattattttaagggcaaattttttaggttgcttcacatagtcctactttatgttagctttaaatttaaaatactgatctaggaaattgtaaatgacattatttaatctggatttgacagaaaccaaccaacatgttttttgatctgtctctgatctgcttggcttgcattgaaagatacacaatgtgcacgttgacttaactaaagtagcatgagtttctgtctgtgttttcttgcattttagtgtcttgcatttagtggttaaccctgcctgcatgccagttaaacgttagttgttatgtcttcatgaattaataaatatacagtcccactgttccacagaatgtgtagtgtcttgacaatgtgaatttttgtagagttggaaagggcaggtttcataggagtgaaacagcttttcgtcctttctaatgaagaaagtttgcttaatgctaagaatttttattaagattgaaggctgtacagtagattatgtatttagcatccaattagaaagtagatttatgaagtagaatgaaaaaagttaatcatcttggatgatgtttccttttttggtaaattttaatccaggagtcttactgttaggagtggattgctttgtcatcttttttattttgaaatctgaatatttcaatttaaggtaatacccgtttagtgtggtgatgagaattgggtatacgtccatcaatttgggagttatattcctttaattcagatggctggggttgctggttttgccaagttccatttgtgtgccttggctcaacattgatgtccaagttaaagcaaatttagcaccctatccttattggacactcagttctgttaaaagacacaagaagaaaatagtgctgcctattgagccttattttttaaagattctttggcgctaactacttcctgattcagaatgcttttgttttgcgtggtgggaggttatgtggataaaagtctctttccttatcacaggttagatttaaatactcactggaaccttacagctttgttaacttgtctcaactgattgtaaaattctttgaaggactctatgttttgatcattttcataaattacattttcccgtcagacagaatgtttttgctttgacaaatgtttgctagtttagaggcctgctgtttaaccagttatttattaactatttcagacatttttagacgtgaaaatgaagtagatatgcttaaaattagtcttaatcatagtttgttactctttcagcaaaatagtattatataatttggaagccatttaataagtcggaacttgattatgaattatttaaaaactcagtgtatttcttagtattccctgaaacgtagatttgataccaaattattatacacgttagttctagtttatttataaatgtaacccaacccataataagtatgtatttttccatattatatttcctgtggaattggcagcttatttattttattttttcccatggacccatgtcttgtggcagtttattttaactatgatttgacattatatttgaaaccagaaattgcttagtgaattaaaatcagtggcctgaagagtcttataaagctggatgtagcagtgctgggaatttagttggtagattatttccatcagtggcttcaaaactttttgaaacttttcagcataacccttcaactttcacatgtttaataaaacctctaaattatttacatgttgcaccttactagtatattagatacgttttaaagcatccgataaagaatttttatagaggatgagattaaaagaaaaaaatgagaagtttttccttattttctttctggacctcagtccacatactcccttggaggccagaggctgccataattcagattacagagaggaaaatgcatcccattctctcactggtgtaatgcaaatttgaggatctagatgggaaaacgtggattgttttgcatcagctatcactcatgctgaaatctaggtagaggagcgtatgttctgaagggtggaggcagcaggaggtggcacagctgatgggtgaagccatgcagcaccctttcccttgggatgggctgttctttcagttaattgtcagctcagctgacaaaagctcctatgagggaactgaatttacaggttgactcatttctctgtagaggaccttgacttttttcttgttttattttttggctttggaaaaatagaggaatattaagtgtgacagcgaagacttaccctacgaattgttaattctgcagaatgttatgtggcgatgataacctgctatttttttttttttaaactggctttggtaatataggtggaataaagcaatcagcggtgttactaaagcacttctttgatctagctgggaattggcattttcttacgttcttcagcctgccattcttcatgttgacatgaaaacctgaaggaaacgtagttcagtggacttgtttctcattggggctttgtggtcctatgtcatgctaaatcatatttagtcaaaattgcccgtgaaatcccttgacttgctcataaagtaaagtttagtcagactgcccttattaagagcccgttttccttccagagttggaatagatttctgtgttttggatgaggaccacatgaagtagttggcttgtatttagaagctgtgttgtacaaaaactctatttcttagatcccactgaaggggctcacactggaagaggcgtgtgggaatgcgcacagttgagagcacagtagatttgtgttttccatctcactccctgtacagcatatgttcacaaagtaagactggtggctcgagctgcctgtatgaaatgtcaactgtcatctttctctgttctccatgttcgtgtgtgctcgctcgctctctctgctggatgtgtacagttgaatttctgggtataatgtgactcctctatactaataaggaattcctttactcagacctgtgtttaaatatttgtgattgtttgaaaaaaccttttatactgtgtgtgttgtgagtgagattgtgctcattccatccttttttttttttttttttttttttgaggtggagtctcactctttcaccaggctggagtgcagtggcatgatcttggctcactgcaacctccgcctcccgggttcaagcggttctcctgcctcagtttcccaagtagctgggactacaggtgcgtgccaccatgcccagctaatttttgtatttttagtagagacagggttttaccatgttggccaggatggtctccatctcttgaccttgtgatccgcccacctcagcctcccaaagtgctgggattacaggcgtgaaccactgcacccggccccatcctaccatttattgagcacctgttctttactactgactgggtattttatataattatttgtaagccttaaaatagtattgcaaggtgggtaacatttccttttagagatgagggagtgtaggtagacagtagttattttttggtcaagagagcatacttgatagagcctgtctctgagcttaattgcatctgtgttgcttgttaattcttaggaactttcattctattgtttactctataggagtttaatcaaaggcctacaaacctaaactacagcaagtctattctgtaacgtagtttttttttttttttttttttttggagacagagtctcactctgttgcccaggctggaatgcagtggtgtcatctcagctccctgcaacctccacccctcaggttcaagtgattcttgtgctttagcctcctgggtggctgggattacaggcatgtgccaccacacctggataatttttgtattttataattttgtagagatggggtttcgccctgttggccaggctggtctcgaactcctgacctcaggtgatctacccgcttcagcctcccaaggtgctgggattacaggtgtgagccaccgttcctggcctgtaatgtagttttgaattaaaaagagttaatatagtcttaatattgtggattcatatgcaaatgtttggtgaagctgaaagtcactaaaaggaagactctaagaaggtaagagagatcgttggacctacttaagctacttttaaccttttctaacccattggaatacctaaaatcctttcccttcttggatgttatttgcaattgcagaataaattaaatgttacatctgaaaccaaatcaattttagattgtgctcccgcagccaccaatactggtcctcaggtggtaaagatgacacaaggagtgaaggtgatgatggctgcactaattatggaagccagtatgtattgaacatcctttgtatgctaggcactagtgagtcctttacatgaatcatcacatttaatctttcagttaatcctatgagatagattatttgactatccttatcttatagatgaggaaactgaagccatggatatgttaactaatgtacccgcagtcagagccgggaagtgggggacgggggagttcagccgctgcagcccgactttgagtcccataatccctcattttgtcccacagagcaatatcaagttgacttttccaagatcttgtagctatttagttctaatcctttcgttttatagaattgtttggcttcttcatctgattttaaaatgttgtaacaaagttaatctaattttgcattatgattttttaaaaagtggcagacactcatttcttaggaaagtagttttgattcctttttttaaaaaaagttttctcctacgtgtattttgatagttttgattctttttttatttatttattttttatttttttttttgagacggagtctcgctctgtcgcccaggctggagtgcagtggcgcgatctccgctcactgcaagctccgcctcccgggttcacgccattctcctgccgtagcctcccgcgtagctaggactacaggcgcccaccaccatgccgggctagttttttatatttttagtagagacggagtttcaccgtgttagccaggatggtcttgatctcctgatctcctgacctcgtgatccgcccgccttggtgtcccaaggtgctaggattacaggggtgagccaccgcacctggccttgtttttttttttttttgagatggagtctcactctgttacccaggctggagtgcaatgacgtgatctcagctcactgcaacctccacctcccgggttcaagcgattctcctgcctcagcctcctgtgtagctgtgattacaggcatgcgccaccatgcctggctaattttgtattcttagtagagacagggtttcaccatgttggttaggctggtctccaactcccgacctcaggtgatccgcctgcctcagcctcccaaagtgcttggattacaggcgtgagccacggcgcccagcttaaaacaatttattgaggtttaatttatgtattacaatataaactgcacccatttgaagtgcataattcaatgagtttttgacaagtgtatgctggtgaaactacctccaaaatcaagacacggcacatttctatcaccccataagtagcttgagagagtatttttttgtttgtttgttttgttttgtttttttgagatggagtctcactctgtcgcccaggctggagtgcagtggcgtgatctcggctcactgcaagctccacctcccaagttcacgctgttctcctgccttagcctcctgagtagctgggactacaggcacccgtcaccacgcccagccaattttttgtatttttagtagagatgggctttcaccgtgttggccaggatggtctcgatctcctgacctcatgatccgcccgcctcagcctcccaaagtgctgggattacggacgtgagccatcgcgcccggcccgatagttttgattcttaatgactattagtatgtggactatggatagtgaaaaaactatattaaaaatagaaattttgtacctgtgtgtaacttgagcattaagcctgacttttatattcagggcaagggagaaagaatgtattaaacacagagcacattcattaaagaacctactcttgtttcataatcagtttggtgttcacatcttcatcaggtgaactgctataaggtttctgcattttaagttagtatttttaaggcctagagccagaaataattatgctaacacaactgtctgaattcacaaatgactatttcataattacgtatattagtactccatatatgttgtccagactgaaaattgttttgtttagtcattaattagctgtttgacttaaaatataactactgcattccctagtctctggatctagatttcacttggcattcttccaaagccaaactaatgcagcaccatgaaccttttataatgaaaatgttctccctaaatatgttcaaatcacttttgtgtgttactatttttgaactaatgttctttttttgtttttcctgtaatacacagtttctctagagtaagcaaacaaaatagaattctagtttgtactgatccttaaagaaagtttcatcagatgtttttagttggtggtagctttagagtgtcatattaaatgcattttttaatggtaaaaatgtctatgtagagagcagtataggttgatacattctaagccacaccaaagcgtctgcaggagaaaaaacaaaacaaaacttgagtaataattataatgctttttataggaggaaacttactctttaaaaatcttgagtactttttccccctaactttttatatttaggtaagaaaaatggcctttaacactgtaagaattattaaataataattaatttcaactgtttttaacatcaagccaccttatttttttttattttttttttttgagacagagtctcattctgtcacccagactggagtgcagtggcacaatcttggctcactgcaacctccacctcctgggctgaagcaatcctcccatgtcagcttctgaagtagctgggattataggtgctcgccaccacggacctggctaattttttgtagagacagggtttcaccatgttgccaaggcccatccaaacaactgagctcaagcaatctgcttgccttggcccctcaaagtgctgggattacaggtgtgagccactgtgcctggttaccttaccttttaaaaaatttatttagtctttttttggtgtcgatacataatcttgagtgtttcttgtgtttttaattttttttcctttgtgtaactttgtgttaggtttagggctgtaatttttcagtgattggtttttctagtgtatttatatgttatctctttgaaatatagacacacattttggggggatcatttaagactcttcagacttcctaaatgtgagctaagctgaaaagcaccagtactctaatcataaaggcaggtgagatatttcagttttgatggcgtggaaagtcagttaacctttaggtagggcttggttttgtttagcttttggcagggctagtggtttgaacggtcccagattattttgttccaggcagggcttttctgattaaattgcaaaaatgaaaatgcatataaacaacacagagagccaagttttaagagtgacattatgtgatttttgaacacagtatatagtacgaagtttcaaattaaaagtgatacttgtgtagcagttaggttaaatatagttcctctgtttgctttgctagtgtgaagtgagatacatgatactgaaatacaggtaggcacaagcctggagatcaggcagcctgtgtcaagtgtgcagtgcctcagcagcagcagcagcagcagcactccacaggatatattgaaaagctggggcggaatgtcctcccacacaggtgaggggagacaggtgaaggcaggtttgacactgaggaatagtaagagaagtaaattgcaccctcagagtacagcaatatttatagcatttgaataagatgttaaagaacattttcttttaaggaagaaattcctgtgggtcttcctcagtttcaatctaaactagttttattatactattacttcagcatgtggcacttaacctggccatagtcagtgttcaataaatatttgttggatgaattaacgtaaaaacacaaaaaactcagtataaaattaattcttggagttcttttgcaaatataaaactcagatatatgcattacataaaaagaaaatacaaaactaataaagttttatattaacagggttagttaaatgcaatagatgatgttttgccaaaactaaattgtctcgcaacatgagtatcatactgactgttctcaagcaggttcttttgaatttggcatgcggtactatcttgtgtcctgcaattattttatactgagaagctgttttttacatatcaagcatttgtataagtctgtcattaagccttggcacaaatacatcatttagttttaaattcacttctggtttttctcattagcccaagaaaaatttaaatgacactactgggtactaggggaaacgtaaccacaaatcacaaacttgagcaatgagtttgtgtgttagaacatactcggttcaggtgttactttttcagattatacattaaattaagatgcaaagttaaaaattttatatggacttacagccccttgataatacttccacagagccgcagttgagaaacactgctctcttggaaagggtgcagagctggtgtcagaagcagattcgagtcttggctctgccgctactcagctgagtgttgggtaaggcacttaacctacttggcctctcttgggtcttaggtgatggcgcttggtgacctttgaagatttgtctttgaagattattgttgcttttgaaggttttctttaggaatgttggactttccagggaggcttgggtccagcttcggagtttatttgattaattttttttttttttttactgttaatcatctttttacttacttttaagttgtacaattcagtagttgtttatttttatttataaatttaaaaatttattttttaatttttattttattttttgtttttttttttaaaaccagaacatttactgcatgactaattgttgaaattcttaagctgatcaaagtgctccaacagctgccctctttggtttaggtgttgtttcctcacggagtccatgcctgaatctgtggtgtacaatttttaggtgcctcgttcggccagtcctggtggcattttgtcttttagccttggcactccagttatacgtcctcctgcacttggcggggtagccacatttgccacaggtcaacttctgaaggtggtaggccttcacgccacagcggtggcacaatgtgtgtgtcctattgcaacactttccaaacggtcatctcacttctgtggctgagaccagagagacctttttaatttttttttttgagacagagtcgtgctctgttgtcctggctggagtgtagtggcgcaatcataacttaccgcagcctcgaccttccgggctcaagctatcctcccacctcagccttctgagtagctgggtctataggcgtgtgccacgcccagctaatttatacattgtttttggagatggaatctcgctcgccatgttgcccaggctggtcttgaactcctgggctcaagcagtcttcctgcctcagcctcccaaagtgctgggattatgggtgggagctcccgcccacactcggccaattcagtagtttttaatacatctacaaagttgtgtagccatcgccactacctaagttcagaacatttttcatcaccccgcagccttctggactgagtggagtcagcatgctcaggggttggcagcatctgttcagggggctcgaggttcttctttggtgtcttttcaagtttctatacctgtccagtactgaagctggaattggagattgaccttttgtccaagtcataacttaatatgctatttcctgaaactgcttttaagaaatgttaaggtgcaaatgaggatccagtttgggcccacatttttctaagttggatgaagagcagttgagtggagtttctagttgcactcgagactctgtactgtgcagacagtttattggtggagttgcctcaggataaaaatacccagctcttctcagtagtgggtgggagactttgggtgatggtgatttccgtaaaggagaagctgagcctggttggaaggaaaaaggaagaatatacggagaggctggcattctttagctgagtggatttaggcttgagctggagtcagaatcacctgggaggcttgttcaaacacagattgctgggccccatccccagagtttctgttccagtaggtcctgggtggggcctgaggatgtgcatttctaacaagtgcccaggtgaaagctcacttagaggaagaatctcagcctcctggaagtgtgttctaattaacttcactggactgtaggctcagctttgccatccccataccactcatgcatgttttggtgtgctttggctacataggttacagttgagctttctagagcttttttctcatgtctttagctagtaggcacctaaaagttgtagaatgcataggttttatttttggcatttatctgaagtatctgttcatgtcttgacatataggaagctcttttaaagtttgggtggcagtggagagggcatatagaagcatattctaatttttcaatgttttttgaaagggtagcatgaacaatagtctccccactccttcttcatatccgtttggctcaagtagctgaaaacagcagaaccttaaagctgagtgtcacagtctgcctgcctacctgcctgtctacctgtctacctgcctatccagctacctgcctacccaccttcaagtcttttcgaatactgcctaccccaggtttctgatgataaattctgttatcttggtaattatgaagttattttgaaggttttaaaagaagctcctaaaaaataacctaagttttacagtattagtgcttttagaaagctggaaaagcaagtgaagaaacaacaaaaagaaatcctttctagatggatgagaaaccacagatgggttggggtgaatgcgatgaaatagaaatgtgtgtttgggagagtgttttctctgtaaggaagaatattctctgtaaggaaggcaggctatgtggctttcatgaggtcttcttagaagcttctgtggtaatgttcactggtctggcgaagggggtagacttgaaaaaattgtaaaatggcgagaacctggaatttacatttggggagaaaagaaactgggaggcccttcagctctggggaattggacaaggtgaagcagagtccacatgtgtgtgtatgtgtgtgtatgtgtgtgtgcatgtgcgcgtatgtgcatgcatgtgcactcatccaggtggggcgtctgcggtagcaccgaggtggattctgaggcaagcttcatttggccctgagttcattttattgtgactccaaaggagttcatgggggaaataaaggctctcatgtgcaagaaacaaggaagcagaaaagtcatttgacctaggctagaaaaggcggccacctctagtctatagtcagaagagaagcagctgttcagaggggctgagacaggtaatgctggtcccaggccaagcctcttgaggaaagagaacaacattccgaaattctgtgagtagctcataccctgaaggagttcttttttttttttttttgagatggagtctctgttgcataggctggagtgcagtggcgcaatctcggctcactgcaatctccgctcactgcaatctccgccacccgggttcatgccattctcctgcctcagcctcccaagcagctgggactacaggcacgcgccaccatacccggctaatttttttgtatttttttagtagagatggggtttcactgtgttagccaggatgggctcgatctcctgacctcgtgatccacccgcctcggcctcccaaagtgctgggattacaggcgtgagccaccgtgcctggcaggagttcccttttaagatcgctgtaggaagagtcagaaggtcaaggacaaggcgccgaggtgcctaccctcttagtactttgtgttggggagtggaggctgtccagagaggctggccaaggggaggctccccctgggaagatggggatcttttttaggtggtgctgcaaagggacactttttcagagagacaaggggaaaacactcgcatatatttacttctttagaagttgagaaagttaaaagaatgggaagatgccatctgcttcccatttctgagaaagggtacattaaaatagcttgaaattaagcagaatgtataaaattaacgtctgagtatagtcatttcccgtttttcctgacacatctttcagctgtgtagcaacagatccgcattcctggtgtcagaagacagttgttaatgtgctagttaaaattttattttatttttgtactgttgagcaaaatttagacttaactctgttttatttaagaagcatttttgttaaatgctttaattattattaatcaaatttttttgtatttaagcagttttcaacaatctattcctcaagcaattcagagaacctgctgtgtggtgattatgtattttttatttcataaatgggggtagtgaggcataagtgttttggaattagcatttgtcatcatctaatatactgtgtaaattacatcttttcactgtgtattgtctggctgccactgctagactcttaagttccaggtggacagggatcttatgccaggtggacatggcatacatgtatgtatggcaggcactgttctaagtatatacaatagtccctggagtgtccagggactgttcattgaatgaatgagtaaagacttctgtcaacaaatatcatttagtctagtgctcaagtgggctgtaatactctgtttctgaattaaacagtctggcttggtgatagtcactgacagcaccaagcagatccatgggagctaccccagaaaagcttgtgatgcagaggagaggagcaaaatgtgcgctccctgtgtgcaaatggattcccacaaccacggaaggaagaactgcggcagacatgcttggttcttaatctcagactcatcagtcagggaattcactcctgtctaaggggcgagtgagggtgaggcaggaagccagcatgtcccctgtgaaggagctctttccaggtagaagcatgaagcccaggaaaggcaatttatacagcacatcaccaatagagagatggccaaaccactctgaactctaccatctgaagtgaacaatttctaattatgtatcttcagatttttttctttcagatttctttctgatatatgtatctacagatatttctctgtgccggtgtgggcattttttctatatttattaacccagaataggtttactgtacatgtagttctataacctggcttttctcttaatatgttatatatctgttaggcattttttgacagtgatccacagcatcatgtttgtttcttgattgactgagacagattctctctctgtcacccaggctggagtgcaatggtgcgattatagctcactgcagcttcaaattcctggacccaagagatcctcctgcctcagcctcctgaatggttaggactacaggcatgggacaccatgcctggcaacgttttttattttttgtggagacaggatcttgctgtcttgcccaggctggtcttgaattcctggcctcaaatgatcctcttgcctcagcctcccaaagtgctgggattacaggtgtgagccatcgtgctcagccaacattatgtttatcgactgtttattaatgttccatttaattttggctgggtatggtggctcacgcctgtaatctcagcactttgggaggctgaggcgggcagatcacaaggtcgggagatcgataccatcctggctaacatggtgaaaccctgttcctactaaaaatacaataaattagctgggcatggtggcatgtgcctgtaatcccagctactcgggaggctgaggcaggagaatcacttgaacccgggaggcagaggttgcagtgagtcgagatcgtgccactgcactccagcctgggcgacagagcgagactctcttaaaaaaacaaaaaacaaaaaacaaaaaacccccccaaaattccatttaatttaatgccatcatttatgcattcagcaatatttttgagggcctactatgtgccaggcactagttggagttgctgagggtataagatgaggttccaattctcatggagcttatcgtttagagggaaaacaatacaaaagtaaacaagtaggtgaggatttctgagtgtgctaagaacaaagtagagcagggtactgaggtgtgagcacatcagtagatttcgtaggaaaggcctttcttaggaagttatatttgagctgagaactgaatgataaaggaaagccagctacttgagtatctgggggaggaatattctaggcaaaggtaatagcctgtgcaaaggccctgaggcaggaatgtgcttgctttgaggaaatgtgaaaaaaaaagttgttgattggaacagtgtggggatctggcagatgagctgggtgaggtaggtaagggctagatcttgttgtgccaagtaggcataaagagttgagattttgggtcgggcacagtggctcacgcctgtaatcccagtactctgggaggccgaggtgggcagatcacctgaggtcaggagttcaagaccagcgtgaccaacatgatgaaaccccatctctactaaaaatacaaaattagccgggcgtggtggcacatgcctgtaatcccagctactcggaggctgaggcaggagaattgcttgaacctgggaggcagaggttgcagtgagtcgagatcgtgccattgcactccagcctgggcaacaagagcggaacaccgtctcaaaaaaaaaagagttgagattttgttttaagggcaacatgaagttattggaggatgagctattaggaagtgagcaacataatatgaagctttatgttcaaaggctttcttggctactgtgtggcagtcaggggaagcagagagaccagttaagagtctgttgcgataactggtgatcttggtaagaaatgacggtgggggtggagggagtgagaagtggatgtatttcagaggtggagctgtcaattcatgggattggatgtagggggtaaaggaaaggagaaattttgtggcctcagctactgcgttggtgctggggctcgtcagtgagacaaggaagtggagattaagagtgttcttctgggatgtcctggttgtgagatgtctgttagacaccagagtgatgatgttgaataggcaacttccataagtctggggagaggtcctgtctggagataaaaattggagagccgtcaatgcgcaggtgacatttaaagccatagactaggtgagatcacctgggatgcagaagatagatggagaaagggagactaagccccgagcagtgcaggaggagccagcacaggaggctgcaggggagccagggaggcagtgctgaggcaggcaggtgtgaagtggaagccaggagaaggacatgttttaaggagggtgcgtcacttttatgtttgctactgtaaccagttatcacaaatttagtggcttaaaacaacacagatttcttaactgttctgtaggtcagtcatctgacatgggtctcactgggttgccatcagggtgccagcagggccatgttctttatggaggccctagagaggaatctgtttccttgtttgttccaccttctagagtctgcttaatgttccttggcttgtggctccctccttcatccttgatgccagcgacgtagagtctttgtgaccctgctctcttctcattcactcaccctgacctcttctgcctctttcttccacttttaaggacccttttaattacgccgagtccacctggataatccaggataattttcctattttaaggtcagctgattaacaacctaaattctatcttcagccttaattcccctttgccttgtgatgttatttatttacaggttctggggattagggtgtgtatatctttggggttcctgttcttcctttcacagagggtatcacaaaggttactgggaagttggataaaatgaggacggagaagtcattgttggatttggtcaactgattagtaacctcaatgggtggttccagtggagtgttggtgcggtggcccaatgggagtgagttgaagagccagcgaggtgaggacgtggaggctacacatcttaatggttcttggtggcagttttgctttgaaggaaagtaaatagtggcaagaattacaaaggaaaagcacagaggacagctctgagaggatgaaatgggagacggaatgtggaacagaggttcagggacgactgctggaaggaaggggcattagtgtagtgtctactggaagagattaactggatgaagaacctggagtgaaaccaagaaatggtttatagggatggggacatatgaaagtgaaattcacagggttatttttaatagaacagcagaaggtactgatgactcctgttgcttgcgcctgggtcagtggacaggatccttgtcagcagccactacagggcccgcaagcccacctcagatgctgtcattccacgggtggtggccaaatctttgaagtcagtgtagaacctctgccctttcttcctggggagcctggatcagccatgatcttgcccagactcagcgccatggtggagggacatctcctttcctctcctgccccccaaccacttcccttacacttctgctcttctctcctcacccgctaaattgtaggcctgcctccatttctttctttactttgttacgttttaataacatttattcactccacaacatgctcacagaggtggaagaccaagttagtgcagacccattcattcctggacccagtggctctcaagtgggagaggtgctggtcttaaagggtgtttaggaacaagtgggcgtcatagtgagtgtaaaaacgccctcgccgtgaggctcagaagagccaggcctcctcctgctcctagtccagtcagtgctcctccttcatatgggtggttcgcagccctgctgcatgttagactcaccaggacagatttgtaaacatatcacgacctgggccctaccacaaactaattcaactggagtctcagggatagggcccaaactgaggattttaaaaagctccctaggagattctgaagtgcagccagggctaagaactacagccttaaatctactgttgactgctttcaaaagaagtcttcactgtgcttaaacaaattgtggttaaaagtaagcaaaagggccaggcgtggcggctcatacctgtaaatcccagcactttgggaggccgaggcaggtggatcacctgaggtcaggagttcgagaccagcctggccaacatggtgaaaccacgtctctattaaaaatacaagaaaattagctgggcatggtggtgcatgcctgtaatcccagctactcgggaggccaaggcaggagaattgcttgaacccgggaggtggaggttgcagtgagctgaggtcgtgccattgcactccagcctgggtgacaagagcaagtctccatctcaaaaaaaaaaaagaaggaagcaaaaggaaatctggaggggaacatttgtaataggcaagtggtcattattaaatgtacagttatattattaaaatgtagatcatttgaatcaactgacacgtctgaatttggattaaaactcctaagcagtatacggtactcaaagcttggtactggtagggcacagtttgttcatttctgtttttcacgttgccttctttacacttttttcctttctgaatagcctaatatgacgaagcagctatttgtaacatgtgggaattattttttcttcttttcctcccatagtctgtctccatctttgagctgctgttctttctacagcttaaggttcttagatgtccattccattccctacccagtcttggaacactgtgagatgagcattcctgataagtggtcatccaatttggaaagacagtattttacaaggtgatcagtttctgaggaatttcagttagaaaactttgtgtttttggtttggtcagggaaagatccagaaaagtgatcaagaggttagctcaaacctgatatagggagttctcagaatagagattggctgttaatggtctcttataattttttccttgaggatagttttattagtatgagagtaacttaaccatcctcattgtgcagttcttccgcctcagtctcccaggtagctgggattacaggcacgcaccaccatgccctgctaattttagtatttttagtagaggcagggtttcaccatgttggccaggctggtctcaaagtcctgatctcaggtgatccacctgcctcagcttcccaaagtgctgggattataggcatgagccactgcgcccggccccaaacttttttataattctctatgacattgacatactcccacaacagcttcagtataatttagatgcccttatacatctgcgtggccaaattaaaaaagacaccatcaggtgtcagcaagaaacagagcagggggagctttcatgtactgctgatgggaatctacattagtttaaccactttgggaaactagaattatctatgagagtggaagatttgcacaccataaagcccagcagttctactccttatgtatattcttgacagactgtatagctgtgaaaactaatgaattgatgaatattcaagaagtgagtaactctcacaaacataatgttgagagaaagaaaccagacactcagaatatatattgtttgattctgtatacaggttcaaaacaaaggcaaaattaatttatggtgttgcaagtcaggagatgtagttacctttggagagtagggaggatatattagcagggcttctggggtgttggtaatgttctttcttgatgacaggtgtgatacacatgcacacatacacacaaatatatttacaatttgtgctgtttcctgtttgtatataatattttaataaaaagttcactgaaatggggctgggcacagtggctcgcgccagtaatcccagcactttgggaggctgaggcaggcagatgctggagcccaggagttcaagaccagcctgggcaacatgacaaaaccattgcattacaaaaaaaaaaaaaaaaaaaatgcaaaaattagcccagcatagaggtgcgtgcctgtagtcccagctacttgggagcctgaggtgggagaattgcttgggcctgggaggtggaggttgtggtgagctgagattgtgccactacactccagcttgggtgacagagtgagagagaccctgtgtccaaaaaaaaaaaaaaaaaaaaaaaagtttactgaaatggtatatggtgtagagtagattattgaacagcagtgagaaatgagcaaaatacagctacatgcagcaccatagaagaagattctcacagaatacatacgatcagattctagttttctaaagttcaaagagtcaatgctaagctattgtttaaggacacataagtaactcgtggatatcagtcaggattcagtcagggaagcagaaccactgtattatgtaataagggatttattttttatagcaataagatattttacaactgtggggaaaagctggaaaaatgacagtctggaaggaagaattagaggaccagagaagagccacgaaagcacctctcctgaagcacctgtacgggtggctgagttagaacttgtgggaggctctgagaagccaggcatgagcagctgctagaacgggaccacaaaggaaagctgatgaaaaagtctatgaaaagctattacctctgcatagcaatcacttctctaggtctgctggccagcagctgatggtccaggggcttctgttcgctgacaaggccggcagttgggggaaaaagctagtgacagaagcagcacgtggacaagctggaaccctctggcatctccgtttatatctgctaccacctctaactacctcggccctcaggaagtaatggtggttttacttttcgctttttaaatcttgtccagattcagggaagggaatcctgagaaaattctagcctaaccaaattgagttaaaagctgcaatagtgatggttgcacaactctgtgcatatattaaaaaatatactttaagtgagtggactttatgatttgtgaattatatctcaataaagctgttatttacttaaacaaaactgccacatgttgaaaactttaaagaaacaatgttaccatggatgatttaagtgctgcttcttggagatatggaagtttcagtttagtaattgcttcttagcaggttgtatctatgttactctacactgctattctttggaaagctagagcgtagtaactaagatctgtttgttaatgacagacctcaaggtctcctgacaggtctgggaataagttttgaaaataggttaatgggatattgtattagtccgttctcatgctcctagtaaagacatacctgagactggataatttataaaggaaagaggtttaatggactcacaattccacatggctggggaggcctcacaatcatggcagaaggcaaaggagaagcaaaggcatgtcatacatggcagacgagagaatgtgcaggggaactcccgtttataaaaccatcagatctcttgagactcattcactaccatgagaacaatatgggggaaacagtccccatgattcaattatctccacctggccccgcccttgacacatgggaattattacagttcaaggtgagatttgggtggggacacagccaaaccatataagatacattttctcacttttcaccatgtatatttggttttaaaatttgaactaggatttctttacttatacttaaaagtaggttttacagattcattaaaactttcatatcaaatctgttttgataatctgagatattctcatcatctcaaactattggaaaatgcccttatctactctccatttacgtggagccacttttcatttgaatgtttgttatggctctttttattctctttataaggagacaattgcccaaataaagatatgcagctttcctgcctggggctgtagttgtaccatagtaaggaaatggatatgaaggttttttaaaaagttcaaaaacagagtagcttgtatcatttatatgcaaaaactagaaacatttttagctgtagttacgaagacttctagctttttgtcaactttttaactaaaaggagtcccaaaacacaggttatttctacatggattaaatttataataataaagaatcattagtattactaaaccatattgacagaattcttgctaaaactaggctagacagacaaggatggatactgaaggttgacactgaagacctagttgggaagaggattcagaggagcttggctagagtttggtcaaggagacactcttggtcagtatgtaagtctggctaattggaagtaaataaaaggcagccatagtcttggagggaagacagacataaaaaatgattgcaatatggtataaaaggtataatagaattataaagtatgtgtgtataagatgtatctgcggcaaaaaggagcagtgatggtctgcttgagcacatgaaggatggatttttttttttttttggagacggaatcttgctctatctcccaggctggagtgcagtggcgccatcttggctcactgcaacctctgcctcctgggttcaagctgttcttttgcctcagcctaccgagtagctgggattataggcttgtgccactgcgcctggcttatttttctactttttagtagagatggggttttgctgtgttggtcaggcatgtctcgaactcctggcctcaagtgaaggatggattttttttttaaaaatgacactaaagctgtattttgaagatgattagaaagtttgctaggcagacaaagagaatcagcaagaaaactttctgggctgaaggtactacgtttagtcaaactattaatacttcctttcctgtgcaaaggaacggaagaaggaagtagtttgagttgcttggataattcgctatggctagtttagggtttaaggagagagatggatgagttaaggttagagagtagcagctagatcatagaaggctatgtatgccacgttgcgtttaaattttgtttttttttttttgagacagagtcttaccctgtcacccaagctggagtgcagtggtgtgatttcggctgactgcaacctctgcctcctgggttcaagcaattcttcctgcctcagcctccctagtagctgggattacaggcatgcactgccacccccagctaacttttttttttttttgagatggagtccccctctgtcacccaggctggagtacagtggcgggatctctgctcactgcaacctccgtctcccgggttcaagtgattcttctgtctcagcctcctgagtagctgggattacaggcacgcatgtggcacccagctaatttttttttttttttgtatttttagtagagacggggtttcagcatgttggtcaggctggtcttgaactcctgacctcgtaatctgcctgcctcagcctcccaaagtgctgggattacaggtatgagcctccgcgcctggcctaagatttttatttctagtagaaaaagagtttcaccatagtgaccaggctggtctcaaactcttgaccacaggtgatccacccacctcaccagtgtgccaggattacaggcatgagccaccacaccagcctgggtttacattttaacagatttttttgttgttgttttctttgaaggtctcactctgtctcccagcttgatcatagctcaccatagacttcaactccttggcctcaaacaatcctctcatacctcagcctccagcgtggctgagaccacaggggtgcaccaccatatctggctaatagttttatttttattttgtaaagacagagtctccctacatttccccggccttgaactcctagtctcaagtggtcctcccgtttcgtcctcccaaagtattgggattacaggcataagctactgcatctggccttttagcacagtttaatcagaagaggaaaatgagcagatttttattttatgcagttaccctgtggaccatgtagagaatggtttggaagaacgctgggagtctggtgaggaatccatcccagaggtagtaactaagacctgtttttagacattggcagtagcgaaggatctgacttgggaggtagagttagtagcatttatgtgacctctaagacgtgatcctgtcacactttttctctactctgttaggttcagtacttgagggcctttgaattaaactgacagatgatagattagcaagagaaaaggtagattttaattttgtaaatacttaggggagttcacaaataaatgtgactgaaaagagttgttagaatttggggtttatgcaccatcttaatagatgaagaggagagggagaaagggtacttccgggaaaacaaagaactatttggaaagataaatgggctcataggagaataaatggaagctgtatattttcgtgacattttctgtttggttgtcttctcatctcagatgattagagttgcccctgtgggaaagggttcatgacaattgagttctttgagttcttttgggaggctctgcttttaggcagataaggggtttcaggaactcaaatgccttcagctcaaaataatttttatgctatagtggcttattctggatcctttcacggtgaaggagaggagaaattcctgagattctggtttgagtgatggtggtactgtagataatgaaatacataaagaagagcaggtttcaggacatactgtattttcatttgtatggttgagcttggagcacctggggaacatctagagatcctagaaagcagttggatgtagatttgggacctagagagagctcaaagaagctgagagtacggataaaattttccttggagagtaggagaatgagagaagaaagagcttccagaaatgaactgaaggaggctggaaaatgagagaggatgaaatgagagaggggacatagaaaggaaattgagcctacaaaggagactaagaaggaatagttgaagatgaggggagctgggagagttacagaaaccaaggcaggacatagtagcaaggagactgagcaatagggatcagcagtgccaaggtgcagagtaaaattatagaagtgttaaggaaaaaaaaaattatatatatatatatttagtatatgataaaggtacagttttgaggaggaaatggagggctgtttatttaaatggacatttgggacaattggcttaccacttaaaaaatattaggttaggccggatgtggtggcacatgcctgtaatcccagcactttgggaggctgaggcaggaggatcacttgaagtcaggagttcaagactggcctggccaacatggcaaaaccccgtctctactaaaaatacaaaaattagccagatgtggtgacgcatgcctgtaatcccagctacttggcaggctgaggcacgagaatcacttgaacctgggaggtggaggttgcaatgagccgagatcatgcaactgcaatccaacctgggcgacagagcaagactttgtctcagaaaaaaaaaaaaaaaaaaaagttagtttaggtccccacctcatgccttataccaaaataaatctaaaaattaaatgtagaaattgaaaatagtaaaaatattaggagaaaacgtgggtcaatacttactttgtgttcaagttaggaaggaccatacccattctaattataacagaaagaaaagactaagaaattttcatgtaaatccagcatgtctgtgtgctaaaaatatcataaaattaaagtgtaaatggcaaactaggaaaagtatttgccatagatttgacaggcagaggtttaatatccttcatatctaaatgatctatcaaaaaaatgaataactgaaggtttctggttaagtaggactcattgaagatgtctttatcttccatccttccaaaattttgataaaatgacaggaattacagaaggggtagacccacaaagagtgaaaaagggagagtagggaagatttttctggttgatgatagactaagttgttgggccttatttcctgctgagagcaagtcgagatgatggacaaaatttaaaacaaaatttatgtgaaggaaatggagagttaacaaaatagtgaagatttgtgggtgtaagaggtggggcgtggtgatgaggtagggaagcccaagatgtgagaccagcatttgcagtcatttctttcccagaggaatctgctcattccagaagaattaggcagatgagaagctggacggctgaacagagtttttgttagactcagagggcggaggacaaaaattggagtttggctcagatcagggagcaggaaaacttcttaggctttgagtaggagacccaaaagcctatatcttagagatagtagctcctaacaggtattgaagtccagctccagaccctctcagttcctggctggatcaaggtgttctggaaagaagcaagtataatttctttcattaatagaagaagataacatcactcagaacctcagatgagctctatgtttatttacaatgtttggcactcagaaatcaccaggcagatgaggatttaagacaatgttactgaacgccaagagaaacaacagactatggaagtggatcgacagggatccagatagtgaagttattagaaaagggtaaggtatgtagtatgtttacggagttaaaagattaagaatagggaaattggaaccacaccaccccctccccagtagaaaaaccaaatgtaaactgtagagttaaaggactgtaaatgaaattaagatgtcagttaatgggtttagcagtacattagtaataagtagaaaacaaatgttcagaatgaaatatggaaataaaaatggtctggacatacattatagagtgagtcttagggattctgtggaaaggtctaaccaacatgtaattgaaatcctagtaggaaaggaaggaggagtgctgcagaagcagtatttggagtgatgatagctgagaattgttcataacaggcaaaagccatctcatcacagatttaaaaaatactaccagaaatctaagataaggagaacattttaatagtaaccagaggccaggtgcggtggctcactcctgtgatcccagctctttgggagactgaggcggatggatcacttgaggccagaagtttgagatcagcctagccaatgtggcaaaaccccatctctactaaaaatacaaaaattagctgggcatgatggttcatgcctgtaatcccagccacttgggaggctgaggtgggcagatcagttgaggccgggagttcgagaccagcctggctgacatggtgaaaccctgtctctactaaaaatacaaaaattagccgggcgtggtggtgcacgcctgtaattccagccacttgggaggctgaggcacgagaattgcttgaacccagaaggcagatattgcagtgagccaagatcccaccaaagtactccagcctaggtgagagtgagactctatctccaaaaaaaaaaaaaaaaagtaaccagagaaaaactacgtactacattgaaaagagcagtgagattgacagctaatttctcaatagatgtaatagtgcatccttctcagaaggcaatgaactaatgttttaaaaatgtaaaaaagaaggtaaacagccaaactagaatgttatacccttcaaaagtgaggacaaaattatcacttctttagatcaacaaaaatgagaaggatttaaaagaaaaagccaaaaccccaattctctttcttctacactcacaaaacttctcataccaaatgtgtagggtttttttcataccaaccaattctccagttctctgtggactccgggtattctgcaatttaactcaatttggatactaactgcctggaattacttgcttcacaggttgagagcttggcctcacaagattgcttagaaaccaattgcaagtccaggtctccgatatttcttaccgactgctatgaagtgattcctataaccccctcctcagattcagtgatttgctagaatggctcacaaaacagggaaacatttacctaggtttacctgttgattatacagaatacaattcaggaacagctaaaagagagatgcatagggcagggtatggggaggaactcagaacttgcacaccctctccaggtgagtcaccctcccagctcccctatgtgttcaccatcccggaagctgtctggactctgttgtttgggtttttatggaggctctattacgaaggcatgattgatcaaatcattggccattggccgttggttattgaactcagtctctaacctctctcccttcccaggaggtggtggggtggggagcagagtgacaggggatgaaagtctgaatcctctaatcacatgattggttgctttggtaaccagtcgccattctcccgagagtcctctcatcataaactcaggtatgtctgctcttcttactaccgtgtttcagggctcaatgccaggaacttgaaatgaagaccaaatatatgtttcttattatatcacagtatcacagagttaattacaccagacctgcactaaagggaataatagaaagattggtctttggcagaagagaaatgatcctgcatggcagctttaagatgcgtggaaaagtgaagaccaaagaaaggagaaataagatggtaaatgtaaatgaacactgttgggtaaaataattatttgtggtttaaaatacacatagaatttaaaaatatagtagtagcatataagttgtgggggtgttaaataaaagttaatatcttacggtcttttcattgcccaggaagtggtaaaaatattaatttacttgagactttgataagtcaaggacacatgttgtaatctctaagatagtcattaaaagagtagtaaaatatatgtaattaacaaattaatagaggggaaatatggaatagtaacagcagtagtagtagtaaaacttgattaatctgaaagaaggcaagacgaccaaaaacagaaacagagcatgtgggaaaaataggaagtgaacagtaagttgttagatttaaacttagtctatcagtaattatattaaataaaaatgaaccaaaatttctaattaaaaagcaaagattgggaaattggataaaaaatcaaagcagatcacaactctgtaccgctttcaaggatgtagaaaagttgaaaataaaatggtagaaaagccatattactcaaacattaaaagaaaactggtgtacctttattaacaaagtgggctttagggtagaaataattgcttgggataaagacatacataatggtaaaatactcaattcagttctccaggaagttacaacagttctacctctgtatgtacctaaaaacactatctcaaaatacataaagcaagaattaacaaaaatgacaaagaacagacaaatctgcaattcatagtggaaagttttaatataccgtcttcattaactcagaaacaaagtatcagtaaggacatagaagatttccataacataatgaacaaacttgacctaattgaaatctcagtgggtttatgtgtaatctagacgtactactgtcctgtgcttcataacgatgtttcagtcaacaagggactgactaaatatatgatgctggtctcataagattttattggaactggaaaattcctgtctcgtagggatgtcatagtgtcatagtgtaacacattactgtttctatgtttatatgtgtttagatacagatacctatcgtgtcacagttgcttgcaatattcagtacaataatacgcagattcatagcccaggggcaataggatataccatatggcttaggaatgtggaaggttgtactatctaggtttttgtaagtacatctttgtgtaagtacgtttgtgtaagtacattgtcatctttgcacaatgatgaaatagcctagtgatgcatttctcagaatgtatccctgttgttaagcaacaaaagactgttgaaaataagatacattcaaaatgaaatatggaatataatgaaatatgaaatacaacactgcacccaataactgtagactgtacattcttttcatatgcatagggaacattgatcaaaattgttgatttatagagtaaatctcaacagatttcgaaagactaaattcagaatatcatacttacaaagacaggtttaatatttgaaaaattgatcagtataaatcactaaattaatagagtagagcagaaaaatcatgtgataatgtcagaggtgcaaaaattgcctttggcaaaatccaatacccattcaaaatggaatctcttaatacattatgaatgaaagttaacttccttaatttgataaagattactcagaaaaatcctatagcaaacaccatgtttactggtgaaatgttggaagttttcttttgagacagggaaagagaagttgttttcactgtcaccaattctgtttattattttactggaagtcctacctagttgagtatggcaagaaaaatagtacagggatgagaaagggaagaataaaactgtgattttgtagatgacatgattgtatatgtagaaaattaaaaaaaacctctttataacttattataaataataagctaggttgcaagattcaaggtaattctggacacaattgcaattttatatgccaacaacaaacacaaattccaaatttgtatcaatctggatccaatcaggagagagaaaccagttgtattagtttgtcctcatagggctataaagaaatacccaagactgggtgatttataaagaaaagaggtttaatttgttcatggttccacaggcggttcaggaagcatggtgccggcatctgcttggattctgggggaggcctcaggaaacttacaatcatggcagaaggagaaggggaagcaggcttgtcttacatcgccagagcaggagcaagagagagagagaggaggggaggtgctacacacttttaaacagtcggatctcctgagaactcaatcatgagaacagtaccaaagggacggtgctaagccattcgtgaaggtgcacccccatgatccagtcacctcccaccaggccccacctccagcactggagattacagtgtggacatgagatttgggtgtggacacagattcaaacttcatcaccagtaaattgaaagcagcgtttaatgtggataattactaattataacagggaatcgaagtaaggagggatttggttaggctagtgaaaagtgaagagaattgtaaagaatatgaaaatagcagataaacagagcaactgctgcccctggggctgaggtagagtctgcaaggaagagtctctccttcccccaggaccaagatccagacctcatccagagagggcatggctggtttactgcatggccaagaagttgctggcatgtcatactagtggaacttaatggaaatccaccctctgatacctgccagaagttgctcactagggcgccacacaaaagctcttcatggggaggtgtctcactggaggtaccctgctacaaaacctccagagtgggatgctggggggagctgctggctgctgggtatggcctgctgttgtgtgctgtagtctctggaggctggagcagctgcaggtgcttgtagagatgggtactggagaagccacctgcgttgcaggagctggacgccatacaattaacacaatgtagagcaatctggaaggctgtatatatcaagatggccaagatggaaccagtgtttttttttttttttctctgtgacagatagaattatgatgcttccccctgccgcttttttttttttttggtattcattcagcatttatttaatgaatgttgagtattttctctattccagacaatgtgtttgttacgagatacataacagcagacaaaatagacattgaacttgtttttgcagtttataggctgataggacagtcagtcattcatctgagctcttttgtgccaggcactattctagtcactggggggatagatggatagattaaatagattggttagatagatgggatggatgtatggatagatagatggatcaagataaaatcttgctttcaaagggagacagccattgagcagataattaattataagaatgggtacatacttacacagtgctataaagggtgtaagaaggaaaaatacaggctgctacaagagaggacaatgtaattcagatgagaagccagggcagacttctcttagaaagtgatatttttatgatgaaagtgatgaggaggaggttagcttggtgagatgagtgatcagagaagaatgatctagatggaggggaggcttgcgggcagacttcatgatgggaagagctcggcatgtctgaagtgaggagtgggaggtctctagagggtagggggaggtagagagtggcaggagaagaggccacagcaggggtcatgctactcacagccataggccaccttggaaactagggtgtccctgtgaagggttgcccgtgatagaggtctgaaataggagattcttggactgttttgctatttacagccaccgtgtggggtgctgagtggtcaggggattggaggcaagaatggaagttgagagaccactgggtgcaatttgcaggaatccagtgaaagttaacggtggaggtggcgccaaggcccagcagtggagctggagataactggatggcttggagatggggtttggaaatagagtcattcagaactggtgatggattgagtgtgggctgggagagacagggagacattgagaataactcccaggtttctggcttaagtcattacatggcatgtgatgccattttctgtgtacttttgtagtgaatacgaattacttgttcaattaaaaaagtaaaataagtttggatttgcagatgaagaaggctttggtgaccaaacaaacaaaaccaaagcagttgcagtgaaagtgaagaggtggagatagttgctacagactactgcagttctgcatcttcaaagaagccagaaagtagcaggcaaggtagggtcgggctgtaggacaaggacatgtgttttgtttacagagtaggatagatgtgagcaactttcattgggagagagagctagaccatagagggaagagaaggcattcgttaactcaacaaatatttgaatgtctgtatgacaggcaatactctaagctcttggaacatacaaaacataaaaaacattcctgtcttctggagcttaatgttctaaagtggggacactgaaaatcaaatcatgtgccgagtgcactgtaaaaagaaaaaaaaagcctattaatggggagatctagggatgttgaggtgggacggccagaaggatgtaattttatgttgtgggtggcactgatggatttgatgccactagaatgcaagatatgccagggcagagattttagttttactcactgctgcatctccagtttagaatggtgcctggcacatagtaaatgctcaataaagaattgctgtgcgaatgaattaatgattcaggatcccaggaatgggaaggaatgaggagtgggatactgaagaaagaaagataggccagtcataaatgaagacatattgtagggatgttagtactgatatctccaattcaaattacagttgtttttgcttttaaaggattttaactgttcaattgtattttgaattctttgaattagctttgtttcatggcattcattttgtttactgtatgtttcttagacacagtaatatagtttacagaactacttatccttagggacattacccacttaagaagtgactgttttcagtattattacaataaaattgagattacatatcactttgtatattgaggttctgttacaacctgtcttttcagcattatccttaaagtggtgtgtgtggtggtggtggtggtggtggtggtggtgtgtgtgtgtgtgttggggggggggtgttgtgattgttttatgcccattacagaaaccagtttagccggcattatactggtgtggttatatattaaataagttaaatttcttgcagctactcttttgatcagttaattggtctgatcctatagtgggtattttcatgggtctctgctaagtttagcctcacaatgattttgtgtgtctgaaatcgtattgacaggctgtagctccttctaatttatgcatgcgtgaagaagattgtcctctatttgctgagtcttatgcttttatatgaggaccccagtgtcgtaactttgccataactcaggaagatctaacttctgactgtgcagtatagagcattcctttgtctaaaaaaataatatggatgttttaagaccattcagtcataactggaagctgccttatagttaaaggactttacatattaatgaagaaagggaacatacaaatcattatgtcctttttgccatagattgctgtcccctcccatagaaattatcttattatattttattacaacagtgtatgtaaaatatatacttataaaagtaataaatggtctttgaaaaattctaataacaggagtgtagagattataaactgattttatcctaaaattgtacatcctaggagataaccattgtgagcaatttgatttatatccttttttggactttacaaatgcttgtgtaaatcgcgtgtgtgttgtatgtatatatgtttgagtgtacatacaagaggaatcatatacagcttccctgttttttcctccccatttatacaccatgttgtggacatttttgtgtcagtgcctgtgtgtgggtatgtgtgtgcataaagacatagcacgggtatgccataaaaagttttcagccaatcccttattggttgtcgtcatattttgctcttacaataagtgatgcacttaacatctccagttatgttctaggacagaagtgcttgtcagagtgtaaatatttgacatatgcccttagaaatgttgtaccaggccaggtgcagtggccactcctgtaattccagcagtttgaaaggtctgggcagaaggatcacttgagcccaggagttcaagaccagcctgggcaacatagggagacctggctttacacaaaataaacaaaattagctgggcatggttgtgcgttcctgtggtcccagctgctcgggaagctaaggtgggaggatcacttgagcccaggaagtcgaggctgcagtgagctgtgatcgtgcgagtgcaccccagcctgtgcaacagagtaagtccgtgtctcaaaaaaaagaaaagaaaagaaatgttgtagaataccaatttggactctcattagctaaaagtgagagcatccatttccccaaacccttaccaatggtaagtgttgtcagtcttttaaatcctttctcagcccaacaggtagaagactcagatctccttttaatttacatttctttgtatattcctgcaatttagcatggtttgaccatttatgctatttttttggatatgttactttttataatagtcttcagtctttttttctagtaggttcttcgttctttttctttctgatttctgtttttcttttaaaagaagtatgtataatatttctccctttagtcatctgtatttcagtcttagttttcttaactcattatgtcctcatgccaatcctatgagtcatgctcccaaactctgaatctttttggccttgatggcatgtgtacttggtctttcccacaccagtaattaagtattctccctagattttcttctttgttttgaatttttatccttagatgtttaatatagctgaactttttttatatgtgaatgggatgagttagagctctaatttcatttttctccaaataagatggttattattgagtcattgatcattttctactgatttgagatgttgccattaccatgtgctaagtttccacaaatatgtggttttttacctgaactccttgttcattgatctgtttattctgtgcctacaaaattaccacattgttttttctttccttatacactgatttagtttttgtcattctaacatattgtaaagaggaaagtattgctcctattctgttcttaaaggtctatcagggccgggcgcaatgactcacacccgtaatctcagcactttgggaagtcgaggtgggcggattacttggaggtcaggagttcaagaccagcctggccaacatggtgaaaccccatctctactaaaaatacaaaaaattagcctggcgtggtggtgcatgcctgtaatcccagctacttgggaggctgaggtgggagaactgcttgaacccgggaggcagaagttgtagtgaccccagattgtgtcattgccctccagcctgggtgacagagtgagactccatctcaaaaaaacaaaacaaaaaaaccaaaaaactgtcagaagtggagtgtgacttacttttttttttttttttttgggtcagagtcttgccctgtcacccaggctggagtgcagtggtgtaatctcaactcactgcaacctccacctcccgggttcaagtgattctcgtggctcagcctcccaagtagcaggcacatgccaccacgcccggctaatttttgtgttgttggtagagatggggtttcacctcgttgtccaggctgttcttgaactcctgacctcaagcgatccgcccgccttggcctcccaaagttctgggattacaggcatgagccactgcgcctggccatggagtgtgactttacagtagagattcatttgtctaacatctctgttactggtttcagtaagatcacatcatcttttttgtcctttggcagcagaagttgtaggttaacgaaaactaaagcaacttttcttgtcactgagatggaattgaaatgatctctaacccatacttcttcagccatgacttctcacatcttagaacacattaaaaataagaatatttgtaggacgtactggagaatgaatgagtatccttgaggtcagaaaccactggtcaggggttagcgtggcttagttcccctcacaaggcacgtgtaacccatttacattgaactgcatgtcagtagggaagtgtttaggaagtgctgctgtaggctaatgttcttcaactttaaaattttctcatgacacgtcattgtagcttgatatggattggccaaactgctttaaaaaatttttaattgtggtaaaatatacatatataaaatttgttgtcttaaccatttaaacattcacattgctgtgcaaccatcagcaccatccatctccagaactcttctcatcttgtaaaaccgaaactctgtacccagtcaacagtaactccccattctccctacccctcgcccccggcaaccacccttttactgtctgtctgtatgaatttgactattctaagtacctcataaagtgaagtcatatagtatttgtcttttttttttttttttgagacggagtcttactctgtcacccaggctggagtgcagtggtgcaatcttggctcactgcaacccctgcctcccgggttcaagctattctcctgcctcagcctcctgagtagctgggattacaggcttctgccacaatgcctggctactttttatatttttagtagagacaggatttcaccatgttggccatggttggccaggctggtctcaaactcctgacttcaggtgttccacctgcctcggcctcccaaagtgctaggattgcaggcgtgagccaccacgcccagcctagtatttgtctttttttgtgactggtctatttcatttagccttatatcatcaaggttcgtccatgttggagcatgtgttagcctttcctgccctttaaaggctgaattcgttatgtgcacaccacattttgttgatttgttcatccatccatgggtgcatgggttgtttcagcctttgggtattttgaataatgccatgaacataggtgtaaaatctgagagccagacgtcttgaaagagttttgttttttttctttcattttttaactattccaatttgaatttagcttccattattccgccaaaccttctttcttagatcactattaagtagaaggaacatttttcctttttaatgatttttcagacatactcacccactttggctgtgccatcctcccttggctcttgggatggtgcatgccccctgtttctctcccacttaggagatttcctttgtgaccctcctctcgcatcatttaaaggtggaatttccccagagcttgaccctgggccttctgtctgtgaccattaaatgtgggtatttctcagcaattagagcgaggctcttttcttttcccttgttttggaaagaagagagtcaaaaaagcttaatcaaataatctcatcttttacccaaaaaagataactattttcttcgggaaaaaaggtgacaagaatataaatcatcagaattacactaatttgtttctgaaggaaatgataaactttcccccagctttgttgaggtataattgacaagtaaaaggtgtatatgttcaaagtatacaatgtaatttgatgtgtgtgtacattgtgtaatgattagcacaatcaaccagcacgtccctcactatacggtgttttactgtgtgtgtatggtggaggagaggagtgaggacacttaagatctgcttattaatttgcttagcaaatttcaaataaacaatacagtattattagctgtagtcaccgtgctgtacattacagccccagaaaatattcatcttataaccaaaagtttataccctttgaccaccatctccccattccctccccaacccctgtgagttcaggcccttctctatattccttcttattctaggtgacccccatctgcttacagagatccaatctgctgatggctcctaggtttgtttcatgaggtcagagctctttgctgagccccactccagagctgcctccttgctgtctatgctgagtgtctgatgggtgctccagcctcatgtctgagatagagcttcatgattttcctcccacgtccccttccgtgttctcagtgaagggtacttgagcctcccaggcgatcaagtcaaatttcagggatcagttttaaagtaaactttttaatttaggatagtttcagagttatagaaatgtctgaagaatattaaggagagttcctgtgcactccacacctgtttcccctgctaacattactgtggtacatgtttcacaccagtgaaccagtaccaacacattatttacactgaactctacacttcattcagatttccttaattttcccctaaagtcttgttctttttcagaatcccattcaggatgccacgttacatctagttgtcatatatcttcttaggctccattagactgacagtttgttagatttcttcttgtttttgttgaccttgacagactaagtattttatacagtgttcttcaatttggatttgtctactgtttttctcgtgattagacttggataatgggttttggggaaggaagaccacagcggcaaagtaccattctcatcacatcatatcaagggtacctgctctcaacatgatttactactgatgatattaaccttgatcacctggctgaggtagtgtttgttagatttcttcactgtaaaattactgacatttttgacactttcctcttctttttatctgttttgaatccaaaacaattcctgctggttctttttcccaaataaatttccattctgtccaagtcactctttgcagccactgctgcagtccaagccacaattgcctgtgcgcagacggtattgagcgatcttctgactcatgccctgcttgtgcccttgccttctccagcccagtctccacccagatgccaatgtggtccttttcaaatgccagttggtcagtggtactcttgttcccaagcctttgagcggcttcttgttgtacttgagataccaccccaccttctagacacagtctgccaggcctgcttaagctcgtctcttgtcacctctctcatctcctgccaagcccctctcgccttgtcctctgttccagccaccggtttcttgcccgagtcccttcaacactctcagctcccttagacatgtcgttgcctctgcttagaatgatggtcgccctccaccttggttcccttgggaccccagcttacatgccatttacatgttgtttcttcaggggacatttcccatccacttgcagggtccatggggcactcttgctgggtgtttctggagcatgccacactgtacccctgatgctgggagttacttgttctatgtcggaattgttcctcagtgctggggtggacaaggctgagacgtgcctcggcatgtcactgtgtgtccctgttacctgtactgagcctgtgccagagtggatgcttgataagtatttgttgactgggtgaaattttttaaaaattaaaacatttttaatagaaatggggtctcactatgtggcccaggctggtctgaaacttctgggctcaagcagtcttccctccttggcctcccaaagtgctagaattacaggtgtgagccaccgtgcccagcctgaatgggtggattttatcttttgaatggaaaacactcttcatttttagcatgccagtatgcaaaaaagtacttgaatttatttttcttagtccattgatttaaatcccacatgtattcttttaaatctgtcacataaggtgctgtggtgggtacagtagtggatctagaaagtgtgttcagcctctgccactcctgagggcccattcattcattctctcattcaccagacagttactgggaacctgggtctgccaggcctagtgcagagtgtggggttatgagggcttgtgagtgagcctgttgagggagagggagaaacttatagatccttcagcatttccagttgtggttaggatagatttgggcggatttagtttgaattctggctctaccatttttaagatctgcactcttgagcttaacctctacccgtctgcaaaaatgtgggcagcattgtctcccttgtaagttgtggaaagaatcagctaagaaaaggaatgtaagaggatcagtataatcatagtaatcacagaactaatggtttttgcctttgaggtcctgagtactagcctaagtagttacattaattatttttgtttattctcacagcaactctgtgaggtagggatgttactgttctcatgttgtaaatgaagaaagtgagaccttagttgaaaaattaaatactttgtccaaggcacagaagtagtaagtgggagagctataacctgaacccaggttcaaggacggcgtgattttaaagcccagaaaggactccttacattctgtgtagctaccccatcttccagtgtggctttattctttaaagttgtaaagactttttaggtatcttggcatttaaaaaaatgtaatagtctttagagggacgattaccttaagctattatcaacttgaatttgtttctttattcacattttagcagctttgacatctgtgacttggtgcctgtgttgaggagagagggtatatgttgggactggaggatgaagtttgaagttagacccatctgggcagtatttatcttaaagtgagaattgtgaacttgtaatcagactcacctggaagatttatcaaaaacgtaaattccttaaccacttctttggtaccccacattataatctcttaggggtaggacttagaaaacatttttgcaagtgatgttatttagatagtggattctttttcattctgaagtttgagaatcagtgaatagagggaatgggaaatgtcaactccttgatgatccagactgccctacaggaagccagtggaaagatgaaagtgaaccctggtatgcctggctagtaagtttaaaaacaagtaatgtggaaataaaatcaacagtcggtgaatttgtctccctgttgttttactttttatattatttgtgtttgggaggaatttgatttgtattttatgatcatttttccctagtgggtagtggggtagcacgagaaatgagtgggtctagactatgatagagttggtgcaatgcagcaggccaatcggaagaaaaaaatttaagcatattttgtggattagcatgtcagttgcaaaaataggagtatatctaaagctgatttcagatagtctctttttagcgaaactatgtcagactgtgcccggacttttgctttggaaaatatggtaatttcaggtttgtggctaatttgaaaattagtaatcaatactaagggttttaaatatgtagcatttatgtgtttattatgtatttctatattcataaacattgaggattcttttattgtctcatgtaacaagaagacaagcagctcagggatggcggctcccgtgtgcttctccatgatctctcagcttcctttgtgtggatggccacagcatggctgcgtgcctaaagcacgcggagagggcagcattcttgtctcaggctccccacccaccattcttaagcagctttgttgaggtataattggcatactaagttgtgcattgtcttgtacattttgcaagtgtgcatctgtatacaccgcacaaccattaccatactatgataatgagcatgttatcactctccaaagtttcctggtgccttttgcgattccttctgcccacccttctcctccttttgtgaaagctttgatgtttttagggaaaaaaaaagttacattattgaggataaaatactaggtagaaagatatttaacttgtagttttcgctttttttttctttttgaggagtattgtggaaataatatgattgtaggtataggttgctgtaatatttatagaaagttttgagaaacagattctctgaacagaccatcttggaagagtttgacaggaaatatattttcggaaaggctggaatagaggtggagatggtgcctgctggcaggagagggagagaaagggaggacagcacctgccggccacttgcgggtgagctacagacatgaaagccaaaggctgcgcttttctttggtttttcaatagatggcatttttatcatgctagaaagactaacatgaattctaacatgaaatggtaataaaaatgtaatccccactaactgtagtgtatacatagctcaagtgcatttttttgttgttgaatggcatgctggtgattgatttatttatatttatagattaaaaataataaactttgctctcattgtaatcacctctttttttttcttttttttccctcccccagagactgggtcttgctctgtcacccaggctggaatgcagcgagtggcacagtctcagctcactgctgcctccacctcctgggcttgtgttccttctgcctcagcctcctaagtagctgggactgcaggcatgtaccaccacacccagctaatgttaattttttgtggagatgggatctccctatattgcccggctagtctcaaacttctgggctcaagtgatcctcctgcctttgctttccaaagtggtgggattataggcgtgagccacagaagcgtgcctggcctgggtagttctttttaattgttgaatatacttgctgaggttagtttctgctgcagaaagcattatataatgttgagttaacagcgatcttgtaaagagttagtagaatgtgtaaagttttacctgggaggcggaggcagcagtgagccaagatcttgctactgcactctagcctgggtgacagagcgagactcttttttttttttttttaaaaacaaaacaaaacaaaacaaaacaaaacaaaaaacgactgtatagggttaaaaaacgactgtatagggttttattttaatgggtttcttcagctgtctccttttagcttctatgactctgcattttcttggctctttgtttttcatttctttacagttcttccatgtattttgttttgaaagtaatatgcctgaggtgaaaatggcggcatttctgtcatgatttaaccttactagaaatgacattctttgttctttgtctgtttagttgagaagtgaaccaattccctgtgcttaaagtactactccttggtgtggggcagggagggaggggggaagatttttaacatagaatacaaattgagtttgttggaaaaggtatccctataaaatgttgtccaggtagttagagcttaatatgggtgataatttccctagaagaatattctttgctgtaacactgatgacttgatggacttgtgaaagtgaaacttggtgtgtttcttctttcagcctccatgtaactcacagatagggcagtgtagagtagatttccagttttagattaaggatagcttgtatcctatgcaaggttttgggggttggttagggtctttgagtatttcctgtctaattcacttactagttacaaagagacaagctgtaatgtaaaaagtcttccttgagctagactagctttctgtactctttgatttaaaaatacctggtagttctgccagttggggatttgtttggggtgaatgaaaacccctcaggctcagtctgttcatgcactggtgtgtattaattcagtccattcatagtcatgagctgactgtgccttattgaagaaagggaggcttctggaagagagaggaagatggataatcttggatcctgaagcactgctgctggcgcctgggagtggggcaggaagacaggaggttctgaagagagggctttgtatccaaagttaagacttaggccagcccttgatggggagagaagctactcaggcccaataacctcaaatagttcaggttaaatcgacagttgtcaagtctaattcctctttacagcattatttctgtgggaaaatgtgtgtggcttatatacttgcctcagcaaacagaccggactcagaatcagctctttgttgtcataatttaagtggaattagttactccctagggttgcattgccccttggatggcttctagccttctttttacttattaaattatattccaggttccttgactgtgagggacatagtaaactcctagtagcctttaccttcccctccctaaatagcaaactcatgtagaaaacattagctaaaatcctttgcagatttttttgaaatcacctaaaatgttgttattggcaccatttcatttggagccattttgtcagaaccactaagtatttaggtgaggcgattgatttcattcccacgtgggaatttggttggttgtaatattcaggcactcagagcaattcctgcctggacgtcacgttcaggtagtctggtgtctgaaacttttggcagagattaagctgatagaagatttgggctaacattttttagtgtgtgagttggtgaattttcaagatgatttagaagactttaaaaaagcatctgtgaatactgcatcatcttgatgtcaagaagagattgttatttaatacatacatgttttagtaatgaaggaggtacatagagataattgatttgaaccggtttactttttcccctttttaatgcaaaatatttttgggaaacagaacttgactcgtgttacactactcgcttcttgttttttgttacaaacatgctgaaatggtctaaataatgatgctactaaaacaacgtatgcattgttttcatggggtgttgattccttctgcagtgttcaaaattacttgcatgcctccgagcaacaaacacatatgtgacagactttatgtgagatgagcattccagagaaatgaaatgcaagtttacttttcagtagctatgcaacttaaaaaaaaaacattgtgttttttgaaacatggctttagggcactaacactcggaccgagtgcatgagctctgcaagttattttaacaaaacctaatcacaggaacaaacatctggcatttatagagtttgtttatttattgattgccgtaagcctctagaaagaatattctgtttcttttaataaaatccttttggaagttgtctatattttaatatctaagtgtttttggaatttagttttaacaaggttaactcaaatgttaaatttattgtgggctacagctgaagtaggagaatgtaagaagaaatggcaagtgggaactcttgtaaaaagaatggtaactaagttctttttcctggttatgctcctgccatttactcttctgtatggcaggccatcatttacactgctttgtagaatctgctgtctagtaagcactaaggaatttggatccctaaaccagggagcatatagcctgctaaagcttaatttttagacaggagacactaaagatgattgtgttatgatactgttcattttatatactagtgaaatgaatactgaaattatttagtataaccattaattatagtgcttaccattactgcaaagtttgtcatgatttgggtggtagcttcatgtttcaaaacaaaaccataggtctatccttttaaaaaacataaactgctttagtttgttaatgggaaaagtgagtaaataataacacttattgatgaaatgaagcctgtcagatacaggaaaaacaaaacaaaaaacccttgtagatattcctcgtgtcaagcccctattaattctgtgtaattccagtagaactagcaagttattttgcttaaaatgtcttttttttcccctgtgcagtgaaagttgaatgtgagaccacatcttaatagatatagttacacggtttattttatcatgtatcactttattgctgtcttctagaacattgttatactaaatgttccaataatggaaattttatgcagctacttcaaatgaaacaaatttgcaaaaactcaattttggaactcattccttgaggagaggaaaaactcaccatgctgtgaccacattagatttctgatatgttggcaacttatcaaacactgtcatttccagaaaacaggttatggggtcaaattgaaatatcagcacttttggtcactttcagttgaagatattttaggttttaatgattgaatggttaaattaaaaaaaaattgttggtaacaggtaatgaaagtgtggttttgtatgtaaataaaaatggctctacacgacatcaggaatgatggggttcagttacagtggaatcttttcaagagcttgattttaaattctcagagatactagttttacttactggagctcctttgttttgcagagatcatgatgcagccgtccttttggatttctttttaataatgtgtgacccttcacctttgatcccctgacctgcattaccttggtaaccatttcattttttaatttaatttcattttttaattttggtgtacaagctgtaacatttcatctttcaaagtgtaacacgctgatttcctcaaatagagatacccctttgagtgataaatttgcaaaatgctgtcttcattttctgtattaaaattcatttcagttttaaaataaagtgtaatctgtgttttcatccttttaaaatttaagtttaatgagtgcatttccccatacagtatatttccttttttattcatgttttgcagaagctgaattaacttgatatttacgtataacttacacacacccaggacacccatacctcttctctactcccaaaccacccaaaccattgcccctcaccttatcacacatacaccctcaccatcaccaccaccaccaccaccaccaccaccacataccctttcctctgcagagtaacttatctttctttcagaaatagtagcaacttgaatttattagtcttagctgccacattatacatcttcagattatattttgtattctgaagtattttggggagaaaaagcttagacttttaattttaatttcatttaaggactagaaaaatacaaagttgcctcattacccaaattcacctttccccactcttttaatattttatttctttaattttaggcataagttaagaacaagcaatttaacatgaccaaaaaatgtacttttgtctctgccaaaacctggtcagccagccctggtagtctcaataccagattgatttctgccatatgcaatttcatgactgtttttcaaacaatgcatttttattgtatttctcttttcagaaaattcttaatctaaagcaaaacaaaccaaaaccgaaagacagaaaccaaacttgagtcagttctttgaactggcaagatactccttagaaatcatgtccttaaaaaaaacatgtgaattctctcagcatggcccactgaagcacagattactttttaagtgtctcattattttattctctaacatttaatgctgatgttttaattgcacacagctgaagctgctaaatgagtactgaaatggatttaagtcctctttgagctttgttgatacctataaaagtttatgtcattcattagaaccacaaattaaaattagtcgtggttagctgttcactggcgattggaactctcacgaacagttttgttcaggctcacgagcttgttcttgcctagtatacttggatgcctgaaaagctgcctttggcctgttgggtatgttttcttttcacagaattgcaaaatatcagagctgagaaatacaaataggtaaaccatcctatgattataaagcccctgtgatttataatgtcccagtagtcaggagcaacttttttgctaaacctggaattttaaggtgattttttttttttttaaataatgcttttcacagttgtgctggcatgtttaccagatccccaaagacttttttgccttaagtatgtcctttatttgttcctttgatgccatgtccttctagcactaaaggaatggcatctggctcagtggatggtacatggaagccatgtggggggccatgactgcttgttgcctccattcctcttgctcaagcagccccaaaccggctgacccctgagggatgagctggttgatggtccccaggagagtcacagctccctgctgttggaatcggctcccctggggctcccatctgcctttgaggtagacagtactttatttgtaagtccagtagcagctgaagagaaattaataggttaagacgagaaaagtttttaattctcttattttacgattagatcagttagattttctttaaagttttctgcttaatacattttaagataacctcatttttctaagagagctagtacatggacacatttatggcttatttccaatgagccttgtttatttggttagcatttaggacatttagtagactgtaagccaatggatgtttttgtaaatgtgattcattgagaaaaaccttcatttgagagtcaggtaacctgctttggactagcaaagtctctggatatgttactggtatctgttgaggtagtcacacaaaactgaaatactccaacagaaagacttcagaagactttcattttggtgtaaaaacagtgaaattagctgtttgacttaaaatataggagttgtaagacatttcatcgatgctacttctgttttatcctctgtgaaatgtagatactgtgtgtctcccacttgctttttagggttgttgggaggataaatgaaactgtatgacagacacactgggaactcagaagaaaggtgctgttgaaactgaacctcatcctatggctgtgccgttggcaggcataaccggtgtgctgagaggcagtggtagtgaaccccgtggtgaaaggccaggaccatgggctctggagccaggctgccttggttcgaatcccacctcgacctcttgcaagtggtctgaccacagcaaatcacccaacctctctgtgcctgagtttccccctctttaaattggggatgataatagtacccactaaaggatcctggtgagttttagctgagcacatgtccacaaagtccttagagcagtgcctgccatgtagtgtggctgatcctcacacccagaaaaccccagcagggggactcacaccttacagaaaatcaggttcgaaaccattccccagtagtcttctaacactgacttagagacccttatatgtttagagagaggaaccgaatagtttatggtaattaagctcctctaaaacagatgcaagttcaggtgcataaagttaaatctgggtttttaatctcttaggaagaaaagtttagatcacaaagagctccataaccctttgttgataggttcttttaactgtttttggctatggagggacaaggaaggaaacctgagggacagacccaccttttacctgcttagcctttctcgttcccttttacgcttggtaaggtgtctagggagctttgaaggagtcagaagtgttgaactgtttcaaggttttcacccagctgcgggaggcttcgttgtcctcttgagtgaggtggaagggacatcactgcctttcctgagtgtgtaagaatgcctgttacatattcatcccagggctttccatacattttaatcatccacatttacctacaaggtgggtggtatgttcaccccattttgcacatgagaatgctgatgcccagataggttaaataaattcacccaggctcacaccctcagtaaactgccagacaggcacttaaatccaagtgccattcatatcacagcactgctgccttgcattgagctgcaaacctggctgagccactcctaggaaacggttttgcccttttagttgtagggacctcagctgtacgcattatcatccttcagccatcagacctttttttgtttttgttttttgagatggagtctcgcactgtcacccaggctgagtgcagtggcgcgatctcagctcactgcaacctctgcctcctgggttcaagcgattctcctgcctgagtagctgggattacaggcgcccgcgaccacacctagctaatttttttgtatttttagtagaaacgaggtttcaccatgttggccaggctggtctcgaactttcctgacctcgtgatttgtccactttggcctcccgatgtgctgggattattggtgtgagccactgtgcctggcccagaccttttaatgcaacagcgcccctaacttctgaaggcccctagctggcttcaacaaccgcccctcttcctgccccccatggagggctctgtcatacatgtgtcacttttagggactcttattaccaatggcttccttaatcctggctgcacatccagattcctctgtacagcttttaaaataattcactttttaagaaacacttgccccatcccaagactcttgttctagagagatggataggttcagaaatacaggaagtttattttgtaaacaagaaaacaaataggtccttacattgtgcacatatggatctgtgcttctggagtgtgggccaatgctgttaattctgtagttgactccattgtaaggtaaaatgagttttatgggccagtttagttgttcagccaacaattgttagtactgtttctgtaggaaaagttcctggcatccaccctgtagaataccatcttccatgagtgagcacttgatcaccacagaagccaggtttgaatttagttagagtgaaatgaagtagagggccctgcttgcttgcttgttctttcatttttttttctcttcctctcttttatgggtttatcgttcccttcttttcttctccttcgtagttccctctttccttgttttctctttcttccaccatctggcgtatgtttacaatgtatctgtcatcagactgtgaggtccctgaaatccttcaggtgcctaccacagagttgacgtgcaaatgaatgtttctttattttttaattaattaatttttttttttttgagacggagttttgctcttgtcgcccaggctggagtgcaatggtgtgatcttaactcactgcaaacctccgccttctgggttctaccgattctcctgcctcagcctccaaagtagctgggattacaggcgtgtgccaccgtgcccaactaatttttgtatttttagtacagacaggatttcactatgttggctaggctggtctcgaactcctgacctcaggtgatccacccgcctcggcctcctagagtgctgggattaccgtggtgagctgctgcgcctggccaaatgaacatttcttaatttgtcttagtatctgtctttcaaagaagtaggtactgcccgtcattagcttgaaaattgtcagattttgtttgtgattgtctgtcctaacttaggtggtttatcttgaagatcttaggtaatttagcctcatagatttagatagatcgagaaatggcaggcttcaatcactgaatagtacagaatgttgggcaataagatggatttggaccattcaagggagcacttatgtcaggcttttagcatatctgctgcatagtttttagagctggaaggtctgagatcatctgggttggacccttcatttttggtggtgaggaacccactcctgagagagaaaggtgcttcttcggtgcccgcctccaggccaggacttgcctcctcctcctctgtgtccttagctgagtgagagttgggatggcggagagcagaggcaatgtgaccgcatagctgctgcgattaactgcctgcctctagacatgttggagaaacagtcaaagtaatcatccttctgcgctccccctcccatggaaacaaatgatagaaggttagggcagttttgagggcaagcggcagacttcctcactgtgaaagtcgggaagctttggttgtgccctagaccctgtccttttggccttggcaccaccaagtgggctgctttaggtgtccatcctgatggtgtttaaccctgcttgaggcttttgaggacactaagaaacacatggtgaaggtgtggaaggattttttgtcattcctcaatgaagatctgccctaggtagaaagggagttaatgaaggaaaagtcggcaacgctattgctgcacgatcaggaaataacagaaaacgtctcccatttgttctcatttgtggtgattgtttccctgggaaactggccgtggttaccatcacgctgtgtgatgctcctcagaatcctagaattagacgagattttccactttccgcacacatcttcaggtggggtcgcaaatactccatatgacagactgtcacatacgctggccacagaacttcaattattcaggtttggatatccagccccttttctctcttctgtgtggatccttttgagtactttatacctctaagcctttcgtatttccaaaggagaaaccagaatgacttttgtcactcttttgtaatggtgggaaaaggactggtaggggaaactaccaaggtttgacctgggatctactttacctgctctagttcaccttggagcatctgaccatacataggtccttgcacatagtagatactcagcaaacattaactgtcttttcatttctcattagcacaggtaattaggaacaggagctgatagactgcacgtatctgtgcagagatatatctgtaattaaagttttaattaaagaaacaccagaccaggcagatggttcttatccctgcatcctgtaaaccaaacagccgtggcttttcgatcttgcaaacatgcaaagctgagagtagcaacattcatggtggtacaccaaagggaataggttgtcttataaactaaccataatctaattttggtagcactctatgtgatgccagattcaaggataatcattgcagtttgaaatgaaagacaatacatcaaagttatgtcccaaccaaagcttttaagcctcaagtcaagggcattaccacagcccagctcgtagatcacaagacgtgtggttttgtgctagatcacaaaagctgacaaggtgttatttaggattatcagctaaatacagtattaaattagagggctatcattctgatttttcaggcattgccacggtatagcagtacagaattgagaagtgacttgtacctgcctgcctcatgcagatcctctcagccatgtcacagtgaccttaatggtcaattgagtgcagaatttgaaaacaaaaaacaaaaacacccacaaagagtgacagaagacgacttctctcatatcttagcacttttccaggaaccgctcccccaaggatccccagcgatttgttctagttccgttgccatcagcaggaagctggatcagtaagggacgtgggcagatggtaaagtccatggcagttcaccatgaccgcttgggcttcacccattccataacccccagtttcttacccctcctcaaaacccttcactttgtcacacatgtcattttcaggcattcagtgcagataggcagctgtgcaacgggattacatactagttgatacaagtatgtttttaccacctacatctcactaattcattttctacttggtagaaccagtactgaagatgttcatttcttttatcacagcgaagagttttagtttagaggctaggagagtaatttctactttgctgaacagtgaattaccttaccatccctgcacttcttttaaaggaagtagagtttccgcttgaaaaagagtccatgttataccgggataaatataaggatcttcacattaaagaatatgtcatcaaatgtagagcctggaagtattttatcttaataccatctataaaactcagtcatcctaggagaaatgtgtgtgtgtaagtgtaaggagacataccaaacccacaagaccctgtgatgtgctgtgagcgaagcctgtgtcttggctggtagacagaaatgtgtccattactttctggcttggggaagacttcaggtatttgatgatatgtcctttggtttcagaagtcaattaaatcttagctgctctgagtaaacagccatttgtggttgtgtttagaaaatacagtaagatcagatttgtgctgctaggtattaggttggcattttacatgtggaatttgaaccggactatgaaatctatttcttctctaatttggttcaagacctgaacatgtaacctttgagtatacaacacaggtttagattataaaggcttcttttccttttttctttttttttttttttttgagacaaggttcttgctctgtcacccagatgaagaacccgcccactggagtgcagtggcataatcatggcttgctgcaaccttgaactcctaggcccaagcaggcctcctgcctcaacctcccgagtagctgggactacctttgctgctgcgcctaattttttttttttttttttggctttgtagagacggagtctctgttgcccaggctgatctcgaactcctgggctcaagtgttcctcctgccttggcctcccaaagtgatgggattacaggtataagccaccatgcctggccctgtgggaggtttcttataaagtgaaaccacttgttactcagaacggcattatgcctcgcttcagggtaggaaatagagaagcatcagcaaacccacctggaatggtaggctttttatttctctttctctagtagggtttttttttaaattttatttattttttatatttatctttaatttaatagagacagggttttattctgttgtccagcctggagttcagtggcacgatgatcatcactgtgacctcaaatgcctaggcttgcctctggagtagctgggaccagaggtgcataccaccacgcccagctaacttttttgtttttcttgtatagacagggtttcactatgtgtccaggttggtctcgagctgttggcctcaaatgatcctcctgtctcaacctcccaacgtgtggggttacaggcatgagccaccaggcccagcctctaaaagtgttttttttttttttttttttttttgagacagggtttcactctgttgcctaggctggagtgcaataacatggtcttagctcatggcaacctccacctccagggctcaagcagtcctcccacctcagcctcctgagtaactgggaccacaggggcatgccaccatgcccagctaactttttgtgtttttgtagagacagggtttcactgtattgtccaggctggtctcaaactctggagctcaagtgatccgcccgccttggcctcccagagtgctgggattacaggcctgagccattatgtccggcctctaacagattttaaggaagcttttgttctgtctgatatctgtatgatcatgggaggggagtggagtgttctgcccaccccagagtgacttaaattcaaatatttgtttgttcaataaatacttattgaataccgagtactaggcactgtcctaggtgtatctagaatgaagcaataaacaaaaccatgttattcccctcgaagagcttattttctggttgggggagaggaataataataaacaataaacaaaaacaaaaataaataacagtaattgcgtgcttatatatgccaattacatttattaactcactcttcagaatactgaggaagtagctgctgtcattatccccatttcatagacaaggaaaccgagatacagagaagttgaattaacttgctcagtgtcacatagctagtaagtggtgctgttgcattcctgtccaggtcattggactccagatttcatgcccttaatcactgtggtattttgtttctcttttaaaaaactgcccaatctgtttatttctaaagaaggaaagaaatgtcagtgatagtgtggtgaacagtgcagcaaggtacacagtgagagggttcttgcatgtctgtttgtgcatgctattctagtgtgactgagcgggtatctctcatgaggtgaattgaaggaagcaacactgtgaccacttgaaggaagcaacaccgtgaccacgtaggtgtctagagtgagtattccaagcagagggaactgcaaaagcaaaggcgctgagatagacagagatagatttggcaatggcgagagagaagccaggagaatgacaaggaggcctgtgttgctgtgcagagcgtgggaaggggcacgggaggggaggagccaggaagtagtgtcctgtgcagccccgcagggcttggcacggtcttttggttttgccgaaagagaaggaaagccacctgaggatttttgagcaggaaaaagacatgacagaaaggatcattctgggctgggcatgatggctcacgtctgtaaccccagcacttcgggaggccagtgtgggcggatcttgaggtcaggagttcaagaccagcctggccaacataatgaaaccctgtcactactaaaaatacgaaaaattaactgggcatggtggcggttgcctgtaatctcagctatacgggaggctgaggcaggagaattgcttgaatctgggaggcagaggttgcagtgagtggagatcgcaccactgcactccagcctgggagacagtgtgagactctgtctcaaaaaaataaaagtaaaataaaataaaataatcactctgaatgtagtgcagagaatcttccagggcagggccagcagaccacagcccatggcaggttctggcccactgcctgtttctatatagctagcaagctaagaatgctttgtatgtttttaagtggttgaaaaaaaatcagtattttatttcacatgaaaattatatgaaattcaaatttcagtgtccagttccagttctattgaaacagagccacactcttgtgtgtattatctgaggccgcttttgagctgcaacagccaagctaagtagttgtaacagggagcatatggcctgtagaggctgaaagatctatactgtttggccctttacagaaaagagttgttgatccctggtttgggatagaagtagggagaccagtgaggagactgttgcaagaactgatggtgccttggacagagcaggaagaaatggtcatatatgggttatgtttgaaaggaagagctggtagactgtattaatataggaagagtcagggatgatgactgtgtttttgcactgagtaactggaagaatgctattcttctttactgagatcaggaagactgagaacagcaggttggggaggaggggtgaagagaatgtaggttgtgttttgcacctgttgactgtaagatcaggtggagatgttcaataggcagtcgtatgtttgagtttgtaacttcaaggagaggctgaggctggagctagattttgagtgttttcagcatatagggggttctaaaagccgtaggactggatgaaattttttagggagtgtatacaatagagaagtccagacatggagccctgggacacccaatgttaaggggaagcgggtagaagggaggcaaaggagaatgagaagcaatcagagaaggaagacaggagatgggggtgtcctggaagtgcatgtttctctttgctttgctttgcttttttgagacagaatgtccctctggtctcagctcactgccatttccacttcccgggttcaagtgattctcttgcctcagcctcccaagctgggattacaggtgtgtgccaccatgcctggccaatttttttatttttagtagagatggggttttgctgggttggccaggctggtctcgatcccctgacttcaagtgatccacatgccttggcctcccaaaatgctgggattacaggtgtgagccaccgcgcccggacaaggaagctcatgtttcaaagcagagtgatatctatgtcagatgctgctaaagctggagcaagaaacagacgggtttcactgtgggcttggtagcggggcgatcgttggtgactttgataagagctgtatgagtgaaatggtgagaataaaagcccagttccaggtggttcaagcaaaaacgactggatagggagctgagctggtgctctgaaggaattctgctttcggcagcctaagtgtagggcaggagagggcaggagagggcagggagttggatttaacctgggattaggattttgccaggtgagtacagtggagggaggaggcataagggagttgagcattgcgcagaagaatcgatgtgaggattgaggatagaccatgtggtctaagccaggcaaggagccaggaggcatgaaggagctgagggtcagtaagaggtcatggggtcagtggattcaaggaataggatcgaggagttgttggagttgggatagtcgaagagtagatagagggcttgaaatcggtatcatggaggggtcagttttggttacatcaaggtcaggggctctgctgtacagtagcagtgtcagtgagtcacgtgtaatttttaatgttctagtaaccatatttttaataggtaaaaataaaggaaactaattttaataatatattgtaatatattttattttacccagtaagtctacattacatgaccatgtagtaagtataaaaattgagaagttacttattttggtatgaagtctttgaaattggtatatatcttatatttccattaccttctaatttgaagtagacacatttcaggtgctcagtggctgccttactggacagctcatgggatggtcatggagtgtagtccaggattatcacaggggaagtgtttaaaggaacaaggaggtcgtggttcatgaaggattggccgtgtagatctaaaaccatttctcactccttctgaggggagcaaggctgaagaggaaggaggggacaccatggcagttggtagaggtcatgtgcttcgatggctgaacctagcagccttttaccatgcagagaatttagcttattctctagagacacacacacacacacacacacacacacacacacacacacacacaattttgtttggctttgatccacacaatgtgtttttaaagatgaataaaaattgataatatcaggtattttttagcctcgtaggccaggaaaaagtaaaatattttgaaagagtaaacaggagcgtctcagcagcatacatgttacttttcatcttaatcatgtgagcctctcatgaaagcctccaaggaggaggttaatggatgccccaattctgtacctttatcaggtttaagcttacttcagtttccctttagtttgttgcctgcagtatcataattaaccaaagaattcttctcaaaaattaccctcaaaaatcctacaaaccccactgttaggaagcgagcccattttgaggaagtatttgtgaaccctgtgttcttggatgccttatgtgttgaaggaataattacttgttcattttgtagtgctaaaatcctgggaatgcgcagtctaagcagtctagagcatgtcagtatcccacctttggaaatctcctaggagcatgtagagactctggtttatcattaactgtgttgctttcctatcttttacacaaagtattctccttcccgcaccattgtattcacatgacagaaagctcagttaatgccttttagtaataatgaaagcttactcattacatacattttcttaaactctctttattctaattaaaatgtttccatctgatgaggaagtgtatggataccaagaagtggaaattaagcaagaaattaaaagaacattaatggctttcttgtaatttgttttgaggtttttcttcctgctaaatggtgttttgcttacagagtcacccctcacacagaaatctttatgatgaatggactggaataaatcccagcaaaagaagagctattttatgatacctcttgtaaattacaacacatgttatggaagtatttgcttttttaaaaatattagctttttaaaggcattgttagtataattaatttggcacacacacaattctagtttctttgaaagtgaaggtcagtgtgtgtgtgtaggggattaagaaaatgagagttctgacatttaaaaaattattttctatttatacctgagtcattagaatgctcaaaccatccaaagtataacatttaaacttgcagttcattcattccttcagaaatttgctgctgaaacttaaactttaaccagcatagccagcgtagccttaaccagggcaggtatttggtctgcagtaggcaagcctttgcccccatccctcgtcttcaggctgcagagtccacatgcatgccattgctctggtgggttctttttctggtcatttggacttgtctctactaataaagtattcattaacttgaaactcctacctctgaatgtagatgcaggtgaaagcagagaaataccaaacccaccccttcctgatgaagtgcaacatgccccacccagctgcatctcacctgctgcctcccctcctcctcccctgatgtgtggacactctttctgtccgttcctacttgctgttcccttctctgcacgagtccttcccctggagggcagcccgcatgccactcctcccatgcaccttttcttgggaactgtgttcagtacagcctgtcctttggttcactcttaccctgggcactgcttcccatgtcctgtgcgggcccttgccatagcatattgtgatttatctctgttggtgtctttactccactcaagtgggagctccttgggcaagggtgctggtcctcccttatttttgttttccttgagcccaccatctgcacgtggttatgggtggatggatgggggaagtgacagtggggtaacataccttcaagcccaaaatgtaaacttaataagtgttttggaggaagagaagaataaatactgtttttgtttatacaggtcttaaaattttggtagcagaaagcaaatgtgcaaagagcaatggaaaacaagtcagaagctgctgtctgattccagaggaactcgtattttatgttaaaaaaaatgtaattgacatttgattgccttgaaatcttcaatttgttgtgctgatatcttaagtaactaattatttagttgaataactactagggaaataggccataaatgtcactcgtgctttccttgtaagaagcccacagctcttctcgcagcatgctcttttcagtacctgttctaggtacttgtgacttgtgaaagtcactggcctctgcgcattgggcacaggcctgaaggcgatgttttactcacattttgtccactggaattaaacagctgtgctgatattcagttgatttgaggtttgtttggaaatcagtcccaaatttgggaagcaaatgagacagaaccctccacaccctaccacatgcttccagctcatcccatgaaaactcatgagcacagtgtggagtgttttatctacagccactccctttttgacccttcccccaaaatagtgagggagagaaatgaaagaacagatctggggcttgccttcagcttcactgtgcatttttggtcattttggtcattttagaagtcatctttcacttgttaggatgttacattaattgggagatgctagtcgttttgttcatggaaaccagagtatccctttgaagtattatattcttctaatctatgaaactggcccaggaagtaacaatgggaagtgctggaaatggaatttaagaagtccaccttcttagtcctgtgcttaagcagagagtctctagcagggagcctctgcaagcattgtgttctgttgtatcaatatgtacttagatatgttaatctgaattagggagttgattgtacataatgactcccctgggttgctatgttagaagaaaacccaaaacttaagtagtttgctgaatatgcatagtaagtaaaaaaattcttccaaaattagtgttaattgaatctgagccttgatcttctttgaacctttaattttttatttgatcttttaaaaaagttttgtggcctcttaaagataaaacctacaacccaataaaagtcatgctgtaacgattgcaaaaagaccattgtatgagacccagttttggattatcataggcgaagaagtcagacatatatggttgtatgtacatgtgtatagtatgtgggtgggggtagatacatacctgttcatctgtatacgtatgtgtgtgtttaatatatactttagtttgcctttacccagatgtctcctcctctctctgcctctggaaatggggcaaatttttcttcagttaaaaacagaaatagaagcgacggttttgacccattttacacctatttatttcaggctctcaccacacacttgttcatgggcgcagcaaagaagagggatccacagagctggagccatgagggctgacacattggaatgaaagctggcagaattcgtagggagagctttcccatcctgccagccccatgtctggctttaagacagttctattagtgaattaactgttctcaaaaccccaaattaatttgaaccgaatgttactaaaaatgaaatagaataaagtgacctactcttgcctcatccggagttattacgaaggagctccgcagcctgactgagctctggagagcagggctctgtgcacacgcctcctggtccagaggcctccgtgaccatccatgatgccactctgtcccctcagcaagctgcctttttcttcctagcacctgccccagcggtggtatgttttccagtcagttaccacctgtctcatcagaatggaagctccatgagagcagggcctttgtcttgtccccttgtatcttcagtgcataggacagtgctgacacagtgcagagtctaaataaacgctgttgaacgaa

SEQ ID NO: 764 - DNA, 102879 bp, Homo sapiens; identical to SEQ ID NO: 763
